United States Patent 9,328,346 (POLYCOMB-ASSOCIATED NON-CODING RNAS) - sequence listing, part 111

SEQ ID NO: 21526 - RNA, 312514 nt, Homo sapiens
gcgcugucgugucgggaauggaauguguaaguguaacauucagaaccggguaacauucggcgaccgaacgcggcggucggcagcguucgcgcgggggccugcgaagcgcugcucggggccggcacugcccgcggggaggacgcgccgccgccgccacccagcgccgccgccgccgccgccuccagccgggccgccgcgcgucccgggggccggccccgcgagcgcaggaguaaacaccgccggagucuuggagccgcugcagaagggaauaaagagagaugcagggauuugugagguuacggcgccccagcugcaagaugcacuagccggcugaacccgggaucggcugacuuguuggaaccggagugcucugcacggagagugguggaugaguugaaguugccuucccggggcucauuuuccacgcugccgagaggaauccgagaggcaaggcaaucacuucgucuugccauugauuggguaucgggagcuuuuuuuuucuccccucucucuuucuuuuccuccgucuuguugcaugcaagaaaauuacaguccgcugcucgcccgcccugggugcgagauauucagccccgcucucucccgugcauugugcaacccaaagaugaaagaccgaaggggagaaaguuaaagaaaucgcccacaugcgcuggaucaguccacggcuuggggaaaggcauccagagaaggugggagcggagaguuugaagucuuuacaggcgggaagauggcggacuggagcugaaaguguugauugggaaacuugggugauucuuguguuuauuuacaauccucuugacccaggcaggacacaugcaggccaaaaaacgcuauuucauccugcucucagcuggcucuugucucgcccuuuuguuuuauuucggaggcuugcaguuuagggcaucgaggagccacagccggagagaagaacacagcgguaggaauggcuugcaccaccccaguccggaucauuucuggccccgcuucccggacgcucugcgccccuucguuccuugggaucaauuggaaaacgaggauuccagcgugcacauuuccccccggcagaagcgagaugccaacuccagcaucuacaaaggcaagaagugccgcauggaguccugcuucgauuucacccuuugcaagaaaaacggcuucaaagucuacguauacccacagcaaaaaggggagaaaaucgccgaaaguuaccaaaacauucuagcggccaucgagggcuccagguucuacaccucggaccccagccaggcgugccucuuuguccugagucuggauacuuuagacagagaccaguugucaccucaguaugugcacaauuugagauccaaagugcagagucuccacuuguggaacaaugguaggaaucauuuaauuuuuaauuuauauuccggcacuuggccugacuacaccgaggacgugggguuugacaucggccaggcgaugcuggccaaagccagcaucaguacugaaaacuuccgacccaacuuugauguuucuauuccccucuuuucuaaggaucaucccaggacaggaggggagaggggguuuuugaaguucaacaccaucccuccucucaggaaguacaugcugguauucaaggggaagagguaccugacagggauaggaucagacaccaggaaugccuuauaucacguccauaacggggaggacguugugcuccucaccaccugcaagcauggcaaagacuggcaaaagcacaaggauucucgcugugacagagacaacaccgaguaugagaaguaagugucugggcuggcgugucuuugggagucagccuugggcucugccggccuugguccaggugugaaguugggggauggggugagggcggaugagcccucaguccucuuuccccuuugagccuggaacugagcaaauccgguucgggugugcagcuagaggcuggggacagagaguuggagcuccucgggcaaacugaaaagccuggagcaccuucucgagccaaguaggugacaguaucucccucuugcuuaggaaaccugcagggcggcgugucuccuguuaagagucgggguuagauccaaguuuaguaacugcauuucaggcauggguacuggaggguguuucugaggguaucuagagacccggagaggcugugaucuacccaaaguccagagaccuuccaccaagagugaugcuuuuguuugcuuuucucaugagcggggguaccuacuuucccaggaguuuucccaacuucacauuuucuguaagccuguaauucauguuagccguggaaauguuuaaauuguaucgaacuuuguguggcccuuuccucucucccccguggcauugacuuuuaugaagggagacuguaaacuuguugggccuguggcuuugcaugcaugcaugcaugcaugcauucauucauucauucauuuauuaauucauucauuucuguacauguccugucucuuuccuaggauaaacuuuuuuuuuuuuuuuaaaugugggccucagucucacugucuaaacuccaguugcuaauuuagauuucccguucccuuuuuucuuuaucuauuugcauguaaauuguagacuguuacucuuugaaugggugugagaugccuccuuacccucuguagugaggcaaguuuuguccaguugcuaaguaacugaauugguuacuuuguagaccuuuucacucuuccuuuuuccuuccccgugacaguaacugacacgggauuuggagucaaagcuaaauuccacaaaucugcuuuauccugagcuugguggaccaguuuccuaguaggugggguugccgcccagacucucacuuacaucuggcugugaaagaguuagugaguuccuacagugcauuuccacguuacgccaguuaaaaaccagagcagccuugugcuacccagggaaggaaggggaaccucucagcugaguacaagaggaacuggcagagguuggcagauuuugcaauugauucaugaaaugcagaauaggggaaauguuucgcaaaccugauuggaacaggaagggguauggugggaaacuggccuugaaaugaaagguuugauugucgucugugcauuuuuucagacacuagggccucuauaggagugauuggaagggaaauuaaaguccuccaagacuugaucauagagagugaaggagaaaguaucaagcacucagauucagcuuuccaacccccaauaccuuuugcuuuucaggcauaagaaaagccggagacuaagaucaauuaugaauccauauuuuccucucauccaggggcaguuauguaugaaugugcaguugcaauggauuacaguuuucucauaaaagacauuuaaacuaugguuaguaaugaacugcuuuguuuauacgacauuuacauugaccuauuccugugggugcuuguaagaaaaaaaugcuuauagccuuucaggaauuucuuugucugguuuaugguggaguaacucgagaugaagucuaaccuuucagugucuucuaaagcagucucaaagaauucuguggaaggauucuguucuucauccuucuaaaagggcuaaagcugagauuucagcuuaggaaauuugaauuauauauauuggaaaauacccuuaauccaagugaauaauaucuuucuuacccuuuuauucccaaaauaaauauuacguuucuacguuuucuguggaauggaagcauuuucuagagaucagcaaugaagggagggguugguuucuuuaaaacuuuaauuuuuacuaaauuuaacuaauuuuugaccucuuugugaucgggccaagaaauaugacacccacacuuugguuuauguuuaaagaccacaaggggucaggaccucaggauugggucugaucagaaaaguggcauuucguagaaaagcaaguuugcucuuucucccaagcagggaucucuuuagcagggacacuucuggauuuucauuauguuccccuuuggcauaccuuccagcccuaaacuugcauguagcccgggauggugcugcgaaagguuuacauucacucgccugguacaccuggaguuuugacucauuccucugaguggguuagcagaauuauuugucuuugagaaauggugcuuacaaacuuuauugccauuuauuauugguuuuuuggaacacaugaagaugaagcaagaacucucaaauuuggagauacgcuagcagagcaagcaacgugugucgugcucuggcguaagagcaacuacugugcuacuuauauugaugcuuucuggaagauggccuuagauaugugagaugcagaacuccucaagucaagauaugccagucucucuagcguuuuggguggaggcgauauugaaguuaggucuguagacgugaucuguguaaguuugacuucucauacugacucauggugugacuuuugauuagucaccuugagcauuaguuuggguuuugcagaguggguuucagacugcuucaggggugcucuaagcacucauuugguaauagcuuguaaaaacacaaucaguuuccaucuagcuuauuagcaaguguccaugggaaaaaaaaagcuucaguuuaauuugcucccucaagcaaucaccuguaaguuuccuuuggagcaaacuuuaugcagccugaugacuagauugaaaauuuaugguauuauggucaaguuagaguauauacaaauauagaguauauacaaauguuucaacuaaaaaaagguugcuuuuggugaaauagaauauuaugugucgauaaagaauuuagugcuaaaagagcaaugacuucugucucaccugugccuuugugaaaauuagacguugauuacaaagguauagaaaagcugcaaggaaugaaagaaaauacuuuucucuuguaauagagagaaaauaaauuucuuuugucauuuuuugacccagacguucaggauuauauuaaaauaucaauuuuuaugauagcuguaauuauuuuuuaucaguuauauauuuuaacacauguggauaaugccagcuaaaacaagucauugcaguaauuagaugaguuguagugacgcuuuagagaaauucuuuguauuuuauguucuuucagcuacuuaugcauccuuauagaauuauuguacuuuugcaugaacuucauaguucacaucccuacaaagggcauuauugugaaacuuuagauucagcuauuugaaauagaagaaagagagggaaaggagagguggcuucuaucuuugacccccuccaaggaaagcaagggugaauauuuaaagcuuuucuggaaacaggcaagauugugugcaauucuuuuugguauuucccuuuuucuguguuugcuaacacuguaccucaccauccugguaucuucaagggucuuggagguaagugaucauucagcuuccaacauccugauuuuuacagauguagaaacugagggacagaacguuucagggguuugcuuaaggcaagaaaauuguuuagugacaaggguagcaccagaaugcaggcccccuuaauuuugccuugaucugcagucuuucauuucuauucucaggcacccuugaaaauucaccagccacaaggagauccuuauuaaugguguuuguuaugggauuucucuuagaauucuucaguaaucugaugaaaacuuggaggacaaccuuugcaaaaauaaaugauaaguaaauaaauaaaagcauguacacaauuuguuauaugguuucaggggcugacacacaccucccgcugagggcauccucagacuuacaaacucuugcucugggaguuuacauuuugccuguuuguuuaguuggguaggucuguggagcuguuuagucuaaguaggaguuuuuugaaccuuucaauuuggcccuaagggguuuagggaauagacugugcauugacugaacaauaaguugaauuacaugcacuuacagcaaaaagaaaauaugugcaaggcaaguaaaaaugcuaaauacuuuuuucuuuuuuuccucauuaucccaaacuguauuaacagacaccuugagcaaguucaugauccagcagugaaccuuagaugaauguuuuccuucuccaaaaugaaaggugggaauugagauucucggguuuuaaauguaaaauauuagcaccuuucuccccacaguuguacaauagcacaaaagcauuucuaacauaaacccaauuagcacaguuaaaaaauaagguagggccagcccuauggaaaauuaugaaguuggcaaguuugucuucugacaccgagauucugauucucuccuuccuuucucgccucuuucuaaaccugcuuucuggagagcaccugagaaccucaaucacaaggaaucccugaguaaauguugggguguuauuugcuacuuucagggacauuuguauuauuacugaauucagccuagcaaaugaggguuuccaguggagucugugaucuaagcuaggggccugcaggauuuuacucuacgaauaauggcuuguuacuaagguuugggcagguccugcccauuggaggccaccuuuggucacccugacucugacagcaacuuuggauggcaaaaggggagaugcuacaccugcaggugguguuaguucuuucugucagaaggcuugaggaucugccuucucagaacacagugcuagaaacuccugccaauaaugaccuuuaauaugccaaugucacagcagaaguugugcuugguagggccuggcugcuuugcucacaaccaucuugaaggugucuucucaggcuauguugcugguguguaaacggaggcaaacggugguaaggugacuugccugaggcuacgcagccuguaaguggcugaauugaggcuaaaacccagguuuuauggcccgaguugucuguucuuuucacggagagaagaacauucauugcuaccucacugcauucgcuuugcagcacugcauauucagaaugaaccaggugagacaaaguggucauuggcuucugcaggcuucuggacauguuucauguucaaacaugaacacagaagcuuauguuuccaugagguuaauaacuacagguugagcuucccuaauccaaagguccaaaaugcuccaaaaucugaaacuuuugaccacugacaugagcauuuuggauuucggauuuuugaauuagggauguccaacucuaaguauacaaugcagauaucucaaaaucuaaaaaaauccaaaauuugaaacacuuuuggucucaagcauuucaagcauuuuaggccaaguccuucucagccuaaauuguguauuugaaacaagguauuuucugaacaagguguuugagaaguagcuauugccauguaauaauuaccuagcgcuuccuucauacucuggaagaagaaaauagugcguuuuuuuucucucgaggucauaaugugaauguuguaugcaguggccaugucaucagaacaggugugccagcccccugcauggaacauguacaugcuucagguugugcggaauuaacuuucuuuagauaagggauaacuagcauucauuucagauaacagauauucaaccuauaauuguuuuuauuuaaaaccucuuccaccuugaccaggcuccuguaauaaacaggauucccuccagacuagaagauuugcugaguaccuguuauuugaauuuacuuuuauuaguucauagaaccuuucaacaacagugugaguuagguuauauccccauuuuacagauuagaauguaggccccugagacaguaaaguaacaagcucagugucacaucuagugagaaaauggcaggguuccuaccuggguacuuagauuccaaaguccauucucuucuacaaaauguuaccaucuuaaagaaucaaacagaguuucucccuguuacauauuaacuuuuaauacgugaagcgugagucagguguuuguauauggaucuuuuuuccauugcuuuacuuuaugaacauguuucccgaggaaaaaguuuggcucagagaugucauaaagguggcuccuaaaccugacauuuaagcacugaacuccuucaacucuucuguucaaggggcauuggaauuguuucuauguagauucugcuuguaauucucuccuaggguucuucuaagaaaagugaggaagcugauuagcauucugucugugugaccuuuccccuacugauagcauccugcagggugucccucugugauuguaagugaaagugaacccuggagaugucgcugcagguggauggggaucagagugacugcugccccagguagacacugugauccaauagaauagaaaugaaaggccuaugggaauauucuguuucuggaacauaccacacccaaugccuccaggaccuaaggcucuuuaaaagaaaaacagugcuuaaaaaauuauaagcguuauacacaggcugagcacaguggcucaugccuguaaucccagcacuuuggaaggcuaaggcgggaggauugcuugagcccaggaguucuagaucauacuagccuggguaacacagugagaucuuaucuuuacuaaagauaaaaaaauuagcugggcaugguggugcacaccuguagucccagcuacuugggagacugaggugggaggauugcuugagucugggacauugaggcugcagugacugaugauggcaccacugcacuccacccuggacaauagagcaagaccuuaucuuucuuuuuuuuugagacagaguuucccucuuguugcccaggcuggagugcaauagggcgaucucggcuuaccgcaaccuccuccucccggauucaagcgauucuccugccucagccucccgaguagcugggauuacaggcaugugccaccacacucggcuaauuuuguauuuuuaguagagacgggguuucuccauguggucaggcuggucucgaacucccgaccuucggugauccgcccaccucggccucccaaagugcugagauuacaggcaugagccaccaagcccggccgaccuugucuuucaaagaaagaaagaaagcaagaaaaaaaaaaguaugcauagccucuguggaagauugggaaaauacagaagauuggaauacauaauuaaauuucuuuccuaauucuauuauaaguguuagccacuauugguaaacuuugauguagucagucuauucuagcacauauauauaccuauauguuuauguggcucugucucugcauauccaaguacccuggauagauagguuaauuauuauuuaauuaauggugaguaaauaaugaauucaacacauuuuucuuaagugucuuguuugugccagacacuuauguauuggagcuggggcuacuucagcaaacaaaacaaacuccuacccauucaccuuaccauucuagucugucaguuuuguaaaguugaagucagacuuuaaauguauuuuuggauguuauuuuuuuuccuaacauuauccaagggcauuuuucuguucuaguaaauuguuuggaaaauaggauuuuuaaggugugauuuuuuuuuuuuuucuaacccaugguuggaccagaguuuguuuaaccauuuacauuuucuuacauauauuuuauuuguuuauuauuauuuugagacagagucuugcucugucacccaggcuggagugcaguggcgcgaucucggcucacugcaaccuucgcuuccuggguucaagggauucugcugcuucagccucccgaguagaugggauuacaggcacccaccaccacacccggcuaauuuuuguauuuuuaguagagaugggguuuugcuguauuggccaggcgggucuugaauuccugaucugaggugaucuacccaccuuagccucccaaaguacugggauuacaggcgugagcuacagcacccagccuucuuacauauuuaacuuguuuuuuuuuuuuuuccucauuagaaauagucuguaauggguuucaccuuguugaguguuuucuucuugacuagggucucucucucaaaacacaauauagaacuuccuguccuguccucccuaacuccccacuccaaucccauucugggcuauagcuguuuuuaaggugaacacccauuuagugaaguagccaucauuaaaugacugccuagauaaacauuuguagguguuaauugguccugccagggggccuuugaagcuccacugcucuguucucuuugaaguuuuguuuuucuccagccaaaauccucccuggucucuuacugagcagacaucccuagacuucacuccaagcacugugcauauaaccuugccugggauuucagaaucugcaggccuuaccuagguagauguuacucuucuagcuaauuguaugcaguuuaucaaggauuuguuucuguuuucucuuugguuguugacuccauggaccauaggagguaaauuuggacaggucgcuuugaccucugggcaucuaaguaaggccugggauuuuaaguguaaaggaggcacuauucuaagugauuuaaaaauggacagaaaaggagaaauuugugaggauacacagccucuuuuuguguacccuuuugucuucugugaagcccuuuaaaagggagagccuguggcccugcaccauaacaguagcugaucccccaaaguuccuggacuagguuuuuaacuucucagccucaguuuccacaucuggaaauggggaucauaauacuggucucauagggucguuaagaaggucaaaugagguggaguaugugagacuguaccuuguaaacauuaauguguucuacaggguggugguauuauuaaacucaucuuccugcuauuuccuaaucaacaacagagguucauuuaguuucgaaacuuagcucuuccuaacuaagccacagcaauaacuuaucucuacuuugauacuuaaguccucaggaaauugugguaggugcccuggaaguccagccauuguuucuguaaagaccuacaggggucuucaagcuggggcuugcaugugugugggguagggguggaagcaguugagggggaucccuggggcagucagauacuuccuugacuccauggccuucagguucccagguugacugcucuauuaaugcaggugaucucuuuuccaguugacuuuuuuuuuuuucuuuuugagauggagucucgcucugucgccaggcuggagugcaguggcgcgaucucagcucacugcaaccucugccuccuggguucaagcgauucugcugccucagccuccugaguagcugggacuacaggugcaugccaccaugcccagcuaauuuuuguauuuugaauagacaggguuucaccguguuagccaggauggucucgaucuccugaccucgugauccaccugccucggccucccaaagugcugggauuacaggugugagccuccgcaccccgccuccaauugacuuuuaaguccucgccaguugaggguaacauuuggagggacaccgugugugaguggagcucagcuacugggaagccucccucggccgguucagcaggcccuuauguugcaaagagccgaaaaucauuugggcuaccuuaaguuuugggauuuauugugaggggacauggggcagaaacugaacugaaacugcucucguaaguucucaggacccaccacaauaccugggccaggcuccuuuguuccugcucuaugccuucaugucuugcuuggcuagcaucucuggcccugugugugucuuccaaccacuggccagucuuuccugaauucucucguccagggccuggaggagaccagucggauugacuuuuccaguaagcauugcuugcuggggagagccauucauauuaggccacgucuuggguaugguggugaccuggucagugaaacgacugcccugucauguugccacucuugauuuacuugguggucauccucuugugaaaacagcccaaaguugcuuccugcaacagaggacugugguuaggggaaguuggcuguggcaggcgcuguugaagccauauccuguuggcaugcacauauuugaccccaguugaugaugaggauaacagcaacagcaacucauaucugagggcauccuaugugaggauaacagcaacagcaacucauaucuaagcacauccuaugugcaggguaaugagaaguaucuucuuuaaucuuuauguccaccuagcaggaagauacccauuuuaucuccauuuuacagaugaagaaacugaagcagacagucuuuaaaagugguuugccuaagagcauacacauagcagaugaacugaggcccucugacuuuugaaccuguguccuuaaccacagcaccguacugcuuuugaacagcuggaacugaugucauaaagaccacacacucacaaacaauaguaugauugauuucuagaguaucacuuggauuucuaaccuagaauuuauuuaaucuuacguuagacaauucuaaccuguuagguaaucugguuucucagccugcaguagauuagaagcaguacauuuaaaaaugaaagagggauucuugcagauaguacugggaagaaaggacagcugguaacccaaauauaaggaagugggccaggaaauuauaaaauguaaugcccagaagaaguaaagaaccauggcaauugaagaacagcuggcccaaugcccaagaauguguucuacacccuccucaggaaugaaugugcuuccaaguccaacaccuacugcccugccugucaccaagcacagcuucuguggauauuugaugaacuauaacaugguacaguauuggcucugaaacaucauuuguguucacuguccuuuguuuaagaauguagaaaaagaaguaauguguuuuauaacuuuuuugaaaaccguaugauuaauaaaauauacugauggucuuaagaguaagaucuccauuugaaaacuugucuaccaacuuuagcaauuuccgccaaggcuccagagagacagggucuccuuucgguuagcauuugauuucugcuacuuguugcuaacucugauuucuggguuuucaagaugcauaucaguuuaaaccuaggugaaaugguaaguuuucugauccugugguguaggccuguagugcuagcuauucuuuuuuuuuuuuuuuuugagacagagucuugcucuauuguccaggcuggggugcaguggugcgaacucggcucacugcacgcuccgccucccggguucaugccauucuccugccucagccucccaaguagcugggacuacaggcacccgccaccaugcccgacuaauuuuuuuuguauuuuuuaguagagacgggguuucaccauguuagccaggacggucuugaucuccugaccucgugaucuguccgccucggccucccaaagugcugggauuacagguaugagcgagccacugcaccuggccacuguguuagcuauucuugauggacuaguaucuagaaugacuugggcugugggcucagguaaagagaguagcuagccuagggcuagggcuggcccugccugccuaaggcguggcauauggauguuaggguuuggagaagggaggggcccaggagggaacaagggacaucucgucucuuguccuaugguuguccuggcagguauguugggcauuucacacuccuagcgggggccuagcuuggacguguagcaggcacacuuccugcacacauuucaguguccugacggauugguagaaaucauccacagugccacugauagaaaauaugaucaccacccugcuugaaugggccuugggggugucucauaguuaauucacauguuacuaaggcaggcaagcucugccugccuucucauccccagccccagggcagagccacacuccuccuccuucuccccgcuuuccccacacaccuccuuuccacuuucuggaaagccagcacccagcugcaucugacuucuuccagagucacuuccuugaugccucagacaaggccaaauucuccugguaugugcucauauagaacauuuaacacccagcugugguuuuccauucaguuagcuguuuguuugucucucuccaguagauugcacagaaccugaggggaggauucauguugguuuuucauugauuuacucaacagauacuuauugagugccuacggugugcaggcacuggggauucaacagugaauaagaaggugcacguaccugccuucuagaugcucauagccuaguggcuggaggcugaggaucauggcauacacauuuugucauauauuagaaggugcuggaugcugugaaguaaagcaacguauggaaguggguuaaggcagugggucucaaccuuaacuguacaguagacucuccuggggagcuucugaaaaagccaggccccaguccaggccaauuagggaugaaguuccagauuuuauuuauuuuuauucauuuauuuuuauuuuuuugagaaggagucuugcucuguugcccaggcuggagugcaguggggcgaucugggcucacugcaaccccuaccucccagguucaagcaauucuccugccucagccucccgaguagcuggaauuacagauauguaccaccaugcccggcuaauuuuuuguauuuuuaguaaagaugagguuuugacauguuggccaggcugaucuugaacuccugaccucaagugaucugccugcuuuggccucccagaaugcugggauuacaggcgugagccgcugcacccagccggccgaaguuccagguuuuuaaaaagcucaccaggucguuuggaugcaaaguaggaguggggaugaggaagaauuuugcagcuuuaaauauggagggaaagaaaggccuccuugggaaaaugacauugagcucucguaccauuauaccuucagagccucagcaccaugcccgacugacucacaggaagcacucaguguuuguugcauaaaugaaaaaaauuuacauuuauuuaaccgaagggaauguuacuacuguugauaugguauauucaaaguauggagucucuaaauguuacugucuuugguuuguagcucaggcauuccuguuccuacuccaaguucauuguguucauuugcugguucacccagaguuucuugucauguucaaaugggaaguuucucccaaugaaccuuuuuuuccccaagguauccuuucuuccuuccuuuccuucccucccuccuucccuccuucccucccucccucccucccuuccuuccuuccuuccuuccuuccuuccuuccuuccuuccuuccuuccuuccuccuuccuuccuuccuuccuuccuuucuugacggagucuugcucugucgccaggccgcaguggcgugaucucggcucacuguaaccuuccacucccugguucaagugauucuccugccucagccuccugaguaccaccacauccagcuaauuuuuguauuuuuaguacagaugggguuucaccauguuggccagcauggucucgaucucccgaccucgugauccgccugccucagcgucccaaagugcugggauuacaggcgugaaccagugcaccuggccucuuuucuuucuuuuucuauuuuuacuauuguguuugauauaaguaucacugaagccaaauuaaaaugaaccaaaggguuuugcugcauaacacaaauccaaauaauuuauugguacaggaaaaaacauuaugaucuuuuuaucauuuaacagucuguagauauugaaacuucccccccuuuaauuguaguuuuucucccaaaagauugauagaauaaaacuuuuggcucacauuuuuugcucagguuacguucaaacucugcuaacugauauugaagcauugccccagagaaugcaguaacacagggcuuaauugagcuaucaggcugcuaaugaauucauauugagauuuaucauuuaauuaaaaggcaaagcggggaaaagcaaagggaagguguacaauuguuccuuccgcuggccuccauuuccuccauuuaaaaucguggcuuguuuguuuaguuuguagaauccugugggauauugcauagaaguacucaaggugcauagguaaaauagaggguguccuguauugcaaugacuugacuucuuagugggucuuaaaaauugauucagauuuggugacaaucauaugacacuugauuaaguagaaauuauguuuuaugauguuuuuacaaaagauuaggaaggccauuuuccaaaauuauuccuaggucuguauaucugaagcaaucugaaaauucaaucagagggaaucuaauacugagaugcuuuugcuuuacugacagagaguaaauuuuucuugaaaacaccauuucuuauaugcuacaugugucuuuaaaauucacaccugcauugaaaaagcuaccuuuaagcaacacuuuuuaugauaacugcauuuuuaaguaugcaagugcaauguugcaaaccugucaaugcagggcagucagucuuuuauugauucagaguggaaauguauaauauuuuuuguauuuagauuauagaguuacauguuuuuaaaaaagaacaguauuuuaugauaaguuaaaauuuaaguaccucaaugcuuaguacgguuaaaagguggaguaguguuuuccugcacuuaguuuagacuuagcuauaucuaaggaguaacucaagcagggauaacagagggcaaaaggauuagaugucaaaacaaaucuuagguuucuaugaaaauaagcuaagaaaugagcccccuuggaugaaaaauaugaagugagaauauagggaguguuggugagguuugaaccucuuugggccucaguuuuccucaucugauuuuccuacacagagaccucugauugaagcugucacaucuguacaugcacauguaugucugcauguguguuguauguuugcucagggaggagggcaugguguucaacugacuccaaauauuugauaucagacaguuuugucuggagagaagagcaauaagauuguggaagugauccuaaaaucuaguuuaacucuuguguagcguagacaaaaaguagagauccagggagguugagcaauuugcccaaggucauguaguugugaccgaauccgaaauggaacacacgucucuugacuuccagcugaggauugcuuagagguuacacauaaggguucugguuugaauucagauggugacucugucacuagcuacgagaccuuggucagcuucccuguuuccguucuucacuuguaaaauggagauaacaauuucaacuucauaggguugcuguuacagggauuaaaugaguaauaauacauguaauaugcuuagaauagugcauggaacauaguaaacacucaauaagaaacuauuguuacugucauuauuauucugucuguuccauuaaacuacauuugaugccuguaacuucaggcuuaccguuuguauguguuuaucaugguuuuaauuucauuucuuucauuugaccuguuuacagcucauuauaauuguagugugcaauauuguacauuagcuugccagucauauagaagcuccuggugguuuggcaagugcccagaauuccaaccaccuguuggaacuguugccaaaauacaguagauuuuuauuucccagauguuguucaaccgagaguacaaaucauuaauaugacuuugugucuuuaaaaaaauucguucuccuauuacaaaaguauuauguuucccacuaguucugugaagcugagcagucacagaggucuuguuccugccucuugaaaaaacauuaaaacggguagcaaaugugcugggggucggucaccugagauagcuuucagagauaaaccugugcgagauagagaagggaaaacuauuuuucuuuucuagcaauccagguagccaagcaagugauuccaccgugcaggggcacuuagcaaaucaggaagcgcgauaacagugaaugacuuucuacuuucaacaauuugaagggcugcuaacaacugauggcuucuucuugaggauggcauuaucaguagcagcaggacccagaccucugcaccguuucugcauguuaaguuuaaacaguguaugccuauccuugaggauaaacuuauaacagggccaagguaaaacuuagagaagaaauucuagccugugauuugaagaucugggagcauucagacauauuggaacuuaaguuuucauucuuuuucucaggagacaaagcugcaauuaugaauaaacacauuguaagagccuuucugugauaccguguuggccaccaaauccagaugugaucugauuccuauccaguuccacauuguagcaggcuuugcugucauugggucaucuguguuccuugaaacuucaccauauccaaaaaaagcauguuagaacaggauuaaauucuucuuauacauuacagaauuauacagaggguucucuaacauccacuguucaaaaagagacucuggcaaaugguucacuaaguauaaguaaagugagauggaaugucugaucccaaauuugauagugcuuggcucaagacaggaagcaggguauguauguuaugcacaaugaugauuauaggccuguauuuguauguggaacauguauucaaauuucaaaucuuuuuuuuuuuuuuuuuuuuuugcugggaauuuuucuggagcaugugguguauauuguuuucugccaagcaucaaggggcuguuuuauaaagggcuuuuuugggggguggggggaguguauccucuccuuucuuuucccaaaguuuucuuguaucuucuccacaaaauaaaaauuucuuucuucuaguucacugacuuggagauucaagcagcagcacgauaaaaauaccauauugcauuuccaaugaacuccuuuaauuagaugagaugaauuaauuggauuuuugggacaugucugugaaaguauaagauacucacuuuuggaacucccaggcaugguguggccugggagcuuucucaguuugcuccuauucaggacaugguguaagaacugucauuugaagccugucauuuuagucccccuuggggguuuuacaaauggccuagugauuuuucagauagcagagaauaaaucagcagugauuuggccugcccuucagccuagggcauucccugguuaucaccagccucaucaucaggugcuuguauuacacguuuuucuguccacaccggcaggugagaugguaaucuaagaguugauuuccaacacgugcggagggacuuucgaaagucccccuagucccgguauucucuugcccuguauaauuuuagggguccaggcauucaggcuuggaucguccuccuuaugucuuucagggccuuggaaaauucuggaauuuagacaggggcaguaagucaguggcuguagcccuugaaucccauuugggaccuuaacucauucuaccuugcauuauaauuauuugguuuuuaacugucuagguuucuguacuuucagggguaaagcugauucauucuccucuguaucccagaguccaccuccaaggugguagguugcuugauaggugcuuaguaaauaucauauuugauuaacuuuuuguagccuccucuuuagucuagaaauucuagaucccaaauagaagguaagauaugguauauucuggacuuuuaguuuucuauaucuccuuuucaaauacagaccuagggugacagacaaaaaaauauugugaucaaaguauauagcauuuccuuucaugguggaaaaaugugccugauaaauguuuucucugcauuauuuuccuccaaauauauuuuaaugacaguuauuuggauauuucacacuuuauacucgacuugggcucagauuaagucuuguguuaguuauaaccuugaauaacaauuagguucaugagaacagggaugguguauauuuguuuuuaaucuguuucccagcacuuaacccagugcugaguuuauagugggucuccaagaaauacuuguugaaugaguggcuuuuggucaugguggccuuuuagugcagaaaaacuuuuggaucugaauuguuagauuuacuuaauuuuuuuguaauaacacagagaauguugaauagaaaaaguaaguuuagaagauacauauauauauagagagagagagggagaguuagauuuauuuauuuauuuauuuuugugagauggagucucgcucugucgcccaggcuggagugcaauggugcgaucuuggcucauugcaagcuccgcuucccagguucacaucauucuccugcuucagucucccgaguagcugggacuacaggugcccgccaccaugcccggcuaauuuuuuuuucuuuuuauuuuuaguagagacggaguuucacuguguuagccaggauggucucaaucuccugaccucgugauccgcccgccucggccucccaaagugcugggauuacaggcgugagccaccgcgcccggccgacuuauuuauuuuuuuguaauaacacagagacuguugaauagaaaaaguaaguuuagaagguauauauccauaucucuauauauuuuacccuccuugagguucgaaauaguaggagugaaauuagagauuuaccaaaaucggaugaugauuugcaccuuugaaauaacucaugccuuugauugucacuuuagcuacaaguagguuccuggucauaacuguaauaucccuacaagccugcuuuauggaacuugagcugcaucguauugucuaagauaggccucgguucuuggccgggugcaguuuauguucuuugaaacugucuccuuuuggggagcaggcugagagauagugaacucauugaagagaauuguagcggaacucucuagcaacuuccuaauagaagauguccccuccuugacuucuuugguguuucagcugccccauugaaggaagggacagacugugcccuugggaccagagccuccuugcuaacugucugcaaaugaaugaggcaccagcaugccaugcucagccaaccaccugugguacaaaacagcuuuccuggacucugaucccuuaguauaaaccuguguauacaggauucacaaggauauaauucuguggugucaucuaucaggcacaugcuuuuuuuuuuuuuuuuuuuuuuuuuuuuuuugagacagaaucucacugucucacccaggcuagagugcaguggcccuaucuuggcccacugcaaccucugucucccaggcucaagcaauucuccugcaucagcuucccgaguagcugggauuacaggcacccgccaccaugcgcaguuaauuuuuuguauuuuuaguagagaugggguuucaucauguuggccaggcuggucuugaacuccugaccuuagguguucugccugccucggccucccaaagugcugggauuacaggcaugagccacugcacccggccagggacaugcaugguuuucuacagaguggcuucagcuuccacgguucaucccuagacaauuuugccuuuuuuuuucaagacacggucuugcucuguugcccaggcuggaugacaguggcacugucauggcucacugcagccuugacuucccagggucaagcaauccucccaccucggccucuggagugccagcaggacgugugccaccacacccugcuaauuuuuuauuuuauuuuuuuagagaugggaucucccuguguugcccgggcuggucucaaacuccuggucuuaagugguauuccugccuuggcaucccaaaguguugggguuacaggcaugagccaccacuuguggccuacuuggcucuuuuuuacagguuuuugguugacacuucucugcagaauagcaccuggcaccucucaccaccacugaaaaggauggaauuuuauacaccucuuuuuccuagguucucucuagcaguuaccaagggaccaucggagguacuuauuguggcuguuuacaaaagccuugccuccagucugagucaccucacccuacucucugcuucuuccuuuuagcuacucuuuuuuucaguaacccucccucuuuccucugaaggcuugugcuugcacacacaggcagacauacucaugcacgcgcacaccacacaugcuuccuguccucuggcucucccguauccuauguaaaaccuccuacugucauuuaagugaaacccuucuagcacauaagaguuuucaucucagaagcucaauuuuaccuuucacuuuucagauagagaacacccaagguuuuuaauaaucuggcgaauguguuaaaaaaggacauauuuuuuaaaaucuagauugcaaaaguaauacuguagcauuguugaguucagacauuauagaaagugaaaguucccuaucauuuguuucccauaaccaccuugaauaguuuaguggauauauuuuauucuaagcacaugcuguuuaucuucuugaaaacaggaucauggcauagauauacucuuuuguaauuucucuuauuagaaaagaagauuaaucauauaucaaacacgauuccaugucacuccauauagaucuuucccucauucuguuuuuacagcuauaagggagucugcugugaaaaugcuccuucgauuaguuuauaacugaguguaaaauuuggcauuucacucuugauuauagucuuuuucuguauauucacccccaauucuuugagaaugaggaguacccuaauuuuguaagcaaaauuuuggggggcuuuggggugaaaacuaauuuaaaugcuuauuuucucaguugccuaccuccauuuaaaaaucaguuuugagggcuauaaaaaaaccuuaugauauuaaggccuuuuuuucuguauaaaaauaacauacaauuuauuuuuuccauuuauucaaaagacugaauuacacuagccaagaaaugaucagucucguguaaaagaauaacacacguucuccuugaaucaagacuacucugagauucagaaaugccaguagcggaagguggggugugaccccuuaaguaagugugacuaguuaaagguguauggauauucuuuguggaaagcgggcugccagauacaauuucaggcuguuucauauuacuucacacggugcuuucaaacuguuuauuuucucucuuggcacuagugaguacagcucauaacuggccagauaauaucuaagucuaggaccaggacagugaauggguuuuaccaugauuugaucaaaaguaaacaagaaaacaaaagcagaggaaaaaaaaaaaaaagagaaggcaucacauuuuucucauuguggggcuaaaaugcugcauguugaauuuucacuuucugauuagaacccacaguugaacagaucugauuuauuuuuuuggggucaggaagaaacugucaaauuuuaguuugacuguucuuuucuuuaggucuccccccuuucuuccccuaccuuuuuuuuuuuuuuaagcauuacuauauuaaucagauagcagccacuguuugacauguccuucugugguggcugcagauuaagucugaaccgugccagaaaucucguugcauuuuuugauguagcagaaaugaaccugguucauuccaucuuaacagcuuuagccaaauggcucagaagggaucuacccgauuucauaaagaagaguuaaugugcagucugguuuaauacaggugcccuuaaaauacauuuuuguuuuguuuuguuuucucacuuccaaguuuaacauguccauggacauuggcuuuaguuuccccaagaugaguccaugaaugaccuuguuccaguaucccuugcugauuugaguucccaaguaauaagccugggaauguuuucagugcagcagccgggagaagaagggggauucagcaguugcuguucaaugcauuuacucucuaccugcuggcuucaaacaguauuaacuuuaugugcuccuugugcauuguguuuaauuaaaagcaguucucuucacagaggcacuuguaggauuuuuuuuuuuuuuuuuuuuugcccugaaacgaauaaaacaaauaggcgucugguauuuguuuuguauaacacaauccccauaaaaugaagaguaauaaaacauaauuaucuguaaaggcuuguuuuauaagccugagaaugggcuuguuucuaccagguuuuuauguucauucauaggagaaagaaucucuuuguacauuaauauguaacaacaauaagaacaaaugcuucccaauuacaugcaugaaucaaacuuaucuuuuauuaaaaaauuuuuuuucuguuguaguaaaaguuugucauuaaauucuuucuguguaaacacauuagauugaaggaaaauguuuuccuucaauauucuguucaacuggcauaacuuuaugauuuuuuucuccccagcauaauuaaagaaacaacuuuaugguugguuauugacuuuuuuaggucagagagcacucuguggauucuaaaaccgccuuccagaaaaguacacaucaaacuucuacguacguuuuuauaggguuuguagagcucugauccuugguuaaagaucccugacaaugucuaauagcuguuuugaaaacuguaccuccaaucugaagcuaagguuuuaguuuuaguuuuaguaugugaauaucugaugaaacgauucaaugguuuuguagcauuggauucaauuucaggguugggcuccuuucuaggaauagaggaauauucuuaucucaggaaaaaaaauucagagugugggaaguacgaaaauuauuaauucaaagguguauuugcugucagauuggauggcaguacccacaucccuaggggcuccuguucccaagacuguuuucauuguuucuauccagcgcugggcacgagccuugaaguggcgaauucauccucugaaguuguguguccauugcugcaagaauaaaagaagcaguaacagaaucaugcagcgcaguauuucauggugacaguuuuaugugguugugugauguugcagagucuuguaggugauaucuacccuuuucuuuugaaucaaaacacgggguuuuacuggaggagggaaguuucagaaacaaccuagucuaacacaaaauuaagcuccuaaauaguuaucccauucugucuacuacaaaacuaauugcuuacaggaaguagaaguacacauaucuaauauuuauauccuguuugaguagugguuucuaauuuuagauuucuaaccccuuuuuacauuaucuuuuugcauugaaauuauacugaaacauucauauuauuaugaaugcaagcugaauuaaauagaccaagauucucgguuucucccuucauguugucaucuacuagagaaugaacagcuuaaaauaagugcaucaguuccucauccaaagggaagcugaauauuccaauucaagaucacuuugcgugcuuacuggaaauaccauuuuugaacguacuuggcaacuuaaagugcccaauuaaaagcucuguugaaagaggaagucuguggaugugcaauuaguccuuaggauucagagcauuuccuuuauguguggaaggccauaauaugaaaucacuggucacaauagcuuuaugccaggugcuuagacuagaaggcauuuucaggauggauuauuucuguacucuugcuccuaaaaugguuuaccuaaagaggcucccaaguccauaaaaauacuggugaugucaagaaauuuuggagguggccuuucacaaauuuuaggcagucaauaaauauaacuagccauguacgugauaggcaauacacaagacuugcuuauauuccuagacuuucuauuuuaucugauugacaguguuccucuucccaccuuuuuauucauuuauuuauuuuuaaaagaugaggauuggguaccagaaaauuagccaguauugugugcuuuuccuuacuaaaaaaaugaggccucgcugaguagggccagaugagcuguauauucugagauuauuuauaguguuuaugauagagagaccaaaaacaguaagcacuuaauagcuuuccuuauuuacaagucagauucaucuaagggauauuuuucuuuuauuuuucuggugcuugaaauguuccuuuaaaauagauuaucagaggauacacagugacacaaaauuuguugcuugugaaaaugcagaguggauuaagcuuuucuuuuucaaggcucugcaacaaaacagguacauuuuuauuucaguaaaaacacugcuuuuuuuuuuugccuccgucacacacacgaguaacauaggauagauauguguaugugaacauguggcucuuguucccaguuguguaauggaugcauucccuuaaaguuugcaguaaagugaauguuuauuaagcaaauuguuuuuccccagugacuucuacuguaaaaauggcauugucuuucaguaggcucugaauauaguauguucccauauucuuugguaagaugaccaaucaaccaaaaaaaaaaaaaaaacaaaaacagccccaauaacaaacaaacaaaacaacccuuuagguaccauaaaucuauaggaaauacuaaccuucugaugaagcuggcccgaugccacuuauuguugucccccacgccuaagcuaugguauauggcuuuaauaacaaaauggcaacacacaauaguaccacaaccuggaggguguuacucuuucuucugcucacccuuccucccauuguucccaugggagagaggacagacaccaaggcuguagcaaauagguuauuuuaauaaccucagcauccuuguuucuauaugauauacauuugauagccaaguugaauuuacccaccucucucuaaacacuuuuuccuaacccuuugucaauuugucacaccaucuuuggaugaagagugguaccugaugguguaugaugcuuaacaaucgaaacaucuguaccuuguuagccauaaaggcucaucccauuuccuuccauaaacaucuauuguaauacaauauggauuguguaaggcacugggcuuuaggcccccagcccgaauaucugucaucuauuaaguacuuacuguggauaaagaaggcaguauacuuaacaugcacuauuucaucuaauuuuugcaaaagcucuuugaguacauuaggccagucuccauuuuauuaauacggaugaggaaagugagaccaagacuugaguucaaugacuugcccagagucgugcaaagcauaaggggcggaguaggauuugaacaccgcaugaacugggcucuggaaucaaacgcuucccuaaugccaugcccuaggucucagccuggacugugcucccagagucacuuaagcacuuuucaaaacacugacauauguggacccagcauuucgaggagcugggcucugggcauuuggguuuugaagguuuuacaagugacccugaugcucugucaggcaggcuuaauaacgacugaauuauauaacaugcccagcuugguuucuugcuugguuguugaauugcugcaugaaaaucugaucccugcagucuuugagccugcagcccagugaaagagauggaugugcacacaaccaagcaugaacaagaugcauuaugacaaguacuaugguaguacagacuuugugcucugugauaauuccuaugacacgacuugcaguugaucccaggagguagcaucugggacauagucacuuuagcaaguccuauuuauucuagcuugggagaguuccuugcaucuuaacucuguauacucugugaucaccagacagucuuggucuagguuauuauaaaaguccuaguugaggaucuugaaucucucccauucaguuugacugagagagcuuggugauuagaucagugguuuguauauuaccucauuugucuuccaaacuaauagauaaguuccucaggauccacuccagugggauuacuaggucaaagauaaaucauuaccagacugguugaugguaucacccaggcuggugugcaguggcaugaucuuggcucacuacagccucugccucccggguucaagcaauucuccugccucagccuucggaguagcugggauuacagguguccaccaccacaccuggcuaauuuuuuauauuuuugguagagaugggguuucaccauguuggccaggcuggucucgaacuccugaccccaagugaucugcucgucuuggccucccaaaaugcugggauuacaggcaugagcuacugcgccccgccucccucuuuucuuauugagacccauugaccaauagcuuggucaauagugcuugauucuugaguuuagaaaacuucuauugagcuucuuacuauguccuggggacugugcugggcaguaagaacaccagaaaggguguggcgucuuaggagccuauuaaacuagauuaggaagagagguguugaggugucaccuagggcauaggcagagaaccugucugccuaaugauacuggguuuaguucuugaauucuuuauauucagaauauggauuagggccaggcuggccuugacaaccugaaucauuaaacacuuauggugacuggugggugauuagccacauaagaagaagauauauucauaacagauauaauaggagcaauggggacucgauggagaguauuaaauaguacagugucuuccauaaauguucuuuaauuguggagauuacuguucuguagauuauucacucaggcauugaguaugcguuuauuaagugcuuuuuguguccuaggcucauucacaagucuaaacuucaaauuugguucuuaaauuccucaagaccagaguuuagcuaaaaguaucauuauauccugagauggaauuuuaucaaauuguaugcuuaaaaugaggagauaugucuguuucuccaucucgcaagccccaccaguuuaacugucaauuggucuugucaaucaacuauaagagguguaaaaaugucuugggcuauaaguacauacuccagggcguauccuggugacagagauugagaaacugauuggaagagaguguaaucaguagugcuggccuuacuguucugaaauuucugguuucuuucccucgcuccaaacuuaauucuuucuucucuauuuucaauuucagaagaaauuuagaaugagugagggaaauuaaaaugaaguccagaagaccagcagagauuucaccgggcauguggguaggaaagacgugugagaaaaccauuugaaauggaauuaaaagaaaacguguucagcucacuauauaauuauaguuagcuuggccugguguuuuggguugcauuaccuguaaguuuggaacucauuuguuguauagaaauugauaccccacauuuacuuaaauuuugcccaucuguuucuuguuaaaagaaacuggacaucugcuaaaauauccuuguuuuggauuacucaaucuuauugucaccuuauaaugguuuuauuuugggggagguuuauucguauuaguaugauggggaaagaacagaaagaucuuauuggaaaauaaauuuagaauuuuccaaauaauaaaaucaaaagauuuccagccguaaucuuaagaugccuuuucaugaugucuaguuuuagaaacuuuuuuuccucucagaugugaagaacaaugcuuuuuaggacaauagugaaacuuacaugagaauuguucuuuuugcauuguguuauggugcaugaugcgaaaguuuagaaauaaauauaucccuggauacaacaggccucaguuaagacuucagcuauuuuuaaugcauuuuguuauuuuuggccuggcauaguaucuuaggaugagaaaauccauccccuuccccuagucugaggucacauguugccaucaguucucuguaauggagucaaugauguuaugguuuuaaaauaacgggaaauuaacauuucuuguccccaugauuguggccgcaggacuugaucguuuuuauacuguuaaucacacuccucuuuuacaagaacuccccgacucuuguuucccccagcaguuaaaugccauauuuucauauauuuaccuuauaucuggcuaaaaccuugcaauuuuuuguuuugcucucgguuuuugugacaauuuuaagaggaaggcaaauaauguacagacuggguugaaagaggagaaaauggagcaguuguaauuccccggggcaggguaagagacuguuaauacauuagugguaggagggcuucugcagaaaauacgacugcacaauuaaauggggcuauuaaaagcacgccagcaucaauucauuaaaugacaguggcaauuucuuuguaauccccuuuuccccaucuccuccugggacucaguauaugcagggaugaaaggcagaugggcaaagaucagaaagacuacugaggaagagguacaguuauuuagauaucugcuuccucaucuucuuugggggcagcuucugugaugaaaacacuuuaugaaagguaagacccccaaauaccuguucuguagacauuggggaugaaaauguacauccuagcagaugaucugguucugcauuccagaacacugcucugacuuuagaagcaguuaucuaugcauaguauaucuacuuggagcuaaaacaaagagagaaauuguuugauugaaaccuucuuauugcaaaaguaugcagaauugacauucagcaaucuuauguaaaaauacugcaaaauguuucuuuuucuggaaaacaguguauuuuaaaaaucaguuggaaucugguuaccugcaugaccuagugagaacuucaaggcuuggggaaaugguugagguuagugguuaugaguauuugauauccuuuugcgugucauuuaauugucuaagcccccauuuccucaucgguaaaauggugauucugguaucugucuuuuuagugcugcucuguaaaauuaaaugagauacugaaugaaaagcauuuugcucagugccuggcauaagauaagugcucccuaaauauuaacuaguuuuauuauccauugaauuuuaggacuccacccuccccccuagcccuccaaaagaguuaauggucuuaucugccugcugaagaguaggguuaugaggaagcugagacauggagagaugauguguuaauuagugaagaaaccagaaugggaaccacauuuuaugacuucccacugcauugaagugccucucauaguaugagacuucuguauuuaguaaaggagggccaacacuugcuccaccuauuauaauagaugagguaugcuuuuuaucuauauacuuaaaaauguaguuuuaaguucauugcucagguucuuucgguggcaaaaauccuugcacuuuaaaaggcauuauuauuggccgaguuuuaaaagaacuaccuucagagaaaaaugcauuucauuuugauuaugcccaacgccugcagaauaccauuuaaacuacaagugauauaaaagguuaaguauuugauuaaaacuaaucuccuuuaaaaacuaauguuucagucuccaccagaacuucuucagggaacuucaguguuuugcugauaacuggauccaauuuaugggagguaaaaaaaaaaaggcaguuauuuacuuaauucaucuauuaguuuccagacuugauauauugaaucuaaagaauggugaaauuaauagauaagagaagaaguuugagugguuaaaaaauggaugauaucuccuauuucagggaaacaguauuugaucagauuucagggugguacgaaguucuuguugaugauaaaaggcaagucacauuuaucagcugaacaacucagaaaacacagaugaucugaauuuguggaggcguccuccauaccauuuucucuauugcuuugaugauugucugaggucucuaccaaacagauacucauauucauauuuccaguucaaaucccuguugcauugugaacucuuugggaacagagaccacuuuugccuuuucaaccagugccuagcagggugccuggaggcauuagggaauguuuauugaauaagggaaugacucacacuguaugccaaaaucuggcuucccugaguuuauaugccucugguaaccuuuuguaaaugacaccuuuucuauaugauuagccacuucuuucuuucuauugaaguuauuucuuauuuccaaguaaaucuuguugcagccauccuccuccugacuacauccaaugugguucauguuuuuucuuuucuuuuuaauuuugggaggggugugaagugcaagauagaacauaaugugggcuaaauccggggcuauucaacuugacuagggucuuuggccuuccagaauguugagaaacuaauuaguggguggggugggggugggggcgguguuagaagaaauggcugggauucuuuguauccaaaagaauguuucuccuuggugaugaggcagguauugucaccccucugaauaaauccuuaggcaaaguacaaaaacaccagccggcugaacaaugccuggccacucuggccuuaggauugcaauaccuuacggguaaguuuagaaaugaguuuccuguucagguuuuaggccugucauacuguugaguggcugucuaaccuuugaacuuucuguguuuuugacaucaaaaggaacucuaagcuuuaccaaaaagguuuuauucgaguaauuaauacucuucaugcacagagggaaauuagccuccaacuuguggacauggugaaaaauuaguaucuucccauuugcucggcuuguuugaacuauaguugauuauuuuuaaagauaaggagaucaaauuuccuuaauauuucaguauguugcuuuuuguacccuuaaaauuauuuuuuccuaugcagaauugacuuugauuaaaaaauguuuuugaugacuauuuuccugauucgucaguauaucuaauuguguucauuuuacucaugaaaaaucuugucuaugagggacguauuuuuaguaacauuuuuauagcauauaagaacuuuuacagcaaaaacaggaaucauuaagugugugugcuuuuaucauaacuucucuuuuaauggaacuuaaaaucuuaacucguguuuuugcagcacuuuuuuugcacaugguagguucuuaauauuugaauggaauucagugugacuguucuuuguguucucaaaagucugaucuuuguaacaauuugucuuucacuugagacuuuuuuuuucuuugcauaugugcacgucucacucuugguuuuccuuaaucuuuuuuaacuaaacacaucuaugacucauauuucccuauuuaugaauaggagcaauuuaaaauuucccaacauggugguaugugauguaacauaaccaaaggcuacauguuuacccuuguuuaauuacccuucauuuguggaaagaugacguauguauuuaugauguaaaugucuuucagaaugaccuuugggacuaagcuuuuuuuuuuuuuucccaccaaaaaauggucaugaccuaggaagccuuguuaguaaaauuuaaaaaggaaaaguuggcugggcaugguggcucaugccuguaaucucaacacucugggaggcugagguggguguaucaauugaggucagaguucgagaccagccuggguaacauggugaaaccccguuucuacuaaaaauacaaaaauuagcugggcaugguggccugugccugugaucccagcuacucgggaagcagagacaugagaauugcuugaaccuaggagguggagguugcagugaguggagauugugccacugcacgccaaccugggugacagagcgagacuucaucucaaaaauaaaauaaaauaaaaauaaacaggaaaaaucuggucaaaugccccuuguucuucuucaacagauacauagugaguuguguaaaaaaggaguuggaaaaggaauauguagauucaaagugacuuaaagaauagaaaaaaaauuuguuuuaaaaaauggccaagacuaaaucauagugucuagggagguacaccugaauaauaaaacuauaaagaaauacaaaauaugauuacuacuaagaauagucuguugccaguaguacacagaaugagcacucaaauuauaacagaagcauuuugguauucauaaauguucuuuuuuuaaaaaagaacacaaucgaaauuauaauauaggcuguaaguacugauuuuaauuguagugaaugugaaaguguuguuaaugaaaauauaaagaauauuuguuaaaguguggaccuagccaggaauacuagguagaaaagguaacucuuuaaaaacauuuuuuuaauugugaaguuaauuuauugucacuuuguuugauauuuauuauuagagucccuagguuaauucuguuuuuauugcuuuucagaauaauuaagaccuaaaucuucugccgaauucuguuugguuuccuuauuucuuuugccauguucuuucauuccacaaauguuauugagcacuuccaguguaccaagccuuguguuuacugcuuugaugauaaaugcaauaagguaaugcugcuuuuaaggauccuucaggauaggcucuuguagcaguaaggacuuaguauuuuugcuauagaaguguauggagagcuaucuauggugcaauaacuguggaaauacaguuuuuauucuauuugguucccauauacauugaguccuccuuuggugggaauuugaucagguuggucucaguugaauccuggcugcauaugccucaguaaggaagaaggccuaggggacuguggaaagccugguggugguccuggaaggcuugagaauaccuggagcuggaagcuccuugcucauuggugaccuuuuucauaugcagcagagcucuuggcauuccuagcauacuaccuugaaaggacugugucuugccuccuagaaauucuggacuugguagaaucauuuguuuauguuauuuuaaaaagaaaaaaaacucugaaauguacuuuuuggaagaaaaaugaacuuguuuuuggacuuuucuguguguuguuucuuuaauugaaaauucugucuggagauugauuuucaacccccuuccuuucccucuaguuuuaaauuguaacauugcuuuccaagcauuucaaaaaaacaacaaaaaagaaauauuuuauuauuacucuauuuuuauuugcucauuaauaauucuugauuuucuaucuauaugaaaucaaagaaaaauuacuguauaauuuucauccaguugcagucaauucuauaacugaaauacaagauaaaaaauaaguaauugauuuacuuaagaaacaaaggcaucucgaccuccuaaaaauuucaucaaauauucacucggcagacccuucuuuguaauaggagcucacuuacuauugugagcacugacagugugagcacuuguggcagggauuggguuuccugaggaauucauaagauacuugcauugcuucugggcaugagggugaauaacacagccauuggccuucaaggccuuugaggagguguucuacggggagaggggcugagacagacauauuccugaaaggaauaauuacugcgugauaguggaaauauacacaaagacuuugggaguaacagugauggagggacccauugaaaacuuacuaacguuuacagcuguuguuaaaauucauccaaaccagccaauuauaucuacauucucuagaaugaaaguacaaaaugauuacaguggauguucuaaacaccaguguugacacaauccccuuuuccuacuggaauggggaucuaauggggaaagugaaauucuuucucaaaaccuuaucgguguugauaccuuacauguacauguaaaagcagcugacuuuguguuuuguggccuuugagaucauauaacucuuauaaagcaacuuacaaauuuucugggagguucuuuuggaauauugcuuuauguuuuguuuuaggaauauacuucccucuccccugaauuaucucaguggggauauauaaaucuacucccuauccaaagcauaaccauguauguauuuguuuucucuuuaucauaugauauaguuuggauauuugucccccuuaaaucucauguugagauguaauccccaauguuggaggugggguccggugggagguguuugggucauguggacugauccgucauggcuuggugcuguccucaggacacaaugauuucccaugagaucccauuguuucaaacugugugaaaccucuccccuacucucucuugcuccuucucuugccaugugagaugccuguucccccuucugccuugacuuaagcuuccugaggccucaggagaacccgagcagaugccacugccaugcuuccuguacagccugcagaaccauggccaauuaaaccucuuuucuuuauaaauuacccagucuccaguauuucuucauagcaacgcaagaauggccuaacauaccauauauaaacuauaaaacaaaaaaaccaaaacccagaacaaugacccacugcaguacaaauaauaacucuuucuuccaaaggaacuucuuucauuguuuaaauaaugagaaacuugugucguuagaaacacuguguagggugcagcguccccucauuacaaacauuucugugccuuagaggacacuccuccugcuauguauccuuaggaggaacacauagaucagccucucuuccuuuuguccagcugcaguaucgggaauggagacacaacacggucaaggugccuaaaacuagaguggccuggggugagucuagacuugaucuucccagauacugucccuugucagacuccaacacugugcacagccuggucucucugggcccaggaauuugggcacuugcccaaagauuccuuugcaggugcuccuggaaaucagagcaguguugaagcaggauuuaaagcaguaacaucugucagauguaaccauggcauuauaucugagacaaaaaauuguaggaggaaaaaugccuguucggagugugggguuacugaaaacccgcuuguugacuaguguuuuauuguagugaugggaaaugaaugagacugguaucuacaccuacuggcacgggucugaauaaaacccacagccggcucuccucucccugagcuuccagccuucugugguccagauuuucauauuccuuccaauuugcccagagcaagcugugacccucauccaucuuuuuuuucucguuuugcauuuaacagaguuguaaagggauuuauaugcuuuccauuagccuuagcaaagcugcugucaugaauauuuaauggaaaaagcaguuuguuuucuuuuacucuuucccagccuucccuccagcccccagcucucccuuucucuugccuggagaaauguaaauaucucgccccucaccccuuggccggaucccaaagccccgggcucgcucaauucaauguucucacccgucugguggggacuuuuuuuuuuuuucucucuucucucucucucguagcccccuacgaggcaacuaaggugguggccgcggugcgcggggccggacacgcguggggcucugccuggcccgggccuccgcgcccucugccugcaccacagcucagcagcccggacagacgguccuuuccuuugaacuucacgggagcacaauagcuucccugcaacuuagcuggagcucccucggaugcauuccuggcucuucacgggucgcuggccccuuucucuuugcaacaggaaaaggggcgaaugucugggacagaaaaugacuucugaagacacgaaaagauuuaccgugucuggagcaaccucugaacuuuugugguggugaucucagaaaaaugcauauuuuccuauugguugcuuagaucaucucccauccuucuucccucccccuccccguccccgcaguuauuuaucuaauuucuccauuucugucauaccucacccucacccccacucccaccccacccccauuccgguuuugccuuuuccuuaauucuuuguccgcucuugugcugcgggaguggaagcgucugaaaggugaggcugggagagggccugaaaaguuuguguuaacugagaaggaagguuccaggcgaacccuccucccuucucuaaugaagucauaccugcuggagugugccugucccaagggaccguuggaaagaugagagaaggaaauccauauaaaaugcuuaacacaguauuuggcuuuaguaauugcucaguaagucauagcuauauguuauuaauaugauacacagucauucuucugaaaugaaugggcaugaaugcuucccucucugcauaaggaauuauuugugcuggauccuucuuaagaggcuucucuucucuucucuucucuucucuucucuucucuucucuucucuucucuucucuucucuucucuucucuucuuucucuucucuucucuuccuuuccucucucuguagcccaggcuggagugcaguggcaugaucucagcuaccgcaaccucugcgucccaggcucaggcaguucuugugccucagacuccugaguaccugggauuacaggcacgugccaucaugcccagcuaauuuuuguauuuuuuguagaggugggguuuugccauguuggccaggcuggucuugaacuccuggccucaagugauccgcccaccuuggccucccaaagugcugggauuacaggggugagccacugcacccugccagagcucaucuauuucugaugaaugccguccacagcaugcuucaccgauggaggugucauuucauuucucuuugaguaaccuaaaauuaguuagcguaugucacuaauguauagcauaugucacuaauguauaacauaguucuaaucaacuaaaaauuuguacagacuccuagaugggcuacuaagugaauauauuuuccucuguccucugguggacuucacuacaacuuuuacauauuucgauacugaaauucuuaauagauuuggcuucaaauuccagccugaugagauaauauuggcaucugccccugaaguccaguaucaggucauucuugcuccacuucaggcuucuuucaaauuugguaaucgugcuccucgugucuuggauggcuauauuggcaagucagaacccuucaauucaucucuguagaccuaccugccuuggguucccguaacccauuaguaagucccuuuggguaagaguucccacuaauaauguuuuucucucgauuucuuuaucaugccuugaaacugacuugaaacauuuuguuaaaugccuagcuaaaaucccaacacacuugugaacagauguuaguaugauggaagaacagaaaaaagacacggccaagcuaagauguugguaugauuaaguuggaugaacagaaaaaaugugcagccagaucuaucuccagaaucaaccaauuuccacauugcuuucgaucucauccuauuauguuuucuguaaguaaaacuuccacugcaaauauuaauugauguuaagucaaaaguacugacggucuggucacaggggcuuagggagaaacgagagaagcaaaaagggucuccccccuuaggguaagcuagagucuugcugggucagacaauuaggcaacaauguaaggcaguauauaauuaaaugcuaaauuauguagagcagauuaugugcuauggaauggagaaaauggcucucacaacauuucuaauguccuaaaucaguuuccuaaaucagaaugguuucauacauccauauguacuuaaagcaugcucaguaucauugguccuuuccugcuuuuuugaagccaugguaauaguaaacauuuucuaaguaucuacuguaggucagggaacuggucuaagagcuuuacagguaucaacuaauuucaugcucaccguguaccucugagauagguaugcuuuucuccauuuugcaaaaugagggaaccaaggcggggagucuaauaccugcccaaagugaguaaugauaaauuccuuccucuuuuugauuuggugggucuguggugaggguagacuaggagaggcaguguugcauucugggaagugaaccuagauuuucauccuggcuucuuuuaaccuacucaccuguguaauuaggaccuugggcaaggugcaucaucuuuuggagcuucuccuuuguaaaaugggacaggaugcuguuuuaagauuuaagugcuucuuaugcaauaggagcucaaagagugggagcuguuguuuauuaaaaauaacaauaucauuaucauauucucuaccuaaagagaccuguugaaauuggacagaaaaggaacguuucugucuugauaagucuuaaaacuccaguaccaagugcagcauucguuucuugugagauauuuguagaauggguggauagaaggaugggagaggagaggggucugaagaauuccuguagcaagcuaaagagguaucaucuuccaauugagcuauuuuuagccuuacucaucauuuguaaucaaaacaauccuuuucuuagccuuacuccucccccaccccugccccccuacuacuuuugcgaugguaaucgucauugccaacuuacuuucuuuggaauacacaaacagagcugucucuuuccgucauggagauuuuaacaguaaaaaacucacugcaccauuaccucugccuuguauuccagacaauaguaaaggacauuguaacaucacugugucagcgcaaacaaagaacuauguaauuuuaucccauauuaauacagugucacgcaggagguacuaucauuagauggcaaucuauaaaaauggccccugagaccaggcacuggcacaauuauuuauucuucaauuauuuauucaguccuaaggauggaaaugcugacagacacugcaaaaugcucuaccuaccaauuuacagaaauugaaugacggaaucauuuguggacugaaguagcuuuuuauugacccuauuuuuauuuauuuaaauucucacuuucacagcuuaacuauguuuacuacacccacuuacaugauagaaaugagaggcuguuuuguucauaaaagcuacuucaaaacaaauuaauauuuauucugaaagggucagaucacaaauggaggcuuuaaaacggccucaggaacauucaaaucgcauccuuaauauuucauaugguuuuauauuuagauuggcuauuuuauguagucuuuuuucccuuuuuagugcucauaccucuugagaucccuuuucuagccaggauggagggaacaguuacacauagcuuccauuugcaguaaguaauuucaacuuaauuuaugucaggggagauuuccagaagguucccgcuccugucugcuauucuugugauucuaauauauuauuuguacaugauaaaauacaauucccauuaauucacacuuaauuaagucauaaaagaauuuguuuggucuuaacuccuaaaguuuaaaagauuauuugcauuuguauuaauacuggaguuuaaaaauuauggcuuucuuuauagaucaguuccgauuuucccuaaaucaguuauuuucaguuuugauuuuucaaacacuugggugagauccaauuuaucucaccuucugauaguuuuaaaagagaaguaauuuuaauuuacauuaacuuuaaaauauuuguaugccaaacacuaguuauuuugaggggaucgaaacaaaucauagcagagauaaggaacuuucauacuuugggaggauuuuuuuuaaauaacuguauguuuacucuaaguagauauguguaugcaugcauucacuuaugauaugcacacacacacacacacacacacacacacacacacacacacacacacacagaaauuuaugauguccuuuaagaaucuugggacuaucagaaaaaaguuaagugaaauaacaauuuucaaaaauacauuuuuguaguaaaaacgcaccaucgguguuacauuacuguauaaaucaaauuugcugaaguuuauaaauauuuuuauguuuacuuuaaacuuggacauaaucagaucuaucugcuguugacgacauggcucucaauauaaaaauaaucaccuuuucugcuuaaagccucauucucagaaguaaaauguguaugugaggauauuaacuaguucauaggauuguuguagaaaaccuuuuacauauguggauacugaaauucuuauggccuggaucaguggccuggaucauagcuaaucuuuaugaaaagaucacuguauuauuacauuguuacuacagguagauuuucacccugguccuugcaugaaucauuugguuguacuguccaugauguccaguaguagauuaaaaaaaaaagaaauaaaaacaaaaacccaagccaaugccuacgacguugcuacaaguauccuuuaaccuguggugugaaguuauuuccaaagaugaaguuugccauucaaauaccauuuccugguguucauuugauuucuguaacaccucuuuuucuaucuccgcuaacucuagaucuguaguccuuccaaacaugcuaccuaccacuuacacuuugccaaaguguaauuuuugcucucuuaucugcuucauaagagaauguuuguaguuucaugauuuguaagugggagggggugcuuagcaggaguugagaucaccagcccagggaggaggaaauggaaucagaauaagcaagaggaauagacgggguacugggcugaagagcacugugggagggugcuauuagugauucacacugcuagagugagaccacucuuugauucuguuuguagaaauuuuaagcuaaaagugacagauuguugccucucuuuauguaaaguauuacacaugggaaguuaaccucugcuacaggauacugaucaagacaagucaugggcaagugcaaagagcuaagugguuuacuuuauacacuaguaugucccuucucagucuuucuuguuauuucguaugacuugcuuccuccagcuaguccaagcuauguuuguguaaauaagaacugccauuuaaugaacccuugcuaugaaccagauacuaugcuagaaggggguguagguacuccaggggaaaggccucuccagcagauuagcuuguucacgugauacuagagucccaaaagggcaauaguggaagcucuaaagcuucuugcagcuuaggcuuggacugaauaaauaacagcaguaacacaacagcaaugguaauaguaauaaugaaaacaacucuucuaaaaaauuugaggaaagucucuugucuauugaauauaaaaaauauuuaccauuaaagauuauuuuaaaauuuauuuugaguguuuauugucuaucaggcagguguacuuggaauguguuuuuuguaauauauucugccgccuaaaaauaggaaauauauauccagguuuagguguuaggcaaguuuuucacuucugguuucuauuuaucuugaauguauugcauuagccacacuauuuaacauggggauuaaaaaaaacugcugugcauguucucacuuacaagugggagcugaacaaugagaacacauggacacagggaggggaacaacacacacacacuggggccugucgggggagagcgggguggggagaacauuagggaaaagagcuaaugcaugcugggcuuaauaccuaggugauggguugauaggugcagcaaaccaccauggcacauguuuaccuauguaacaaaccugugcaucccgcacaaguaccuuggaaccuaaaacaaacaaaaacuggugugaucucccuguaagacaggauuuuaaaagcaugucuacauuuuugaguuuucuuucaaggugccaagaagaggcugaccacauuguuugaagaaugguuaagaacuugaacuucggaguuugccagacuugcauuccaggcucagcucuggcacuguaagcucuguggccacacagcuuugccgaaccaaccugcuuagcaguaaaaaugagaauaauaacauuuccauugaaagguguuaugaagauuaaaugaaaguguuuuucuaaagcucuagauauauagugggggcccuucucagguaaucagaaaguuguaguugcaguuuuguuacuaauauugcaaaugcucugaaaaugugccaccauggcuaugucuuguagauggugacuuaagcuuaccuuccacagugggaaaauaaaugauuuauuucccuuuaauagccaucacucuguugauccagcccugcaaagcuuacagcauggggcuuaugaaucaugaaucaacacaaaugucaccaagcuaaaagagaguuagcagaaguagccuauguuaagauuagguuucugauuuaaugugcaguuucuaaaaaccaaguagcauguaacuggucuuauccuugcugaguuaagauugcuggaucguuaauuuaauaauugagagaggauaauucuugcaacuuccaauuaguauugacuugaccacugcuuugauguaggaugaaaccgcuucacguuggugugauuuccucagcuaugguguguauagucuaguuuaaagcuaggcucuguuauguacuauguccauccuggaaaguucauuagacaaggaacagaauaguggcucucucaagcagucagucauccagugaaugcuauagcaccugcuuccauccagcccauguauuccuuccccucauucuucuuuguuacuucacaccacauucuuccuucagcuaguccaagcuaugccugcauaaguaagaaccgcaguauaaugaacacuugcuaugagccagacacaguguuggaggugguauagguacuccaggaggaagacgucuccagccaguuagcucagguguguuuguauggcaccagugccccaagaugacaauauucaaaaaugccagacuucuugaaguuuagacuugagagucucccagugucauuucuacuacauucuuuugguuaaagcaaguuaccuggcuaaaccuagagucagugagagaggggauuguucaacagugugcauuuagggagagaauuguggcuauguuacaaacaaucuaccagagacuuacagacggcagcugucuauuccccauuugacuucaucauuuaugagcagacguuuguuaagcacauauuggguagcaaaacaucuauaauauuagcuuuuaauuuuuuaaaaaacuuuuauuuccagaaagcuuagcuuuaucuacaaguacaguugguccuugaacaauguagauuagggggugcugacccucugugaagcugaaaaaccauguauaauuuuugacucccugaaaacguaacaaugaauagccuguuguucacuggaagcauugcugaugacauaaauggucaacuaacacauauuuguuuguucuauauauuauaugcuguauucuuacaauaaagcaagcugggccuggcgcugugguucacauguguaaucccagcaauuuacgaggcugaggcgggcagaucacuugaggccaguuguucaagaccagccuggucaacauggugaaaccccaucucuacuaagaauacaaaaacuauuuuggguguggguggugcgcaccuguaauuccaguuacucaggaggcugaggcaggagaaucgcuugaaccgggaggcggaggcuacuugagccgagaucaugccacugcacuccagcucugggcaacagagugagacucugucuaauaaauaaauaaauaaauaaauaaauaaauaaauaaauaaauaaagcuagagaaaagaaaauguuauuaagaaaauaauaaggaagagaaaauauauuuacuauucauuaagugcaaguggaucaucaugaagggcuucuuccucauugucuucauguugaguagggcugaggaggaggaagaugagggguuagucuugcugucuugcgggugacagauguggaaguaaauccucauguaggugggaaugagcaguucaaaccuauguuguucaagggccaacuauaguugauuaacucauaucucuacaguuaauuuucaaacagaugugauagcugaaugagaacuuuuaagauaguacuggacaguaaccuuauuggaacuggaauggccuuuagacuuuuuguguccaguuucuucucaccuccucuuucucuucaaaugugcaacugaaacugagagaccucagucccauguccaaggucaggcagauacuuagcggcagagugaggacuccagcccauuucugcagcucugcugugcaguggaagauuugggacaaguacauuauuuaaaaaugcccacccacuaaauauuacauuccuaacuuuucccaauacacaaauaugcuugaacuuuuaaaagcuuguuuuuggucgugcuugguuuggaaugugaaugacuaaaacuaccuuuagcaauuucccaaaguguaaguucaaauguacagagaauuuuuuuccugaaugcccaacacaauaugcaguuuuacaacacauaccagauucuuagauucauuuggugaaggaagccucugaauuaaaacuuuuaaauauuucugauuugcaaccagacgaaaaagaagaaaauugacaacuuuuuugaugcaacuuugugaaaucaugguguuccugguuuuucuggucugguuuuuguuguuguuuuguuuuguuuugccacaguuuaguuccucaccugaucuuuccuuguauccacuucagagucucugaaauguuaucuguuuguugguuccugggaaauugagagccuuuucaaagacuccaucuagaagcauauuuaaaagugugaaagaagacauuuaugcgaccaacaaacauaugaaaaaaagcuuaucaucaugggucauuagagaaaugcacagcagaaccacaaugagauaccaucucauaccaguuagaauggugaucacuaaaaagucaggaaaggccaggggcggugacucaugccuguaaucccagcacuuugggaggcugaggcggguggaucaccugaggucaggaguacaagacuagccuggccaacauagugaaaccccaucucuacuaaaaauacaaaaauuagcugggugugguggcgggcaccuguaauccuggcuacucaggaggcugaggcaggagaaucgcuugaaucugggaggcagagguugcagugagccgagauugucccacugcaacuccagccugggugacagacuccaucucagaaaaaaaaaaaaaaaaaaaaauucaggaaacaacagaugcugaagaagauguagagaaauacgaacacuuuuacacuguuggugggaguguaaauuaguucaaccauuguggaagacaguguggcgauucuucaaggaucuagaaucaaaaauaccauuugacucagcaaucccauuacuggguauaaucccaaaggauuauaaauuauuccgcuauaaagacacaugcacacuuauguuuauugcagcacuauucacaauagcaaagacuuggaaccaacccagaugcccaucaaugauagacuggauaaagaaaauguggcacauauauaccauggaauacuauguagcuauaaaaaagggugaguucauguacuuugcagggacauggauaaagcuggaaagcaucauucucaucaaacuaacacaggaacagaaaaccaaacacugcauguucucacucauaagugggagcugaauagugagaacacauggacacagggaggggcacaucauacaccggggccugucaaggggugggagcuaggggagggauggcauuaggagaaauaccuaauguagaugauggguugaugagcacagcaaaccaccauggcauguguauaccuauguaacaaaccugcacauucugcacauguauccuagaacuuaaaguauuaaaaaaaagaaaaagaaaaaaaguguguagcgacuugacgcgguggcucacgccuguaaucccaguacuuucagaggccgaggcggauggaucaccuaaggucaggaguuugagaccagccuggccaacagugaaaccccaucucuacuaaaauacaaaaauuagcugggcaugguggcacaugucuauaauaccaccuacucgggcggcugaggcaggagaaucgcuugaaccagggaaguugaauuugcagugagcugagauuguaccacugcauuccagccugggccacagagcgagacuccgucucaauaaauaaauaaauaaauaaauaaguaaauaaauaaaguguagcucuggucuuacuaaguguaugauguuugucuccaugaaauaauaauaauguaagaucugagaaguuaauacuuaaaguaaaaccuacagcaaaacagucugcugaauuugucugugaucucacaggagagucuaguuguaaaccgaagcaaggaugguagcuaauaucgcagcaguguuuguaagaggauuuuuaguuugucaugcuuaaacagaccccucaguauucucacagagaacugaagcaauucauuuucaagacuaacaagagcacagcaucugcaugcauguggcagguauguuagugaauguugugaaguagguggucccaucaguugucaugguucaccucuguccagacugugauugugugacucgcaguuggcacuucagcaaagcuuaggaaaaugccucaucuucuuuugugggagguggaaaaauaaguagcugcuuucaaugaacacugcaagccuuguuaaagucuguaccuuucauacagaaacuccuagaugaauggcaauggaaaauacggguuugugauaacuuugaaugaugugugauugccuugauuagcacuauaguuacuaagcagauaugcacuucuuuguuuuaaaagagaacuugaauuuuuuuuuuacuauaacugccaguugcuuaauuucuaccacuuugucuauuuuuuuaaaaaaugaauuuccaccuaauuugugcuugucagugaugacaaguuuuaaaaguaacucaaguuaaaaaaaaaaauucuccagaaaccaucaucugucaaaaaguuuguauuuaauguuuucuuucagguagaaaugagacauuuucuccuucuucuuuccagauuugcacccuuaauguuccagaaagcugagcauccauauuauuuugaguuuaggaauuuauagugaccuagucauaguuaugagguguuugagggaaaugaagggaaggaugaguagcaaagacacauuaaacagaauaaauuauauagucuuguuuuuggcaacuagucuagcaugcaguuuccuugcuuuguucaguccacauauagaacaacucugucuaaaacagugauccaguuaggccaguuuccuguuuaaaagcuuucuggaccgucccuuuuccugcuggcaaaaccccaggcuuugagacauaguucuuucuaaacugacccuaauuauucuucccaggucaucuuuacugccacuacuguuccuugugaauauuucgcaucucugggcuguuaacauaugauuccuuccacuuugaauggcuugugaaaaagacgggggucuuuucacaagcuggugauacucuuuucagucauguauuuagaccaaauccucucacuuuguggagucuuggaauaguguccacguaaggcuggccugguuaguuucuccucugcuuccugaguccuugaguggucuuuguauauagcgugaagugcacagcauugggaagucugugucugcaagcccaucaccuucacuaggauacaacauuuucaucuuuggaccucuaggcuaaccggagauugaaacuuacuuggccucuaccuaaacauuucuugagcaacucagugagcuguccauguaguuuagcagacguuccgaugauuguuucauggaguuugugucaacggggaaggacugcugagaggcagaaaccauaaugaccagaaagcuggaagucauggaacacguguccacguuucuucaguuaauuuuuagaaaugagugaaugucaccugacaguuggugucucuuguuuuuuuuuaaugaagcuguaccauugcaagccauuuucucucucuaaguuuccuguggaauuucuuuccuuaucaagauaguaauacuuuggaguuuugaauuuuuaagagauucagucaaagcaucuugucauuuuauccaguugcuccacuucuuaaucuguaaaacggagauagugucuuugcuauuaauuuuucuuaagggacacagaauccaaauacucuuugaucuacaaaucuuuugcaaagaugcauaacuguuuacugaacauuuuacuagaagucagccuguugcuuuuaaaaucuaggaauguuauuuggcuuaccaacuaaacauauucauauuuugcuuagcaugcccccuuucagaugacuugcugcagaauaaugaggugcaaguugaacaaaguacuuuucaaauuaccacaggaccucaccaguuuuaccacuuaccuccagauguguggaggccaucaugggagaauuuaccuuuuuauguuuggacauuuuuguaaaaagcuugugguguugaaucaauggguuaugaaaugguuuuaggaauguaacgagccaucccgugauucuacagagagagacaauuuuaugagcacauuuucuauugaauguguuugcugguuguacuugaaccaaaccaaacacaaucucuaaaucauaacacauacaaccucucaacuuggagacucuugauuuacaaaugucucucugugacugaaguggcugccaagggaaucaccuucccuauuuugguugaauguguuuuuaauuuugcaugagcugucuuuguugauaauaauaaaaugauaacaguaauuucagccuuuauugaaugggugugccagccacugagccacguguuuugugugcaguguuuaguucacuucacuauggugcccuaauaaggauggauuuuagaugagaaaaccaguacagggagaagggaauuaacuuaccccaagugccucagucaaaguuugcagaaacacuuuuuguggaauuuuuugucucugugaugcuuccucauuucagucucaggcauuuugccugcaaaucccuuucacuugagaacacccauugugcaaccauuucuguuuuugguuucaccaucucaugauguaaagaaagggaaagugauaccaggcagugucuuuuuacuaauaaaaggcagauaagucuuccucaaauugcucuucuuggugaagaauaauacuugugcuccaaaugcuuuggugaugugauuuuuacacgaagcagcugagccaggugguguuccagcuuguuccuggacauguugauacagcccuaauugcuuaagguaugugccucuucuuaaucaucucuccuuuaacuggagaacugugcuacauuaugaccuggaaaaugggggcauuaaaagcaaccccaaauguaaauggcccuuaccagcaagucaccagcugaggaaaugcagacgucacaugaagagaaccuccuugauccucuaaggccccuggggacuggcuuccugagaguguacaaguuggugguugccaucuuaguuauuuucagggcccagguagauguuaugaguggaaugcagagugguaacugagaugguugucaugcaagaaaguggggccaggggacuagaccuucgagucuuucagaaguuggaaauguggaauuuuagggaaaaucucccaauuuccaaaaauugggaucaguucaaacauucgaaaaagucggagguccaaaucaaacacgucugugggccagaaucagcuugcaagaacccaauuugugaccacuggcuuaagauguguugauaaauggaucuauugguccuugacuaaagggaaucuaggaaagauuuguuuuauuuuugggggguaagaacauaacgcauaagaaagaagucacuuacucauuuuuaccugagaguuguuuauuugucuugugaaauacugaaaccuuagcacucauugagcgcucugugguagcaagugauuugugaugaugguaguauuuuuggagaagauuuuuagagguucagugugguucuaaguguguguauuuggguccuauguguggcaguaaagaaauguguucuuuggugaacaguuuuugcaucccuguguucaccugcauggaauugcaaguuguuucauaaauggaucacuaguauacgcagaggcuaugcauugaggucuuuucucuguauuauccuauuuaucaaccagcugucagucaaagaaacacaaacauggugaguauuaugggauuaagggauuuauuauagaaauugguccuuccucaaauaguagaggagcuggcggaaguaaaggucuugaaggaaagugagaggauuagagaaaguuucaccagaaguucuugcguaggguugggcaggucagaacugcaggaugcugaugagggaccauagcagggaacggaugaaacauuccaaaagcugcugcugccucugugucuguggaguuccaaacccuguggucugcagccaugugucuggugcuggguggagcccuugcugcucaacagggccgcuuguuaggaagaaacagggaucagagcagaagaaagcaaagacaagcuggaccccauugggcaccugccguuguccaucaugguguuuccaucaaccuuaugagagugguggccuguuuucagguucacuuuccaagucucauuaagcuccccauauggcuagccguaccccaggaccauagcgggaaggguauuccauuaaaugagaguuccuggcuuaccaaguugacaguuguaugauucaguguacucuacaaauaaggacaacauccuuaggacuauacugccgugagccgcuggcuacucuccccuguugcccuaaaaggcuuguaccugcucugaaacacaguauugaaauaucaggauuuggaaccucugccuuggccaggccaaaguagguguauuucuguuuaggguccucccagcauaguaccagcaauuuacaugcacauuagauuaaugauuuuaucugaucuuucuuccuggaaaauuugggucuggugggguggagaaaagggagguacucaagaccaucauacagagaagcagaaggggagaacaagagaaauuuuggagguuggauugagggaagcugaacucaauuuuaauuuggguccaguccauguaaauccucuacuuuuuugucugccugccugucugccaaucaaucaaucaguccauucauucguuaaucaguuauguauaucuauaucuauuaauauuuuucuguagaucuauaccuaucauauccauccauauguuuauauuauauuuaccuaaucuauuuaaucuauaucauguuaugcacauauauaugaaacauuuuugaguggaaaauuuuauggaaaaaguauucuauauaagguggauuaguaauccucuuuugaaaaaaaauucuaguucuucucaauugugaaagauaugucuaagcuuucuaacaaaaugaacuccaaacagucuuagaugucugccucuuuuuaaucauuuagugaaauaauugguuucucuuuuuaugagaagguguuaggauaaguaagaaauccugauacuuaacucgucugccuauugcuugacuacagaguuauuagaguucagucuuugcauuaaaaggaaacauacuuguaauuuugcacucuuugccaaagugugagcugcuuuuuaggcgguacuucaacuuuuuauugagguauuggcuacuucuacuucuugcugguaguguggcuacuaaacaauauaaaguauauuacuuucaaaccuuagaaaauuaauucagaaguccuagagcacagaaacagguuuuuccugcugcuaaaauauuuucccuccuuagguuauuuguguguguuguguauuugugucugucugugugugaguggggaaguuauuugauguggaaguguugggagauacauugucauuugggaauauacuccugaagccacuaaacaucccagguagugacagugguuugcucuggugcagaucacuuucgauuuuuuuuucuuuuccuuuuuuuuuuuuuuuuucuuuugagauggggucuaacucuguugccaggcuggagugcaguggcgcaaucuuggcucacugcaaccucugccuccuggguucaagcgauucuccuccucagccucccacguagcugggacuacaggcgccugccaccgugccuggcuaauuuuuuauuuuuaguagagaugggguuucaccauguuggccaugauggucucgaucuucugaccucaggugauccucccgccucggccucccaaagugcugggauuacaggcgugagccaccacgcccagccucacuuuagauuuuuuuuuuaaagagaccagacauuuuuugaaccccucaauauguuaggcacugacuggagugcuuaacaauccuagcuacuuagugggaagacugccuuuucuuucuucuuuuucuuuuucuuuuuuuuuaaauuaagauggaguuucgcucuuguugcccaugcuggagugccauggccugaucuuggcucacugcaaccuuugccucccuccuggguucaagugauucccuugccucagcccucugagucgcugggauuauggcaucagccaucacacccggcuaauuuuuuguauuuuuaguagaguugggguuucaccauguugaccaggcuagucuugaaauccugaccucaggugauccaccugccucggccucccaaaguguugggauuacagaugugagccauugcgccuggccaagacugccuuuucaaggcucuuaggagacuuguuauggcccagguguagaacauaagaauggaaguugaacauucacgaauuaaccaaucacaauucagcacauaacuguugagcaucuauuaugugaugaggguuaggaaaggcuuuuuagagagggcagugauuugggguggaggaggagagcaguccuguccuucgugucuguguucaccuaugaucaucauaaggaagagcauccuggaggacguuccuguccuguaucccagggccuguguuuaggaaaccaagucacaccuccauggcuuuuugguaauggcauaguugguugugaggaguuguucuccuaagucugacugagucgucauccugugcucuuaagcuaugcuuuccaagcccaccaggcccuucauucccagcugugguuggaaagauacauaaaguucucuuccaggcucucuucucugguagaacuccuugacaauuugccuugucaaagcguucuucugauaauguguaugucuaguuaucacaccugccaucuuuuugugggaagcuuacugucuaggccagaggaccccccagcacuaggcuccuuccuagccuuccucauggauggucacccaggcuugaauuacagaccuuucucuccuucacccagggccaaguacuucucuuucaaacggucccuuuucagacuugcccgcaugugugaaaauacaagggguagaucuuaggggccugauagguaguaagugguaagaugcaauguaagccgggguaggggggauguuuaucacaggcuuccuggaaacuaguuggguuucacugaguccauucauuuccuucucucugaugaaugaguaaucagaugauucacagggagcugcuaguuagaagacugcagcauguucucacuagugcuguccuguuagacccaggggaaagguuauauugguguguuuuuaggcaccaugugucaauucuuucaagauguauauauauuuuuguuuuucuaaagggggcaggguuucaaaaagguuugagaagcauuguguuagaccaaguuuguccaaccuguggccugugggccaccugcagcacagaauggcuuugaaugcaacccaacacaaauucguaaacuuuuaaaaaacauuaugauauuuucugugauuuuuuuuuuccuagcucaucagcuaucacaaguguuaauguauuuuauguguagcccaagacaguucuucuuccaguguggcccagggaagccaaaagauuggacaucccuguguuagaccaucauuuguuugcuauaugaugucauagugguagaauggucacuuaagguaaaaucugaauagagaaauuuggcagaaaucauaggaauuucuguuugaaggcauaaugaggguuaaucauuuuucauaauagauguuaagauuaauaguaaucauagcccauauuuauuaagcacucgccacacacugguuugagauuaagauuuugcgagaauaauaauaaucauuuaaucuucccaauagcccuaugaaggaggcucuauuauauugauuuuauacauaaggaaacugaaauuagacuuaguuauuaucaagggauggguccaaaugacaagaccagccaucuguccuggaaaaccaugcccugguaugcauucaaaaagagaaugagguuuuguuucucaucuccauuucuuuauacuggaaaaaccguucaaaauuuaauacagcuguaugaucuggcaaaauucuucuucagauagagguggauuuuaaagagaauggugauuugucuacacguguucacagcagcuuuauuuauaguagccacaaacuggaaacaacgcagaugcccaucagaggugaauggaugaguagacugugcuauauccaugcaguggaauaauauucagcaauaaaagagaacaaacuauugauacaugcugacauggaugaucccaaaauaugcugagugaagaagccagagaagaaagaauguauagguuauaggaugccauuuauacagacuucuaggagaugcaaauuaauguacaaugacaggagacagauuagugguugcaguacaaugguuggaguggaugguaaggaaaagagagugcaaaaacuuuaaagagugauggguauuuuauuaacuuaauauuggaaguggaugcaugagugcauaugcaugucaaacuuaucaaaauauacaguuuaccaaugugcaauuuaucgcauaucaauuauagcuccauaaagcuguuaaaaaauuuauauauauauauauacauauacauacaguaagggaaggcaaggagaaugacccauuaaugugugggaguaauaaaagagaaauuguacaaugagaggcucacucucagagcggccucggaaccccagagagguuauuauuguuugaucagucagucaacagguauuuauugaaauucuuccagguacuuugagagaaugagagauguaugugagcuuaacugugccugguagugggacccauuuggaaagagcugggcucuggaguuagucugauguggguuucaauccugguuuucccacuccuuggguuaaagcuuuugaacuccuuuaccuucucuuagcuucucuuuaguccuagggaaaaauggagauggcaguaucuuuauuuuagggucguuugaaggauuagcaauaauauguaucaaaugcuuggccaaaguguggggcacaugguaggaaugcaguggcagcgauuauuaucaucacuuuaauugcaaaacuggaaguucagauuccaggaggaggauguaguugcuguggacuggccuucucaggcaaaacuucacuuggaauaggcuuggaagacuguauaggaguuacaugaaguggaaugguuugacucaaagugcagaaaugggacuacauaaaucuguuagguuucuugaggaaguaggggagaucagguaggggaagggcaagaaauccuacuuacuaggaaagauggcuuccuagcuaguuuggggcacaaauacucaacagaccauugcuauggugaaaaugguagaaaugagaagagcaauggagggaggaagaccugugucaugaaaauacuuaucugacuguucagcauuauugauauuguggucuggaugacucugugucauggagacuugcccuguacauuauaggauguuuaacagcaucccuggccuccacccacuggaugccaguagguagcauucuucacccccauacacaugacagucaaaaauaucuccugacugccagaugugccuugguggggucacugaagaccacugcuuuaguaauuagacuaagcaucagugaagaugagauuuucauuucaguguuggaagggagaaaggaguggaguucauuuaaaauaauagaaugaacugcucuaauuauagagguguagcagaaguaacaugguucagagcauugacagcaaggccacuuauaagcuguauggucuuuggcaaauaaccuguuguacuucagcucccucauguguaaaaugggggcaauaauugcaccuaccuuaaaucaguaaguuaaauuguaacugaggccaccgauuauuugcuuaaagaaaacagcauuacuccuccuuuauuggaaagacuuugaagaaaaggggaucuuccugucucuagcucucuugaguuguuuuuuaaaggacccaucuuuugaaaagacccguuaaaaaauuagucagacaugaggcuauugaaagaucaauguggaaaauguacuuugucccugaguugauucuuuuucucugggcccacugaaagaucuucagauuauaauguaaaagugaagucuuuuugaacagagcagaagaaaaggauaucaagggcaugaaguggauguuacugaagggagucguggugugcuguaaaggaacuccugagagggacauuggccgaagggucaucucccucuucuuggcacugaacgaccaccacagaccacaaaagggcuuagaaccgaccuccauuucaaugggacuuuucagugacacuugagaccucgugucauagccaguuugugaccauucuccaacccaagcauucugcugcuuuuacaacagauuauuuuagaagcugcuuaggagaugcuacuagggaugugucaggcuucaacaaauuaggauuuccuccccaccacucugaugauggugagaccagcauggagacuggcagagugaugaaugcauuggcuuaucaaggucaugaguggcagccggcugcauuguguccccaauucaaacaaggaucccccaacacugcaacagucuaggauugucuccuaaauucuucacauuccaagcacacaaaggagguguccuggagccauguaccuuggggaaggcagauuauuuguaagcucuuguguugccuucacugcagacagaugggccuccucuauccuaaacagaggcuauuuaauaacguuugcuucuuguuaacuuuccuuacucaccugaucuaaugaaccuaugcugcuuuggaacaucacuggaaauguuucagaacaaagcaagaaucauuuggacuaguacuucuuuuggagagguggcuauuaaaugggguuuaaaguuuuucauuuguuuguuuuuuuaccucuuagauuuggagcuucuucuauggccuugcacauaucauucugugacuaugaugcccacauuagcccaguugucuuacaaguauguaaaauccuuccagcaguucagguucauuuggcauucuuguuaaauguacugcuguuaggacuggaaugagaaaaaugauagaaauacaaguaaccauaaaacaaaacuagaauagaauaacagacacugaaguaaaaacaaaauguuuauccauauuuugucauucaggccuauucauugaaauaaagaguacaaagauuuuaaaaauccaacuauauuaugaggaaauguuuuaagaauuuuuugacagucuuuccuaaacauuucaaguugauugacaaaagauaacaauccaucauauugccuacuagccaauguuuuguggugccuucaccucugaguucuaggaagugguuuuaaucauguuugcguucagcuccccuucccauuuauuaaagauuggaaaaugcuaagguuuaguugacaugaugaccuuaacguaaaagggcaugaagagggcaaagacucccagcuucuaagucuaguucaucuguuacucucaaaggugucuuugacacuuagaaaugcuuccacacccuugccgacuuuuacuuuuuaggaagugugcaguaugguaacccccuuucaaaggccaauagcaaggccacgccugacuucaaaaugagguuaugcuuuaugcuggagaugcacagcagaaaacaguaguccagccagguggggaaauaaagccagaagagacaguauauuuucaggagcaauuuagugcuugauugaucuuacgauauuguuagcguaguguuuauagcugauuggguuuaccugaagcaacugaccagcacuccguguuuggaaacagucaagggagaaaacacauugauuaguugguaaguuaacucuguaccuccauacucuaaaauuaguaaaucagccugucauugacagcuuggaaagauguuccugugucucacugaucccuggccaggguugccaggacuuucucuuuacuuuguguuuucccuggcccaucaauucuucuucaacuuuugugacuuuuuuaaaacuggcuuuauucaauuuuuguuuaacugaaaggcacaggaugcaaacugaauuuauaggauguuuuauagcgagaauaaaaggauaaauuucaaaaucauaugcuaauauguaaacugaauuuacucaaaacauuccuuuuguuuuguuuuuuugagauaggaucuugcucugucacccaggcuggugugcagugguaccaucauggcucacugcagccucgaccuccgagcuccagugauccacccgccucucagccuccugauuagcugggacuacaggggcaugccaccgugcccugucaauuuuuuauauuuuugguagagauggaguuuugccauguuggccaggcuggucucaaacuccugggcucaagugauccacccaccucggcuucccaaagugcugggauuauagacgugagccacuacaccuggccaaaacaucacuauauuuguguguauggauuauaccuucucugcugauguuaauagcagggauucuuuuuuucccauucuuucugugaggugugauggagaaaacuuauguccuauaaugaaaugggaauaaggaucuaaaauacauuaaauagcacagaacaccucccuccaccuucuaauucuuagagcaauaucaucuuucuucuucuuuaguucccuccaagauuaaucaagauauuauuuauggaugguguagaccugguguggcaaauuagagucugugggcuaagaauggcuuucacauuuuuaagugguuaaaaaaaucaaaagaagaauaguacuuuaugacaugugaaaauuauaugaaaaucaaaugucaguguucauaaauaaaguuuuauuggaauacagccacacucaauucauuuacuuccugucucuggccacucuccugcuacaauggcagaauugaguacuugcaagagagaccauauggcuuguaaagcccaaaacguuuacucucugacucuacacagaaaaguuugccgaccccugcugggaggcagaucgaaaaugaauaaucaucaguaauagaaagagcacagccuuuagaaucaggcaguacagaguccauguuaugucuugguuuccucagagcugcaacuauuacacauuauuauuccaccuuagaagguuugggugaggacgaaaugagauaaugaguguaaagcaucuauacauguauagcaugcugccaaauaccucacagauauucagccagugcugguaucuuucccucuccagguuacaaauauuucggguucauugccuuaccucagguccucuguucacacagaacuggagugaaaaauacccuuugcaagucugacaauagccggagagacaaaaacccaugucucucucucucuaccuuccuuuauuuagugucuuuuccuccauaaacugguggcguuuagcccugugaaaugucauuuuaccuuaaggugaauggguauauagaauuggucuugaccuugaauaaaagaaggacacaccaggcaaucaucauuugggggaacuucagagaaauugcuccaugagaguaacacagagcagugacuucugcuggagggguucacaggugacauuuugagcccugugcagccugugccuccgagacagucagcgagggagcccuggcggucguggggcugccuucgccagcuucagaacugugguuuuucccccauuaacacacuucuuguuaagcugaugugguugcuuucuaaacugaaucuucccuuggccagaaagaaagaaaaagcuucccugcgugaagaugaagguuuauuggcaaugucuucuuuagucucuuagcaagaacagcaaacagagaacucccuucuuucugacuuaaguuacacauauuuuuuuucucuuuuuuacuuucaaagcuggcagccucauaagagcagcauucaaauagaccgugccagggaugcagggcaccaugaauggggcauuucuuguccuucuggcccccuuucccuuugugcugucucuuuuccauguguuauuagccaccuugcaaagucggagcuuugccaacaaauucuggguucuguggguugcugucugaaucugcugcuuauucaggaaaaugaguuaguuucugcuguuuguagaaaaaaaucaacaaacccacuuauagguuacauuuagguuacuaauauaugugguagcacagcuaaguaaacuggagauuaugcugaugcuaugugcuuauuauugcaguguggguuuuaaugugaauuuugcacaaauccaugaaugauaugcccauuugccuuuuuaauuuucuugcuguuaaaaaauuagcuuauuuuguagccauugaaauauauauaaagaaaaaauuaacuucuaccuguuuuuuuucuuuuaaaaauauuuuuaugugaucuaaccagucugaaauaguuggcuguaaauggaugugggagugucauuucaaaccuuuuacaauuugggauuucuucuggggggaguggguaucagagcuuuaguucuuguuauuggcuuaugacgauagucuggaauuuuauagauuguguuuggcugucagcauggugcuugggugugauuaauuuguguagcuugccauuggauagauaauauucauuccuuggauccuuguucagaagggauuaaccaagugaacuggaaaacaugucuuugcaggagagcuuucacuguuugugauaaucagugaacaaucuagugcuaauuuaauuccacucauagaucuggcugacucauuggcucuuaaugcuucuuaacuucuauauuuuuaaucuucaguuuuuuacacauauacaaauauuauaguagacauaguucaaaacuuaacauuucuccagggaucuugcucugggaaugcaaaguaaauacccucuaaaauagguuucuggaauguuguuuuucugaugggucuguuauuucugccuuucuucuaaugggaaaaaaaauugauuugaaaggguaaaauaaacuuagcuuuuuuggaaagggaggguuaaaauaaaauuaacaacaacaacaaauaaacaggugauaccuuagagaccuaucuggcauaggacuuuugaagccuauaacauggcuuuggguuuugguauugaucuuuuauagggcuaaauaauuuauagccaggcuuuugccuugugggaugguuggaguguguguuccaccaggaggcaaagguuucuguucaaaucuuccuguucacuugauuuagguguuugauaagugacugcaaaauggagaggucacuuuaggaaagguuucucucuucuugcccucuguugccuuugaguaguuuccuccuguguuuuguucaucugaacaaugcauugacuugcccuauguaggaaggcuggagagcugcuuaugaauuguaguaagaugucuuauggcuuccagggagcaaaccuagggaguucccagguacugauuuuuuuuuuuuuuaauauuaauucuuguucuguuguccaggccagagugcagugguaugaucucugcucacugcaaccucugccucccggauucaagcaauucuccagcuugagauuacaggugugcaucaccaugcuagguauugauugauuaauugauugauugauugauuguggugccuccauggacuagacucugccucccacuuuacuuguagccuaaauguaggugacaggugaauguaggguugccagauuuagcaaagagaacuauggggcauccaguuaaauuucaauuucagauaaauagcagauauuuuuucguauuaaguaugcucuguauuuuaucuggcauccccaagugaguguuggggaauuaguuuucucuauccugaaggccuucagguucgaucacauauucagagauaauugugagugagauguauggaugggaaaagagagcaccauuuauuagguacuuuuuauaucaaguacuuuguauuuaguccuuagcuugggaggcaaguauuguaaacucacuguaccuuugaugauaaaaguagcuaacguugauugagugcucucuauguccugggcccuguucuaagaacuuugauguauccuuauuuagugcuuaaaauaaaccuaagaggguuaaguacuauuaugauuuccauuuuacacgaaaggaaacugagcugcaaggucacauagcuaguaagggauuguucugggcugaagaaaaaggaugcauggaggggaguaucuugcccaaggucacguuauuaguaauuaguggagucagaauuccaaugcagguuccuucacuccagcucuucuuaccucagaaaacacacuugccuggacccuccccuggaguuggauuuaguuggcuugggcauggcgauuuuuaaaacuuccccaggcgauuuuaaugcacagccagacugagaaccacugcuuuaccccauuuuuggaguaaaaugaauuacccuccuuaggaaaucuggucgcucuauguggccauuccuuuaguuccugccccuccuccacagaaacacaccauuccaaaucuggcagcuaauuuuucauggucuuuguuucuucaaaauuauuuucaggaagucuuggugaauauauguugggguauaaacagaccacaaagaaagaccccauagggguauucuguugauggauuuucugcacgaucuuuucuuuuucauucuuccauuauacuuccuggaggagggacuaccccuuuguucgucauuuaguuccagcuggguaccagguuggguauuuggggagguuuacagauuaauaaaacuagaccacuacccuccaggaguuuucaauuuuagaagggaaguauauaaauguaauucuagguuuaauuuucuaaaagucacuucagaggaauacaaaguauuagggaauucagaggcagcagaggcagagugagguggugugaagugugagcucugcagucacugccuugguuugaguuccugccccaccgcuuccuacccacagaacucuggccagugcuugagcccuccuggucuccaggacuuuguuggcacaguggacaugccaaauuuuuugaugagagacaugacgaguuagugcugguggagugcacaccaccgggcccagugugagggucaguccuggugagcugcugugcucugugcguugccugaagcuuuccagcaggccuuagcugaugcucauggauccaaaacaucaauaguaaguuacuaagccuuaucugcugcuccuuaaauugacagagucaagaauuagguaaccagggaggagccacagaggugugugaaugggaaacuagacccaguccuggaagaugagcaggaaauggagugggagacauugauaccccaagacccuaguuaggcaaaaagaaaaaaaaaaaaagacaucuaggcugggcacgguggcucaugccugcaaucccagcacuuuaagaggcugaggcuggcggaucacuugaggccaggaguuugagaccagccuggccaacauggugaaacccugucucuacuaaaaauacaaaaauuagcuguguguggugauaugugccucuaauuucagcuacucaggaggcugaggcaugagaaucgcuucaaccugggaguugaagguugcagugagcugagaucaugccacugcacuccagccugggugauggagugagacucugucucaaaaaagaaaagaaaaaaaaaagacauccaguccauccagagagcccgggacccuuaucuaguaagaaggcagcugcaauagaaagaggaaggcauuuggugugaggacucagauacguauuauguauaugugguggcaggugggaggaggguggugauggaagcuucuagucuuggugguaacauucacgauggaugacauagaagaggcugauuguuaaagggaaaaggaugaugaauuagguuuuggguaaaguuauauugcagccuucauugcaagcaaugcagugccacauucuauguuguuaauacgcacaugccccagauugcacauuuggggaugagggaccucucuauaucuaacuuuuacugguuugagagcgugaaugaagaaaggcucacaccacugcuaccaucccaucugucuuuuauguugaacuugugcuuucuuccccuaguuuguuuaggucuaaguagaauacuuugcauaggaaaucgauaaaucuucuauugcuguuugagugauggggcaguuucuuuauuaccagacaguucugcgagcaauaaauauuucuaauauccugaguauauuuauuucuaagugggaguuagaguaaugagacauuuacuaacgcugggcucgacucagaauucagaaacagaagguagaugacuggcaaggacuguuccuacucuagaguuuuaaggucauuagaaagcuuuuguuuuguugaaagcacuguacuuuguguacgauaugguugagccuuuuagaagguugcugagacuuacgucuuaucuuugcuuauauaguaucgacuagagguuggcaaacuuuuucugugaagcgccagauaguaaaugcuuuagguuuugcacauacauucucugucacagcuagucaacgcuuguaagaggauagcagcuguagacaauauguaaacaaaugagcuauguuccaauaaaacuuuguuuacaaaagcaugcgguggggcgccuguagucccagcuacucgggagaccgagacuggagaacggcuugagcccacgaguuuucgaccagccuggguaauagaguaagaccuugucucuauaaaaaauaaaaucagccgcgcacgguggcucacaccuguaaucccagcacuuugggagaccgaggcaggcagaucaccugagguugggaguucgagaccagccuggccaacauggagaaaccucgucucuacuaaaaauacaaaauuagccaggcaugauggcgcacuccuguaaucccagcuacucaggagguugaggcaggagaaucgcuugaacccgggagguggcgguugcaaugagcuaugaucgugccauugcacuccagccugggcaacaagaguaaaacuccgucucaaaaaaaaaaaaaucauaaagaagaccaaaaacauuucaggcuggauuuggcccacaggucuagguuuucugacccuugguucacuauaugagccaugggggcagcaguucugguuugaucaaccauuaacugugugacuuaccuucucugacucuccauuuuaucaacuauaaaaugagaucauagaagaacaaguuugugguguuauuuugacacugaaagagaucacaaaaguaguuuuguauaguugcuauaacauaguaagguacagaaaauguuagcuaaaggggaacaaaaaauccauuucagucggcguuauacguaacccugauguuuaacugcgauuaucuuaagguaagaaagagacacuggcaaagcagaauuuuugaagggccaauuaagaucacaacucuacacaaugagcugauguaaauaagguauauauugacuuuuaauagacuuaaaaagaguugaugagaucauggaaagcuccacguggccaauauuguuauuauucuguagaugguauuucuuggaaauuuuguuucauucccuuucuggaagugaguuggacuuuuaccuguuuuuuggcauagauuuggucucuccuccucccaguaguggagguguaaggaguaaaaacuuuuccuagaaauaaaacauaacaagcacuuacugagugccugguguguguucacauugugugagguguuaugacugcagaaugaguuuuccauaaucacugugucugcauuggaguuggaggagaauaucuuacacagagcucccaaaucccuugcaauuuccugggugaucaacuaucuuuuguucuaaugagguuacccuuaguggacaugaugcuaaggcagcauauaaauaagugagggcucaugugaugugggcuguguaaaugugccaagauacuucagugugagaaaaaaagucacaugugauggcauuagucuguggaagcuucguggagaaaacucuggauagggacuuuggaaguguaguuuuucuuggcugaguaggucucuuuccuaggaaauaauucugucccauucccugcagguaucaaguuuggauuuugaugaauaaagugucucuucguuuuaaaaauagggcacugaaucgccaaggcaguggcauacaggguagaacuucguggccauggcccacguggacuguaauggcuucaggcauuugguuuugcuucacacuucaaagaacugaaaagugaaggggauuuauuuauucaugaaaaccugccccacacaacugcucugugugccuggaauucuuguugugggugggcaggcugaucuggugagaacaguaguggaaagaggagaggaacauuuccucccuaggauggaagucccauagagcacgcauuugagacugcugaguucauugccauaugcuagcacauuaaacagagugcgccauagaguuggggcucaaaaguuucuuuguaagggagugagauaauaauugagcuaugccuucugcucuuaauuugguguuaggcauacaagcaggguaaucuaaugacagaaugaacauaaaacaagugagacugauucaacagaugaggcuguguugaauguauaggugggcagaggugagaaggagcaacuguccaucuuggaguucaggaagguuuuggacaugguguuguacgaacuuggucuuuaaguaugaauggagauauaaguugaauggaaauauaccagguauuucaggacaaagagaacacaggagaacaugccuaauuguaggaauggcagggcaaaggaguacuggaauuaaaaaacaaggugggggccaggugcccccagaggcucaugccuguaaucccagcacuuugggaggcugagguggguggaucacuugaggucaggaguucaagaccagccuggccaacauggugaaacuccaucucuacuaaaaauacaaaaacuagccaggugugguagcgugugccuguaaucgcagcuacucaggaggcagaggcaggaaaaaucacuugaaaucaggaggcggagguuacagugagcugagauggcaccacugcacuguagccugggcaacagggcaagacuccaucaaaacaaaacaaaacaaaaaacaaaacuaaaccaagguggauuugggaaagacuuauaagcccucugauugagcuccuuuguuguugacuucuugauccucuuuaauucaggaaucacaguuagauuucuuagaauccuucuuugugcuccaaguaucaaagaccuuauggggcuccccagccauaauggaaaaaguaauuucuuuaacaggggagacaccagagcaagagcggagauggggguacgaggggguccucauuuaugcagcuggccagagcuccucauccaacccggggcuuagugaggugacagaugugauguuggccaauguagucuuccuuuucuuucuuuuuuuuuuuuuuucugaggcagagucucgcucugucacccaggcuggaaugcaguggcgugaucucagcucacugcaaccucugucuccuggguucaagcgauuccccagccucagccucccaaguagcugggauuacaggcaugugccaccacgccgagcuaauuuuuguauuuuuuaguagagacaggguuucgccauguuggccaggcuggucucaaacucuugaccucccuuuucuuuuuccuuccuuccuuccuuccuuccuuccuuccuuccuuccuuccuuccuuccuucuuucucucucuuucuuucuuuuucuuguuuaaaaauacaucuauauuuccucuagcuuguauauaaacugaccucugcuuuaaguauuagcuauuuauugaggaacacgaugcaugggccagacacugugcuaagggcuucaccuguaauacucgguauagacuucuuauaauauccuauggguaagauacuauuauuaucccuacuccuauuguuuuggggcaggcaccuuauccauuuguuugcugcuguauuccccaugccucaaaaggugccuggcacuuacuaggugcuggauuuuaaauggauuaaucacaugcagaguaauuugaccaagucauacugguuguauaugggaguuggagaugaagacuguaggguuucaaagucuggacucguuacccugcaccaucucugcuuucugaugccuaguuagagaaagaacguccuaucuguuuuagacuugaggacuucuuuuuaaugacuuuuucagacuugaggacuccuuuuuaaaguuguagacuguuccaccuagauccuucuggucauucucuacuuuguuguggauaaaaauuuuauaauaaauuagguaauguuuaaaaguggcuuuguauuuuguacauuugcaacaauguguguauuaaccucuccuaauuccaucuacuggcaaagcuugauuugaugagaauuggguccccugcaguaaugugacucugaagcugacggauuagagagcuugugguucaggcaugaaccuugucucuuggguuggaccugagucuagacugacccuagaguuggaaauuuaguagcuuaacugacagaacugacgugaacaauugcugcuuuuuauuaaacaagggcaguucaucucauucgcaaacauuuucuaagaccuugugcaccaaauggugagaaauaagaaaguucccugcccagggagcuuauugccugcuggaggagauaaaacuuuuggaaaugggguagaaugugguaaguguuuuaauagaagcugcaggagcuuagcugagggaggagaugaccuuuggauggugucccacagacauaucaguggucuuuggaucuagaaggaccccacuguugucugccuuguugcaauuguagcauggguguucuugaaggaagcacaaaggaaauguccacugacagaguugaagaugacacuggcccaguagguuugcuauccaauuuauggaagcaaggcaaaaacauagacaaagcacaggagauaaugaaggugugaaacauguucaaaauaaucaagaacccaaacagauaccucaaauuucuucccaccccaucucccagguaaccaaaauagcuaccugguuuuuuacaacuuuucaucacuuuaaauacacuugggauucccauuucugagaaacaaagacagaggaagagagaauugcaaaaggcguuaguaugaaucugugguuugcggacugguaauuaggccagcaggcuuuuuugaacuacagagcaguuuguuaaaaauaauguuaaaaaaaaaauacaccaaaaucagguuucucaccauaaugagaaggaaaguuccagaggucaaacacugggccuuucugcuucucauuugagauuuuuaugagccagaaagcuucuucauuaaacagcaauuucaacauugcaggacuguauguuuuuuggguuguuacgcuuucacagaauuuuugaaucauagccacacuucagaaugaaaauucaaagucaaaaugcuuacauggacuuaggagaagugcuauucucugccuuucuacuguaguggcuuuauuuuguuuauguacuuguuuauuuauuuauuccuggaagaaaucaucaggccugcucagucaguaguucaucccaccaguucaacuggaagggauuuuuuaaacccuuucaccuucacucauaauucaugucuuaugaauuaugaauucaugaauuauuggugccugcuugggugaucaguaaaaauaauucaucagcauuuucuucaaaaauuuucacucuucuggcauguugauaguaccagucgguggucuuuucauuguaccuucuggaucuuauuuuuuuuuuuuuuuuuuuuuuuugugacggagucucucucuuguccaggcuggagugaaguggcgccaucucggcucacugcagccuccgccucccggguucaagcgauucuuccgagucagccucccaaguaacugggauuacaggcgugcacccuuaggcccagccaauuuuuguauuuuuaguagagacgggguuucaccauguuggccaggcuggucuugaacucccaaccucaggugaucugcccgccuuggccucccaaagugcugggauuacaggcgugagccaccgugccuggcauuaauguugaaauagaauagagguuuaaccuuggaauaaaagaaagaaucagcaaauacauuaucugagccuacauacacuuuguaaaaaguauacuuccacuguucagaauuagaugauggcacaaaaccuguugaggucuucauucauccuuacaaauguuuauuaugcugagugucccaggugacuggauacaguggagugaauuagaaauuugaaauuauugcccugaggggaccuacauucuucuuguuggagugcgucugugugggauaagguagacaaauaauauaggaaauucaaaaaauuguuucagaccauaguaaguucuaugccagaaaugaauaguccauaugauaagaggaacagacauugugagauguuggaucuauaggaaaagaggaacagacgccauguucaggccauggugcauguacaaaagaccuuuuucugaaaucagugcaggcagugaguggccagguguauuaggaucuuuuagauguaguuuaaugaagaguuuauggcuuaaagugagacaguauuacuucagagcucagcuucucuccuuggauuuucucucagcaaaugggagaaguaacgucugcccuucggaguuguuacaaggagacaagauaaacacaggguccaagugcuugguaaaugguaagugcuguuauuagagucagguguucuagucacagguccucaacagauacagcuuuggcaguaggaggugcagcugaccugagcuguuuuuaaauuaaaauuaaagccaccuagguuucauuagucagcuagcagagaggaggucugggggaccaugcuuaaccagagucagaugcuuggaggucauuggacucuacagggauucugcacagucacugggacagaagacgugcuccacaaauaggcaaauauccuuugacuucaauugaauuuauauuuuauccauuaagggagccaauuuaccuccaguguuaguuguuauuuuagucauuuacccacuguucaacguuuuugccuuuucauauauuuuguguuuuaaaugccauuaggauaucuacccccuuucccacuuuaaaacaaaauaauuuuggaacucagaacucaaauccuuaauuuugaacuuacuuucacuuuuuaaaaaaucuuggccgggugcaguggcucacgccuauaaucccagcacuuugggaagccgaggcaggugaaucaccuguggucaggaguucgagacuacccuggccaagaugguaauaauacaaaaaaauuagcugggcaugguggcgcaugccuguaaucucagcuacuugggaggcugaggcaggauagucacuugaacucgggaggcggagguugcagugagccgagaucaugccauugcacugcagucugggcgacaagagugaaacuccaucucaaaaaaaaaaaaaaaaaaaaacaaaaaacacucuuguugauacaaagaaagaucuagaauuaaaaacuuuacaggaggaaagugaaaaggcuggaacuaacucacccaaaauauuuagcaaguuaaucauaaauaagauaauagauuuugagucuuucgguuuucaguggagaacuuuauauuugauuuugccuaaugugugaaacuguauaaagcauacucuauaguauauguuccugcugccuggaagcagacacaucaucaaagugugugugugugcaagagaaaacacauuaauuucucuuucucaguuugucauaagaggggagugcuauaaagaaucuucuggcugggugugguggcucaaaccuguaaucccagaacuuugggagaccaaggcugcagugagcugugauugcaccacugcacuccagccugaaugacagagcaggaccgugucucaaaaaaaaaaaaaaaaggaaucuuuuuaccugcaaauuguaagguacucgagggcagacauuggcauuuucagauacaugugacccuguguguuugugugaauuucugugcacacguacaucccccucccacgccuugacauaaugcauacagauaaauguugagguucaguggcagcuguuuuguuucccacagacauuuuacuuagauuauucuggaaaacauucugaagagaaucacaagcauugaucauaaaguuagaagaugugauguuuaagacaacauggacauaggaauugaaauuuucuuucccauugucucucgaguguuuuugaggccaguguuucuuacucuugcuugaguauaccuggauaacaaaauccaguuucuaagauuucugcccuagagauucugauggauuuggugugcugcgugccccuagacccuggagauucuuaggacaaagcaaauuugggacacuggggaagaaaagaaaaagagaauaagauaaaguucaccugaaaggauauuccaggaauggggagcagaguuugcaaggucauagaggcucaaaagaacaauggagaaagggcaguagaugguggggguaggaagaacaaagccuggaaggugguuaagagacacacaaugaagggccuccuguucaaggcuaaagguuucuacucuaucauggacccagugcugugaccuuacuaaauguguacauuuuuugucuuuacugaugaucacagaaguaacauuuucuauuaaaaacggaaacauuacuagaauaaaugacccccaaagggaaauucucccauaauucuacucugcucaacucaauugaaauuacuauccucaaggguuugugacuaaacuggaauuacuauuguaaagcaguggauaagauggaaugagaagcucaguccuauagauaaguuaucaugcgauuuacuaucccaggcaagagaucaguggggcuuugaauaaggccuaggaggagaccgaaaaggggcggccacugagagauauggagacuauagaacaggucagacugugguaaagggaaggcgauagggggauucuaaggggcucugagguuucuggaauggcuaacagccugaauacuggugucauuaagcauguaggaauacggugggaagaucauaugguuaaggacaugucaacuuugagguacccagggggauaucugugugaagaugucuguaaggcugcuggaaauuuaaaaguggaaucuaggagugaguuggaauuuaggaauauagauuuggaaaccacagauacaugaaaaaaaaaaaaaaagacugagauacagagaaagggaggcaagaaacagaauaguaaaaugggucauuacugccuaaguguuuuuguuugugaagcuuaaugagcuaagggcucauucuuagguuacaguaguggaagagagaugaguaaauuaucucugcaggucaaagagguuauagaaucuguucucauaugaauuaaucaaauuuaacuucucauguugaaaaguagacaacucauaaaggagcuaucauguaaaccuuuuuuuaacuuggaagaaguccaaauacagaauacuuacagauugaagaaaaauguucaguuuagauuucaaguguggucauuuccauagcuauguggugaaagaaauuguguuuccgaaaaucguguuuccgaagaggcuauguuuuuaaaggugccacugggaaacuaugacuauuaugaguuuugcaguuuugacauuggaugggguguguguguguguguguguuugaauugaguuauagaacuuacauguaaaauuauucaucugacuuccggggaaaagucuguuuuuuuugaaauaccuuuuuuuuucuauuuauuccuuuaauuauuauacauuagaaagaaaugacaaggauugcauccuaguuuuaaaaugcugaacuuuuaaaaaggcaauuuuauuuuuaagacuuuaaauaacucuuauuaguaauuggauuuguggcagauuccaagagggugguuuuggaaagcacaguggcuuccgguggcuucagaccuugguuuggaauugcaggccuaccgcacaccgacucuggagagugacuuggagccuccaaauuccaagcuuccugugugcgagugaggcuagcaaaccacauugaguaggacagccugaggguuaaguuacaccauggaugaaaagcugaugcaugguucuaacuugcccgggcuugauauucaaaaaaugucuauuccuuuuccauuuucucucuuuuccaaaaauccucuugcucuguuucuguuaagacccuuuugcaacacucuguuuuaacauggugcuuaauauauugucagaaaccacauuuuccagugcauauggugcaguuuuuaauuucuaauuuagcuuuuuaauuaaaaacucaccuuuugcuccuaauaccuauagggguugguuuccaauucugcuuuucuggugguaacugaaucucuguucucccagugaugaguguaacccucuguguacaaguaggaacaucaugacugccaugcuugggccauugguauaauuauuucugcuaccucugaagacuguggugaggguagaaucagaguggucccuagccaucgucccccuuuugaauugguagucaucuugaaugucacagcagccuagacuuguagaccauaucaggaaaguagaagcaagaauucugucgugugcuacuccacuccaagaugcuguaggucaucagaagcucugugacuucagaugugcaagugaggccaaggcacugucacauuaauaucugugugaucucgguggcauugugcuuuuccaucauugucagggcugcugggcucucugugccuaaaagcugcuucaaacaagcagcucacauuccagagcucugagagauguugucagccuuuaacaguuuucucuucgagaagacauuagauucuguacagguugcagaaacguugucuuaagguggcuggaaggaaguguuugaaauaacacaugugcuugugauuuugguaaccaaggaaacauguaccugauacaaagcuuccuuuaaaaaaugaugguacccuucugggauugccucagaaucacccacagcaagauuccaaagggauuuaaaauuaaaguaggucacuuccagcaacuguaucaagaguuaacagagaaucaccucuuuaaaaaugaagaaucaucucuuuaaaaauguacuguuuagaagaggaacccaauacauuguggauacaauaugcuaccaucugaauaaucugagucuugcuuauaauggauguuuaauaagucuuaccuggauuaaauuuuccucugcuucugccuuauuauuuguauuauuuuuauucuuaguuugccuucuauuccaaauuaauccuuagcuucucgccaucucuuuucuaacaguuuguuauuaaaauuauauagugaugguuaaugcagccacuaccuguacuuugcaaacagauuuugcuaauacauccaugauauguagaaugauagaaacuggaguugacuuagaagauaaucauauccaaacuuuucauucaauaaaugagaaacuguugcugggugugauggcucacaccuguaaucccagcacuuucagaggccgaagcagaaggauugcuugagcccaggaguuggagaccaaucagggcaacacagugagaccccucgucucuacaaaaaccaaaaaauuagccaggugugguggugcacaccuguaguuccagcuaauugagaggcuggguuggguggauugcuugagcccaggaggucaaggcuacagugaacuaugaucaugccacugcacuccagcuugggcaacagaguaagacccugucucgaaugaaugaaugcaugaaugaauaagaaacugaaucuuuaggaauaguuacuuagaguccuagaagucugacuuaagucugacuuaaaucuuaaguaaguuaagagucuggcuuaaaucugaacacaguauguacauuuuaguaauguucuggacacagagaccugagccuugguacagauugugugguauuauuaccaacaccguuuuaacauuuauguuacaaaagacuucugcauguuggacaacaggaaagaaauacaguacuuaacucacaaacaacaaaaggauuaggacaguccuucugaaagcaggggucucaacaucaaaugugacaacagccauacaggcuuuacaaauauguagacuggccuaguauaagagaacagggagugggcacauauuuagcgcauugcaaugggcauaaauaccugaaguuacuugacccguggaagagcccuugacagccagauaggcagcaaccccuuuccuagucuuuguugucauacacuguaaacugaaauugugcugcauuuuuuuaagugguacauuucauaagagguugaagugaaaagaauguaccuagaauuuucaccugggagaaaauuuuauuccugauucuugguuaucuauaaaauuauauaccuggggauaaaaauuucaguuuagcuuaaaacuuaaauuguuggccaggcgcaguggcucacgucuguaaucccagcauuuugggaggcugaggcgggcagaucaccugaggucgggaguucgagaccagccugaccaacguggagaaaccucgucccuacuaaaaauacaaaauuagcugggcgugguggcacaugucuguaaucccagcuacucaggaggcugaggcagaugaauugccugaaccugggaggcggaggaugcagucagccgagauccugccauugcacuccagccugggcaacgagagcgaaacucugucucaaaaaaaaaaaaaaaaaaaguuguuacccucugugaaagacacugugaagcuuugaugguauuuuaaagacacuagauuauauuagagagucaugaaaauuagcacagacccugaaaaaaaucuuuauuguucuaaaacagugguucucaaaugccucggaauccccugggggacucuguggagcacagauugcuggaccucacucuaaaauuucugauucaccacgucuaggaggggaccugauaauuugcauuucuaacaaguucccgggaguugcuccugcuguuucugcuccggggacuacagauugagggucacugcauuaaaagaaacccaaguuaauuuaauacaaguauugcauuuauuaggucggugcaaaagucaucgcgguuuuggccauugaguaauggccaaaaccgcgaugacuuuugcaccaaccuuaacgacuuggcauuuuuauuuuauucucaacccaauugcucagccagucacugcaaggguguggcacuucagauagcacauuauauaaucagugguuugcugguaaaugcuugacaauuggcuuuaggguugaggagcagccuugauuugcaguguugccaguuucugugauauaaacagucucaucguagccaauuaaaagcugucaaucugacauuggcuuguaaaauuccugaaaauuuaacaguuaucuucaguacaccacugagucauaaggaggcguuaaaggucagguugaaauuuaaucucagguugaauggacccuuacuaucucuuuaaggggcagguauggagggagaugaaaaauaagcccuuguuuacuucucggggauaggacagagaugugugucuucaaggggaaggagacacuauaguucaaaagucaaagccuggcugcucacagaggguuuuauuggcucaaaagccuuuuaacuuuaaauuagucacugacuuuaaguaagauuuuucccuugaaaaaaauauuugaauuuuuuuuuuuuugagauggaaccucacucugucaccccagcuagaguacaaugacucgaucucagcucacugcaaccuccgccuugcagguucaagcaauuccccugcuucagccucccuaguggcugggauuacaggugcgggccaccacgccuggcuaauuuuuguaguuguaguagagacgggguuucgcuguguuggccaggcuggucucaaacaaacuccugaccucuggugauccgcccaccucggccuccuaaagugcugagauuacaggugugagucaccuugccggccaaaauauuaggauuuguauauuuuauugaauggaaaaucagaaauugcagcaacuccggcccagauucuuacucaauggcacuuagcuggagccgaggagcagcuguuccccccacaccccaucuguacuuuguuuagacuggacaggcuguuucuagaccauccacucccaggcucucaacuaggguacacaugggaccugcuucaucauugauacucaugccuucaagaauuuguaugcuccuucuuagaugcauguuucagaagggggaagggaagaauuugaucaccuuaaaaggaccuuuagaaacguaagagugaaagugaaccaaguaucccuuuuuguuucuucuucaguguuuucacuccuccuccucuuuccuuuggaaggggaaaagcaggaaagaggaauuacauuuucuagaaacagaagccaagaccucaagaagccucuaacuggccaggcacggugguucaugccuguaaucccagcacuuugggaggcugaggcggguagaucauuugaggucaguaguucgagaccagccugaccaacauggugaaaccccaucucuacuaaguacaaaaaaauuagcugggcgugguggcacaucccuguaaucccagcuauucgggaggcuaagccaggagaaucacuugaacccaggagguggugguugcagugagcugagauugugccacuggacuccagccugggcaacagagugaaacuccauuuaaaaaacaaacaaacaaaaaaaacccucuaauuucucuuucuaaacuguagaccugguaucuagaugaguuuauuccugauaaaagcauacaugcuccuaggagguuuaauuacuauuuauaugguguacgcacuuuucuuuucagaauacuguuauuuauuugucacuucaguguuucuuuucccauugcucuucucucagccucuugugucagcccugcccaggcuggcuuuuauauccuuagccuuuuuuuuuuuuucuaaguaugggaaaacauaguuuagaaguaaucccuucucacaaaaucaccucucucaaccacucugugguuauuuuauuugagggugguggaaagagggagauguuuguagagccucagagagaaaagcacgguuuuaaaucuaaucauuaucagagugagagcuaaauacuuuugcaaccuucaugagagauaucccugggaauuuucuggauaaauaucauucucaaguuuuggcagugugcagaauuuaggccacccacauuguauggggcauaaaacuguuuagugaaguucaaauaauguguugcaagaguuugguugaacuuguaauuuaaccuugaggaaagcaaauacuugugggaaaauauuugugcucaaaaucaauaaggaaugugcaaguaggaugcccucacucugagagcuguaguuugcagcugaagcuaguacaaaguggcauuugucaguaguaaguaaaacgagcaaaguggauggguggcaagacuuugacauuauuggccuaucacauucagaucaaguucaucugcagaugaauagucacuaagauuuguuaaguguuuacuuugugccacauaguacaacacagaacuuuagcacuauaagacccugaccugugagauggggaaauugacucuuggagaaguuaguuacuuugugguggucucauagcucaaagggggcuauaauuuagucucagaucuaccugaccucacauuucagauaacuuauuaucugugcaugccauggcccuuaaaagaggauuacuuguaacuuuuuauuuauuaauuuauuuaauaaagagaugaggucucacugucacccaggcuggagugcgguagcauggugccucauugcagccuugaacuccugggcucaagugauucucccaccucagccucccaauuagcuaggacuacaggugcacaccgcuaugucuggcuauuuuuauuuuuuguagagacugggucuuacuauguugcacaugcuggucuugaacuccuggcuucaagcgauccucccgccacggccucccaaagugcugggauuacaagcaugagccuggcacauuauuuuuuauauucaucaauguugaaucuacaaauguaucucuguacaacugucuuauuuuaaacuccuaaucuagguacauguaguccuuuguauauugccuagaacauacugccuaacuagacaaucauauauuuugauuuuaauguauauugauauauauuuauggugaauauaucuuacaguauuauucauugcuuuauggcuaauuuauuuauuuuuuuucuuugagauggaauuucgcucuuguugcucaggcuggagugcaauggcgcgaucuuggcucagugcagcuucugccucccagguucaagcgauucuccuaccucagccuuccgaguagcugggauuauaggcaugcaccaccacacccggcuaauuuuguauuuuuaguagagacgggguuguuggucaggcuggucucuaacuccugacaucaggugcuccuuccgccucagccucccaaagugcugggauuacaggcaugagccaccacgcccggcuggcuuacuuuuuuuuuauuuuauuuuuuccuuuuuauaauugacucauuugucaacuacucauauauaaauauaauauauauguuagucauauguauauaauuuauauacacuagugucauauguauaucuauauauguauaucuuauuucauuuggaaaaauuagaaacuaccaggcuaucagacacccaccuaaauaaaacaggaagauucuuauauucuauaaaaaacacagcaucuggugaauggaacauguuggaauuucuaucaagaauucuuuuaugcaucaauuuucuagagguaucugguguuuuuccaauuaaccuggaaauauguuuuggaaagaauuuauuuuuccuagaggccagaugcguccuugcccuuuccccaacauggcccuuggccaccaguggaguguugggagcucugggaagagagcggcugccgcagacguccaggcaugggcacuuucgccaucugucccguguuguagguuuucauugcuuuaguuguuauccucaacacaagggccuuuaggggcugggaccacaacucugccuccuauucucccauuacagcugcauaauuaguuguaaaacuuuuacuuguaggugaaaacucauuuuggcaaccauuaauucccacuguaauucauuuaguaacugcaguacuucuauuaaugggaaaguaaggucaagcaucaagcagcaugacuaauauguguugauaauugcauauuguugauaacuguaaacucugagauugcacuaauaaaagguaauaauucccaaggcaaccaggaagggaacuggggagcggcugcaaauuuagccuuugccauuuugccaguuguuuagcgucauuuacguuggugggaauucuagugcucauaaugcacuggaagauuuuuuucuggacuacguaagaguaauuggagauugauaaugugucgauaugggggcaugggaagugacugaugcuggggcagaugguuucucuagacaauugcuaagagggugugcaagaaaguugcagcuuagcacaagcuuguguggucaaaaaguaaucugcuugcucuuuggacccacauuuuauguaagcugauacugagagcaagcacuuguagagagagggaggugugaagauaguccaaagacuugagcuagagucuggcucugccauuuaggggaaugcccuugagccagaucuguuaaauucauugagccucaguuucuuccacccuuguagaauguaguuauucuuguaaagcuguugauagcauuaaaugcgauugugugugugugugugugugugugugugugugugugugugugaaagaaacugauuuggaaacucgaaaaccccucuauaaacaggaaccuggaagucuguuuguccuuucuuaauuuucugaugauacaaauagauauaucauuguaaaacuauucuguguacuugaguuucuuucaaaacacuaacccugaguagugcuugcaauuucucuaaaaaguaaauuaucacagaaagucaguuuaugacccauuuucuggggcuagaacuaccuuucuuuuuggggauggggucucacuguguugcccaggcugggcucaaacuccuaggcucaggcaauccuccugccucaggcuccaaaguaacugagacuacaggcacaugccacugagcccagcuggaaguaccauuuuugguaacucagauuccuauagcugugcauggggucauuaccuuggacaaucugaugccugagaagacucuguuuuguguuuccaaauggaccaucuuauggaccaucuuugcuuggaaaaggcacuguccagaauguguggcuaauggauuguugaaggagcuggacauggcccaggcaguccggugaaucagugacugaugguuguuuguaguagcuaaugcuguucccuccccccaaagauaaaagaaccaaaaaaccaucaaguggcuugauuugacuauagcagcauuugugacagaacugggaaccaaaugaaaaucaacuuaguacuacucuucaagagauuuuuuuuuucuccagaggcuuagcguaggucauaccccagauguugaugaugaauauauugauugcuaucucagggcgaaaucucaaaaguuuguguugcccuuuuaggaauuucacaguuuauauugaccuauaaccaagaggcagguucauuauguuuaauugcauuaaaagauaaaagaaguagagaaauugaaaggaaaaagagcccagagauuguuaccuuuuuaucaagcaacagcaugccacaaacuuugcauaaauaaaaaauaauaaccugagccuuucaucuugggaaucuaaugaaauaaaugugugcuguuuuccccauuagcccucaccuuagccagcccuuacauuguggacagaggagugaugucauuauuugugagcuagaugacuggcucaguaggugccgugugguuccuaagaagauuguaggucuugccauugcgucuugugucucuugcuguacagguggaaacaucuguguguuuucauuauggugaccgcuggguaacuggucgccaaccucuguaacugaagaaacagcccucacaauagaguacacucuuuucccauccagaguguggcaguccuuuucugcgugagccuuugucugcauuuuuaccucuugcaaacccuccuccagccagagauugauaugccuggaugauuuauggcagugauugucagaaacuuuugaagcccauccaauuucaggauucggguucucauuucuugucauuuauggcacauuugaugaauucucacuaucagcugacauguuucauaauugucaaaacuuugauugaagugguauuuuugaaaaaaaaaauuauggaagagaaaaaaaggaaacaagacuccuucaucacauuuuuuucuccugugccuaaaaccgcuuugccggagguucacagccccaucauuuagccucucagcuacuugcuggccuggcaagucagucuccucacucuccuuuuacagucuugugccugcauuuacuggggcuuuucuuuugcuuguuugggccuuuuuuaguccagaugauaaaagcuuucgaaaguagcccuuuggagaaaguuucuaagcuuucccuucagcugucuuucaagguauauccgguggggcaugaauagauaauaauagcaagcucuucucucauuuuguuaucuugaccuagugcgguuuguuuuguuuuuguuuuuauuccaugagccaacauucuuuggcuggaauguuggcucuccaggucuuuggcugaggucaaaacuuagaagucugcuccuguacuuuggaguucuccuccucauggugaagcccacagcggugagccaggaguggaucugguuccuucaucuguagaguuuuguuuuuguuucuuuaccuaccuuaguccugugucucuuucuaggucagagaaaacuucuuauagcaaaugacuccugucccuucccacucugacccccaguacagugacagggaauuccugcuucuccuagcuuguccuuucucaguuucuuuccucagaagcaaccacuaucugcagugccuuuugucucuuucuagauauacuucaugcauagauaaggauucauacauacacguacauagaaacacacauauaaacacagacaugcgaauaucaagauauaguuugaaaucauaauucugaacuuucacucuaguguuuaaaacacaucaauauuuaauaucucacugcugcuaguuggaugaaagaugaccauuuuaucaugcucuacaaggaucaugccuccugugaucugauuucccuccaacucuccagccucauccagcacuuuucuccucuuucucagaccucuaggcccacuuccuguucuucuguuaauuccucaaacaagccuucccuuguuucuuauauuagcugucacucuguuacauucuguaguuucuugacuguucauuuagggcauuuagcacaguuuguaaguuccauauuugugugauuauuuaaauagcaucuuucugccucuacugaacugcaaguuccaagaagacagaaaugaagcuguuuuuuuuuuucuuuuuuuuaaagcuguuuuaucccuagagucugugcauuaccuggaauauaauaggaucuccguagaucauaguugaaugaaugaaaaacaaauggcuggcuggcuggaugaaugaauguaugauguagaaacuuccuuuggguagggaggaaaugcuaccuuuuggaaaacaguuguguuuuaguauccaaacacauguuuucucuguagaccuuagguauuuucuuuuuguuguuucuaaccauuuucuaagaagucaguuauucuagaaaggcugaucauaggcaccgucaaggaaaaucuuggcaguuauuaaggguauuagcuuacaggguuuacauuuucucaccuuccuugaucucuuuuguuucuaccgugguuuauuuuuugaaacauaaguagucccuguuuuucuucuaagauuucucccacauuuucauggcuuaauggggcauccaggagauaauaagugguggaugggagauagggggaaggagaaagugagcaauguccacucuagacuuacaguccucugaaggcaagauuagggucccacaucuuuguauucccagcauguggcacaagguaggaacuucacaugcaguguggagccacaaugugagggugaacaaauaugcaggaagaaaggaagaaauggcauugcuaauucuggaacuggcauuaucguuaaugagcggcucuguaucugugcucaagucuugcuucuaauaagcugcuggggauauguauuaccugcuguugcagcugcuauuucuuucaaauuuacuauugcuuuuucccuuuuuaguuucuucaucuaccucuuuaguguuaaucuuugugucuaaaaaaagaaaacauagaguuuggagcaaggacagaaagauuaauuucuacguacagcucugcaucuggacgugguccucauuuauuuuugaaggcugaggguuuaguuuaugaugacuacauuuuccuaguagccugagagccugcuaggaaggcugucaguuuauauuucuauugguccacuucuugcacuuaaaauggcucagagagugaagccauuccuauuuuaaagcuccccuucugcugacagcuuucuucuuagccaaagccaggaagaaguauuugcuauuacccauuguuuuagaugugcuaacaccaugcuaauugccaauagucaggaauggucuuucuuaauaacaauuccugaguuauuuauaauuaacccauuguuuauauccuaguaauguuauuguauuugaagugauugaaaauagcuuaaucugucuuaagugaauaauuucuccuuguuuaccuuauucccagcaaacuuccuuuuuccugauaauacaaaaguaaacuuuauucuauuucauccuaagugaugaaacuauuuugcccauuuaugaaacauuuugaauacuuacaauugguuauuuuccaggaaauauugggaccuugccuugaaauuuaguaugguuuaugacuugguuuaugacaccagacagaagcuacagauaugaauccucuaaccaccuguuccuauuuuccuacccuucauuaauuugacuuuugacuuuugauaaaguuaucacauauuaaaauauacgugggugcuaagccuuauacugugaauguuccaggguucaaauauuuuauuuuuacugccuuccccaggcauuaccuccauaaaugauagaacauacuuucuuuuugucaugagaaguaauugguuguuucuuuuaaccugucucguugcauuccagaaaaauaauaaaucuuuaaaauuauuaaaauaaugagcaacaguuauagacauuguuggguuaaccuugggaguccaaagcugauccuaagaggaauuaauaauauaucuuuuuuuuuuuugggccaggcgugguggcucaugccuguaaucccagcacuuugggaguccgaggcagguggaucaccugaggucaggaguucgagaccagccugaccaacauggugaaacccuguuucuacuaaaaauacaaaaauuagcugggcgugguggcaugcgccuauaaucccagcuacucagggggcugaggcaggagaaucgcuugaaccugggagguggagguugcagugagccgagaucgugccacugcacuccagccugggugacagagcaagacuccaucucaaaaaaaaaaaaaaaaaaaaaaaaaaaaagaauauauaugcgcccggccaaguauaucuuuuuuuaauauauugccucccccugcauuaauuuuuuucuugcuuucccaguuauauaugcauauauauaaacuucacagauaccaaauagguuauugcucauagguaauauaauuuguaccugauguaaaggcugcaacugagguuucacugaugguugguuuaccuggaauuuugugaguuggaaggcuuacugaaaugaaggaaaaugcuuauguaugacccagcucucucucuacgcauugaccaaaauagguugaucagggcaacagaaaugauuaauaggauagugcagauuuggauaaagagcaaaaagauuaggauuugaaaguuggaggaugaagggagucauguaggauauagucagguggaauucggacuugcucacaaaaucccagaauacuguaacaaaagggcacuucuuuaugcuagaaggagauaauuucacuuuaaauaaagggaaauggaaugucuuugcccagaggauaacaagcaaauagaacucauuuucccgaagaaccuguguagucuggggugucagggauguguguucaagaaaaauuuaggcaaaacccaaugauagcuucucaaggguaaguuucaaacauucagacaauaucccuaacccuugagugaaccaucacacagggaaacgauucuguuguacagaauauguuuugaugccacugucagacauaaagucuggugggaacuggacuucuacucugacccagggugacaauuuuuauguuuuuaaaaucggccgucuuccagaaguguucauuuuacagugcuuauaucucaguaccugaacuucugcagaagaguuuuauuugagucauaaauuucuaaugucaaaaccucccugacaauuauuagccaaauguuuagcccaaaagagagauuaaaaacauauaucuuguaaccuagcuacccaaugaguuaacccagagagaauuuucauguuggaaguaguuucauaagacuuuggggagagauaccugcagaucugacauauuaguggucagaacaaaaaccuuuguaauacaugaucaacugucugccauaugaaaagcguauucauagaagcaacucaaagugcacaguuaggcaguccuuaccaauuaaagccucccucuuuuaaaaauuuuuuaaauaagaguucauauuugcacaauaaaugauuuauugagaaauuuuaauguguaagcuucccacugacucuaacugaaauuagaaagcuuugaaaugaacucauaaauauuguucuuacauacaaaauacacuggaagcuguaaaauguaaagcaguuuaucauugaaaagcuaagcuacauuaaagaauguagauuugguuuaacucuaucuuccccacgugaugccgaagaauuugcgaaguacuuuuuauguguuuuguuuuauuugaucuguguaacuacccauuaaaguuagaaggaggguggguauuacugucuugguuuuauagccaagguugcuauggucaaagaaggcuaagugacuugcuggaaggucacugauacagcagagugagggcugaagaacacacauacucugugacucugagaucuccucuccuucauccgugcuaacccauaauguaauacuauucgaucaggcacaguccugaaauaaccucagagugcuuaaugcugaagggcauauucuguguuuuaaucaaagaagacuaugacagcaagaauuagcugcaccagccccuuugucaaauguugguuagcugaauauuugaaaaagcucaauauuugugucuuugaucagauaaugcacuaaacauugauuuauagaggauuaucauagcaucuauaacguguuuuaaauaacacaauuaaaauaguuaugauuuuacauaauaggacaagaucguaauguagugcaaccacugaaagugaagguauguaaagaccagagucuuuucccuagacuacuagaauuaguaguuccuucuaauucuagcaaggcugaaaacuuguaaauagacucuuuaguaguguuagagugaacuguuuacauuuuaugugucuguaggaacugaggccagaugggucgauugcauccucuaguaauuuccaaaugaaguuuuauuaaaauccuuuccagacaagcauuuuuauaagaaugacuaauaaaaccccaaacacaaauuuuagguucucuuauuuuauaaaaacaugcaaguugcuucugaaguuauuggaagaccaguaaaauaauaaaucaguaaagauggaagaagagcagagacuuugagcaaccccaaaauaaccaggggugagcaacauugcugggcaucuuuugcacauugaacugcucagggcucugaaacaugagacuaugaaagaagcauuccucaugcaauggguuuauugcuugguuauuucaccaagcaccauuuauugaaaggcaguguuccugguggcuaagagggcagagucuggaaucugccaccaccacuuaccaaguggguaacuuuggucagaguuauuuaaguuuugucucaguuccuccaacaauaaaaaggggauguugacaauacuuaauacauagcgagugcuuaaaauugugugugacacacagaaaacuucauucuguucaggucacccugugagcauuguuggguauggugggaaaagaaagacacuaagaucuuagagaugacuucaagguuccuuuucugguccaagacgauguacgaugaauagucacaggaaaugacucuuuucugcgauagaaucuggacccaccauuuaccuugugguucugcucacuguuuagugcugaguugcuaauuuuaaugauucuuccuguuuuaagaagcauggcucugagucguauucucucucucugccugucuuucucucuguccacaaacacacacuuuuugaguacaacagcacagaagacgauuuagagauacaugugcucaagacuuaccucucucuguauaaaaguuugaaucucaauuacucccauuuccucuuucuuucuuucuuucuuucuuucuuucuuucuuucaaucguacugcuaugucuuacugcuuccuaagugaaaggggaaaagaaucaaaguuagggaaaucaaagguuucagaaaugaaaaacuggauuucuaaagcacucacauuguaccaacuuauuuugugccuguuccuuuaaguuuuuuuuuuucuuuuuuuccucugccucuagagcuaccaaaagcacacugaucaguuuuuacagcuuugccaugauaggugcaguaguugcuuuuuuauugaaccguagauugcagcauuauaaaacacacucauucagaggaguaaugaaggccauuuuuaauugcauuugggaagcaggguacuauuauuaaauuauaccuaugucuguauuggaaaaaagagagagaaaaccagguuguguuuucuuugggauuugagguuucccagagcuggagugaauucaggguugcgugacaaaauuuggaacuucagccuuuugggauugugagucagaauuuccccaguccugugauuaaccucaugcacccacaacuguuguaaaucaaacauccaagggcuuaguaauaacgaaauuuauuauuuccuggaagauaacucucaauguaugugcguauacaaguaagacagaguggcacacacagauuuuuacuuaaagauuguuguuauacacuguauuaguuuccuaggucugcuguaacaaagucuauaaacuugguggauuaaauaacccaaaccucacaguucuggaggccagaagucaagaucaagguguugccagggcuguuuuccuuccgugggcuguuagagggagucuguuccauaucucuugccuagcuucuggggauuuucuggcaaucuuugguguuucuggcuuuauagaaacaucauccugaucccugcuuucaucuucaccuguuuuuucccguguguaugugcauacauguguguguguuuuuccaauuuuuccccuuccuauaaggacaccauucauauuggcuuaggcacccacccuacucugguaugaccucauucuaacuuaacuaauuacaucugcaaugacccuauuuccaaauaaggacauauuuggagguacuuggaggcugggucuucaacuuaugaauuuugcagaggacacagcucaacuaguaacauacaccuauagaucugucuuuaguggauauguauauaucacacuguucuauacauuggagaagggugaaaauuaauuguaagaaaaaauugcuugugcaaugaauagcacuauaauccccuucuugacaguuaagggaaucauucuggaaagcgaaauugcucugagccaauguguggaaaauucugugcaagagcucauuccuuuuguugcauuuuuucaaagauucuuuuggcagugcugggcucgguccagaugccuuccacaucaggugguuuaagcauguguguacaugaucgugugcaggguugugggaagccaauuacgguuggaaacaguuguuuagcuggcaauuagauuccucacagucucgaauuauguugcuuuaaauuaagauuaugcagauuugaguugcuuugauaauuugcaaaagccauuuugggguuauaacuaaaaauguaaucugccaauuaggagauuuucuaccugauaucuguuuuguucauuggacuguggacccauuuuaaauauuuaucaucugcuuucuaaaccaauggcaagagugucugcauaccaguguggugaggggagauacagugguggaggggagauacaguggugaggggagauaagucccugaaucagacuuagcuuucuugaggacucagugcugacuuuguuacuguuuacuuuagcaacucagguaaaaacaugcgucaaauaacucuuuuguuucauauaaaaccugagguuuugcaagagacaaaaccucuuaaaagugagauuuguuguuuaaauaagaaauaguguucuauuauuaacccaggccagcugagacaagcuuuuuaauuagccuaaaaagagaggauaauguauaaggagaaugagguagguuuuacuuaguaaugucuuggagauuuaaaaacuuauccuauggugaucagauucagauucaagcagacuaacggauagcaguauuuuccguucaagaugauggacaucuuaucuuuauaaaugauuauaccgguccgucugggagaacaagaugcuaaauguuacauauuccuuccuucuuucauuggaaguucauuggaaauuuuauacacguaccaugcauacagagaaguucgugcaucacaaagauucaacucgauaauuuuucacaaagugaacacgucuauaaccagcaccaagaucaagaaaucgaaugucaccagaacuccagaggcugcuugugucuguuccagucacugacucagaauuuugugauggcauggaaagcuuggcuuguugucugccggcagugaguauugaugauuuugggaacacguuuccauucacagugccuuuucaguuguagguuaguuuuuacugggagcaguuucaugcuucuuguucauucugcuagagacugggguuagcuccuuagaguuaagccuuuuggugagcauaaugcagagcagaagauggccuuuacugcagccgggacaaagucuuccaggugcugccugccuuccucucuucccaccagacuaaauucuuugugguuccuugaaacaaagguggccuuccccuuuaccuccaggucuugguccuguggcuuuccuacgucaggaucccaugcccucuggccccguccuacugcauucauuucccaaggcugcuguaacaaaguaccacaaacggaguggcuuuauuuauucauuuauuuauuuuugagacagagucucucucagucacccaggcuggaguacgguggcgugaucuuggcucacugcaaccucugccucccagguucaagagauucucaugccucucccacccaaguagcugggauuacaggugugcaccaccaugccuggcuaauuuuuuuuauuuuugguagagaugguguuucuccauguuggccaggcuggucucaaacuccuggccucuagugaucugcccaccucggcuucccaaagugcugggauuauaggcgugagccaccacgccccgccuggaguggcuuuaaacaacaaaaaucuauucucucacagaugcgaagucuagaaguccagaaucaagguguuagcagaguccugcucccuuggaagccuauagguuuccuuccuugccucugguagcuucugguagccccaggcauuccuugguuuguggcacagccuaacuccagucccugcugccaccuucacuuggccaucuucccucugugucugugcaucucucucugucuucacauggcauucucuucuuugugucucuuuccuuuuuuuauaaggacagcagucaacuggauuaagggcccuccccacuccaggcuggggugacagcugcaacaacugcuuuuucaaauaaagucauaugcugaggugcugggguuuaggaauuuggcauaucuuuuugggagacacaguucacccauaacaucugcauuacccccuucuuaguuuagaugccgucuuuucuaggaacucuucugccguguuccuucccccaacaucuggcuuugaugucccucuugacacuggaacucucuugucaugcuuucuagcaucucucauaauuguuuuuuuguuuuucuucucugccggacucugagcaauuugaugucaggaauaauuuaggguauuuuagaauuuuuuuuccaaauuauuagaaacuuuagaucguggaauuuuggauacauuuaugcauuuugauguaaccugaaauauuuguaaccgagucauggucuucauguucauuuugcggggaagaagugauaccuauugguaaaagaaaaggcuuggguuaaacauuacccccucucucgaguuucugugaucaugacaaacauggauucuaaauccuuggcuugagagcacaugaauugccgagcagauguggcgucagcgcuugcaaggcuguaagcagcuuacugauccagcaguuuaaagacuguuuacuggcaguggcaacauuacuucugguugccugucuuaauucauuuuagauuaaucugucuugcaguucgaaggaaaaugaauugagucaguaacuucaagaguuauguaaaaucuguacagugcuaaauaauugaaugggguuuuauguauggucuuuaaauuggaaugucaauuugacacaaaugcuccaaaacagaguguuagaugagcugaucuguuccucauauaaaagcuuugaaaauuccauucuuguaucacucuggaauucaccguucccaucccuugcagaauauuaauguuaacuuuggggaaggugagucugcuuguguaacucuugggccugggguugagguuuuaggguaaugguacccaaacuugaacggguuuaagaaccacacgaggaguuuguuaggaaggaugcuuggcugggcaugguggcuccuaccuauaaucccagcacuuucggggcugaggcgaggggaucacuugagcccaggcauuuaagaccagccugggcaacauagcaagacuccaucucuauuuaaauuuaaaauaaauuaaaaagaaaaaagaagaaggaugcuuucuggguccagcuccagaaauucuaauuugguuguucuguaacugggcucagggaaguccuuuggcauuacaggugguucuaaugcugacauucucagaccacauuuuaaagaaauaacugguugaagggaugcacggacaugagaaggagaguaugugaacuccugagagaaaauucaagacuauuuugcauaaaauacauuuaucacaaccaggcagaccaaaaaugaccuuuuugggugggauaaaggggauauuuugcagacccaaagaaaauaaauucuugagauuuuuucccagaaauccaugggaggaaggcugaaguauccuuauucuuaucagaaaacauauuugaauuuuauuaccaauaucuuuaaccccauuuuguagaugggaaaucuuugaggcucaaagagcaaagaaggcuaacauuuguugagcacuuaauaaaugaaacugucaauauuaguaauuauuaucgccaucaucauuaucuuuauuuaaccuauagcacagcccugugagguguuaucacugccauuuacagauauguaaagcaagauucaggcaguucagauaacuagcuaggauuacacauugagcuuguagugagccaggauucaaucgcaguucaacuuaacuccaaaauccauauucuuuuuacugcaucaagguagauuuaagaucuuuacaugacaagaguugccagguaaaauguaggaggcccaguuaaauuugauugucauauaaauaaugacuaguauaaguauaucccaugaaauauuugaacauacuuacauuuaaaaauaguggaccauaguauacuagaaaauucguuguuuaucugacauacaagguuaaccagguauccuguauuuucauuugcuaaaaucaagcaacccuguauguggguaguggguuuucagauuguaugaucguacuuucugacuucugacuccaaguccauccauccuuucuaugugccacauucuguucugucucauucuugggucucugcuguccucuuggggaagagagugaauggcuuaccuacucuagccccuguacuaaggggcccaguggcucaugccuguaauccuagcacuuugggaggccgaggcggguggaucaucugaggucaggaguuugagaccagccuggccaacaugguaaaaccccgucucuacuaaaaauacaaaaauuaguugggcgcagugacgggcuccuguaaucucagcuacuugggaggcugaggcaggagaauugcucaaaccuagaaaaugaagauugcagugagcuaagauugcgccacugcacuccagccuggugacagagugagacucugucucaacaacagcaacaacaacaacaacaaaguagccaggugugguggcccaugcuuguaaucccagcuacuagagaggaugaggugggaggaucgccugagccugggauguugaggugcagugagcugugauugugccacuguacuccagccugggcaacagagagagauucugucucaaagaaaaaaaaaacaucagugaacacauagaaguaguucaccuuuucuucacccacauuaugcauguuuucauuugcuuaauuuuagagacgaaggagugagagccaguuaguugccuuacuaacgauagaaagaaucaggccaccauucugcuacaacaaauuuaggaaaaggcuuuuauuuuggguaugauuacagucagagcaauaagggugaguuagaaaauggaacaacagaaccuccuggggucuuuuuugugagaaaaauaauaauguuuugguuaauguuagauugaauguccauuaugugccaggcaauuuacaugcaucauuguugcaggcugcccugagagguaguuauuuuuaucagccccauuuuaaagauguggaaacugauagagaugugaugugcacagccccaggucaaacagcagugagacgcagagcuggaauuucagccaggugucuccacccuggaggccuguucuuagugcacugugcugccaaggcuaaagccuuuuaucugggccuggucucuguccuagagacugccuugucggguggccuuguggaaaucugcucuuuggcuuggggaggcagacacugcaccagcagcuuguuccaucuagccuuaggaagcuucaccuucccggacaaaaagggucaauccaaaaguggcuuuugacaccugugccaaacuaggaagccgcaguggcuucuucgggaauuaggccuuagccccguggaagaaacucuguccuguguggucuucugugugcaguggaaacuuucagcaaggcuucuaaauucuugaugaucacaggaucgcuuugcaccgaaaacuggcaucuggccugcgcuucauugaggguucccuacuuuuggcgagagcuuuugaaggccugggucugugaguuuuccuuuauuaguaaaugauaacaaagcacuuuaaagaaaggagacacguccguggugguaguucuugcugugugaagaaagggagcacuggaucugagaacaaaccucucccaaguuggucccuggggcuccuccugcugcugcugcugggagccccuuccuugcaccaguggucggcugcuucccauguucucucgcgcucucuguaggacucugccugcgaugacuguccucccuuccugagccauuuauaaaaacagacuguuuccauuucuaagugacuaaagggauuccuugaaguagugagaucaaagaugcguuuggaauuugucucugagugaauacuaacggcuugucauggagacaugucacaggggagcccgaucuugggaaaaccaaaugaaagccuuaggagccagagagcgaucaggguggggagugacagaugcagggaauuuuggaucagacaaaccagaaaugaucacuuuccacauaugcgacuuugggugaguuguguuuguaucugugaaccucaguuuuccuaaucugaaauagcauuagucaugccgaccucagagaguccuagaaauuaagugacuauuauguauaaaaugccaggcauggugacucagauccaguauuuacucgauacuuuuuccccucuucauacccuaauaugguaauggaaaauggauuuugauggauuuuguaggcacauuuuaaaauuaaaagcuauugcagaauuccagcuagucauucacugguguucauaagguuagugggugccuacuacguuccaggcucacuuuaaguggcuggggaauggaguauuaugagacagacacgaguccugccucuuuguagcuuccauucuggaccgggaagucgguaacagacaaagcagcagagggaguacacuuuuaaugucaggcagggaaaagagauaugagaggauuuggcugugguagucugugagggccucuuugaggaggugucguuugcauauaacacuuucucauggugaaguggcugcuaugcuaugcugacaaauagccauagcugaccagaugaguccuucccacauugcaaacagguuuucaugugcacaucuugauggcucucccauuuccuuaccccucuucuuuccugcaagcuccuguuguccucucagugucauauuacugaacagaguugaauuacccacagaaagcuuucauuaaucuugcugucccauugggguguuacuguaaaccuuggcacccagagcgucugccacggaaguggcuucuagcaaggggagaaggugaagccugagaugggguagagugaggaagagugagaugugagccaagagaguccuuaaacauuucaugagguuccacagagccugcgaucacacucuugcggccgugccguugccagugagaauugaugccuucagcccaggguacugggagccucccagcaaggugaugugccacguaaacaugcuccuaaaggaccugaaugcuaauauccauaggaacugcucugcagcuucuuuuaauuagcugagauggauuuugggaggucagcguaacacauucaagugaaauuuauguugguuuucuuuguaaacuguugcaguuggaauucuucccagugaguggucaaagugcucuuuuuugcuuguuuugaugagauuuggguagaggugaaauagagguggggggugaaaguaggccaaaaaauuugaaaauauacuuuuuuuuuuuuuuuuuuuugagacggagucucccucugucgcucaggcuggagugcaguggcgcaaucucagcucacugcaagcuccgucucccgggaucacuccauucuccugccucagccucccgaguagcugggacuacaggugcccgccaccacgcccggcuaauuuuuuguauuuuuaguagagaugggguuucacuguguuagccaggauggucucgagcuccugaccucgugauccgcccgccucugccucccaaagugugaaaauauacuuauauccugccaacucuaaguccuaacauccaucuugcaauaggcaaaugaagacacugauggacaaagguuauucuuacuuuuuaucugagcucagggauuugguuuuauuagcucuuuagccuaccuguuagcucuuagccacuucuuagaacccaauucccucagcaguugaagaccuccuuguuuugcacuaaauacgcauuugguccaggugaguauagacuagcgguucccaaccuuuuuggcaccaggaaccgguuucguggaagacaauuuuuucacggaccaggagggugguguggggaugguuucaggaugaaacuguuccaccugagaucaucaggcaguaguuagacucucauaaggagcgugcaacccagaucccucacgugcacaguucacaauaggguucacucuccuaugagauucuaaugccaccagugaucugacaggaggcagagcucaggugguaauccucgcuugccugucacucgcuuccugcuuugcagcccgguuccuaacaggccacggacuagggucggucugcugcccaaggguuggggcccccugcugcagacccaguguugguauaugcaaauauugcuugcccuuuuggagucuggaaauguuggccacugucuggucauucacuugcuuugacucacccuuucuccacguccuuuucucaacuuucccucuguggauuagagccacaaaucuaugcccucauuuuccaguccugaaaauggagacaugugaccuggcauaguuuuuguuguuucuuccaggacugaaguaaucugggaaauguaguuuggcugccaagaauuuggccuuuccuagacacauugcugguugauuagaacaacagaggagaauguuagucugggaggcgugcucacauucccaguguagcucaggggacccuuucaccagauaggacucacagacuucucaagucccuauugcgauguggcuucugggacaccuucaaccucugucccugguaagccaauggcugcuucauuucccauguugguuucccccaauuuucugggaccuccacauuaauaccuacuuucccguuuccuuuuaaaucuccuggcaguucuacugcuuggaaugcauucuacagauauacuugcguagauaagagaugacccauuucauaauagcaaucacaucuaacacuugcugaggauuuaccugguuucuggaacuaagaauuuuacauauuuuucauguauuucauucuuuaaaaaacucugugaggugggacugauaguaucuucauuuucagauaaggcaauuuaagcaggaagaaaguaaaauguaaccaaagguguauuuuuuuuuaauugcagcugugguuuuaauaagaaaagauuagaaacaauguaaucaaugugugucuaauuaaauacauaaugcuuuauugccaauaccauaggauacugugcagccacagaaaaaugguauugaauaucuucauauaauagcguggaaaucccuccauaauacaugaagugaaaacaaguaagucuguauauaaaaugcaggcugggcaugguagcucaggccuguaaucccagcacuuuuggaggcugaggcggguggaucaccuaguucgagaccagccuggccaaccugcugaaacccugucuuuacuaaaaauacaaaaaguuagccaggcaugguggugggcgucuauaaucccagcuacuuggaaggcugaggcaggagaaucgcuugaaccagggagguggagguugcagggagcuaagaucaccucacugcacuccagccugggcaacaagagcaaaacucugucucaaauaaaaaaacaaaaaaaaguauaauaugcauaaauuagcucaaccauuguggaagacaguguggccaucaucuucagcaaacuaacacaguaagagcaaaccaaacacugcauguucucacucacaagugggagcugagcaaugagaacacauggacacagggaggggaacgucacacaucccugggccugucggggguugggaggugaagggagggagagcaucagauuuuuauuauuaguuaauuuguuuuggucgucaugacuagacaguaauucacaugguuuaaaacaaguaucaaaauauagugaaaacagucucccuuccaccugcgugccuccucugccagcacugccccucuccaccauagauacucacuaucauuagucccuuggguaauguucuagaaauuauagggcaaaauuguccucugucaaaccccuuacacaacugaagcauauuacacuuuaguuuauucauuuuuuucuuucucucuuccagcucugugucaucucccuguuccuuucuuaucuucccaaacaagauuucucucaucuggugaugcgaaugaaacuacagucuuguaguuaccugggcuugaagcucuagaaucauguuagaccuaucuucuucgucuuuuguauuuaauuuaauuuuacuuuaaguuccuggaugcauguguggaacacgcagguuuguuaccuagguaaaugugugccguggugguuuugcugcaccugucaauauaucaccuagguaugaagccccacaugcacuaacuguuuguucugaugcauuuuccuugaaaggaggccucuaguuuucaccaaguuaucaaaaauauucaagauccccuuagguugcuuaggauggugguaacuguuccuuguuaccuuagaaaggaugcagauauucuuauguaaccugucuguaggcauguucucuagggccaucaaaugcuuuuuuuguuuuuuuuuugagauggugucucgcugugucccccagguuggagugcaguggcgcgaucucagcucacugcaagcuccgccuccuggguucacgccguucuccugccucagccucccgaguagcugggacuacaggcgcccgccaacacgcccagcuaauuuuuuguauuuuuaguagaaacgggguuucaccguguuagccaagauggucucgaucuccugaccucgugauccgccugucucggccucccaaagugcugggauuacaggcgugagccaccgcgcccggccagccaucaaaugcuuuuaaaaaauugaauuaauugccaacucuaacaacugaaggauuucacauagaaauguggauucagugcuuagguaggaaaauggaagauuuggcagcccuacgcuugcauuucuacauggccacgguccuccagagcuagguagaggaugccucuuucauggagagaguguucucuuuuuugccucaggccacucuuacaaccuguuguagucuaaaugacacuggcuuggcuugagaagaaguggguccuagucucuuuucuuccuaaagcaacucuuuaaaaaugugaauauuuuuucagaugauaaaaaugagauucagacaguuuagauggaaucagccucaguuguucacugaaguggguuaggauaaugugaaacuugaacucagaucaucuaacuuuauucuaauauucuuuccacugaaccacaguugucccccauuauuguuacgauuuuugaccuucaaggcauuccuagagauagguagaguauuauaggcauuucacagaugaguaaguugaaacuugguucagcucugaaaaaggaaaguuacguucuaaaagggcagagcucauauuuggucucagguuuuuugacucaaacacuauacuccuuuagugguacucaaaaaccucagagauccauauaauucugacauuuuuuacagcagugauauuaaugauucuaacauauuugacuccaaacagaagcaggaaagguggagggacccccauuguugauguugucucagaacuggaagaaaguuccugcggucagucagagaauaaguuauaguagacucacuccuugcaaagcacugacuggucugggaccaugggcugcaaagugggagagauguuaagaggaauaaggaauugcuuuccagaacccuauaaacuuagaugggcaaccuagcugaguauaccugagaggauuuaacagcuuuauaaaggccacaccucaaguucauguuaacauuauuuuaccugcauucuuaccuauagaguaauaagaauuguccuguuuuauaguauuagagcuguccuauuguauaacaguagagauggcugcuuugauggacacuucuuguaagccguaguauauuugaugcauauuuauuagggcuguguauugguggccaaauuuguaaagugaagacucuguaauaaaugaagaagcauacauaggguguguuauuuuccuggaugguccuuuucccauugcagaguuugcaaucauuuugcaaucuucaccuacaugugacguagaagaaaaaguacagagagggccaauuaucauaaaagacacuuugcguaguggugaaaugcuggacuuguagccagucugccaguuuuaaauccuggcucaaucacuuagcagcuugugugaccuuagaucauuaguuuauguaacccuuuguugccucaguuuucuccucuguuaaaugaaaagauuagacaauucauauccgauagaguugcugugaaagucagcuaauugcacgugaaacauucuuaggaagagccuggcauauacuaaauagugcauagguauuagcuacugcugcuguuuuguuuugcuguuuuuaaucauuguugaggugccuauuccucaguugcuaugcuguagcaaaucgagcuuuguaacuagagcuaagaaacuggugggaaccuaggcauggaaguuguauauguguacccuuugggcugagcacuauaacaugagggguuuagacuaaucccuaauagucugccuagcugcaagcaagucugggauaucugucagucaugagaagcaucauuaagcaugugauggucucugaggcugggcccuuuaacuuguaugaaaaaccccagcugucaaaaguuagguagagagcuuuggaccucaaguccugacugccacucuccagcucugugaucucaugcaaaucacuuugucucaggacuuugucucccucacccccauguaaaagugggaugauaacaucauuuuccaggaucaggguggagaauaaauagaccauguuuacuaaauguccuacggagugugguggccaaguaggugcuuagaaaguggcugcagcucucaguauuauugugaaugaaaaauucuggccucauauccgguaaaucaaaauacuucacccuaacuccuaaggcaauauuguugccuagaaucaucagcauauuuggagaccaauaacgcaguuugcauauuacauggagaauguggguggacuaauugcauccaggcauggggugacuggcuugagauuaaaucaaaaggaauuuccugaguuugugauguaagggaagcucaagagacuggaauacucaggaagugaaaucccagauacaaggacugaaaauaaucauucaagugguggaaaaggugauagaaagauugaucaauggcaccgaguuuagugggacaucugcgcugugcucccucuuugguuuccucccuuucguggcugagagguuugguguaucagugcuucuuccuccucagccagaaaguuucaguuuuucuauauucugcccacccucuuuucuugccuguauuuguccauucauucaauaaagacucauuuagcuccaaaauauucauugaggagcuaaaugugccagguccuggagaugcaacaguaaaacacacauaugcauauacccacaugcacgugcauacacaauuugcacacauacgugcacaugcacaccuccaugcauaugaacauggaugcacacauggccacgugaaucccucucuucuuggaauugacauucuaguugaggaggacagaaaauuuaaacaauaguaguaaggaaaauauguaguuuguuucacuugacgauuauuguagguuuccccacaauuuuuuuuuuccugccucugcuguuugggagguuguguguccaacuauuucuauucuuugaagaacuucuagccuaauugcuuaagcuucacagaaucucuucaaacuguuucuuaaagggcucuaguuauugaauaaguuuugauucacaauuucaugaaaaaauuuguaaacauauuagaaugugguaauaugguuuuucuguuuauugugcuaaaagcaaaaguguagaaaaguacaaaaaccaugaaaauauaccuuguuugaaguaaauaaauaugaacaugaaauauauuauuuaaccaugcuggaggucaauuuuaaaugaauucugcuuuucucugggcuuaaaaagaaaacuuaguaacuaguggguugcuauguuuuauguuaagcaacauuuaaauugaaaucaaaguagaguaaguacauauuuuaacuaaaacagguaugucuaguuauggggcaaguaaaauuguauagcaaugaaauuaaauaaaaaaccuaugaauauuuuuugaguuugaaauacaauuggcagaaucugagcuugcuauacaucuaguuggcuuuuaagggaaacugauuuuuuaaauuucccuucuuugauuuuggaucuugacuuaaagaauccagauucccauaaacauuauacagaaaguucuaauggugccaggaauuagaaaaaucuaauuucuuuuuuuuuaauuuuuuuuuauuucaauagguuuuuggggaacaggugguguuugguuacaugaguaaguucuuugguggugauuucugagauuucagugcacccgucauccgagcaguguaacuauacccaauguguagucuuuuauuccucaucccucucccacucuuuccucugaguccccaaaguccauuuucucauucuuaugccguugcaaccucauagcuuagcuuccacuuaugagugagaacauaugauguuugguuuuccauuccugaguuucuucacuuagaauaauguccuccaauuucauccagguuccuugaaugccauuauuucauuucuuguuauggcugacuaguauuccaugguguguauauguguguguauauauauauauacacauauaaaacauuuuauccacucguugacugaugggcguuugugcugguuccauauuuuugcaauugggaauugugcaucuauaaaugugugugcaaauaucuuuuucauacgacuucuuuuccucuggguagauacuaggagugggauugcuggaucaaauaguaguccuacuuuuagaaaucuccaggccgggugcaguggcucacgccuguaaucccagcacuuugggaggcugaggcggguggaucacgaguucaggaaaucgagaccauccuggcucacacggugaaaccccgucucuacuaaaaauacaaaaaaauuaggggggcgugguggugggugccuguagucccaucuacucaggaggcucaggcaggagaauggggugaaucugggagguggagcuugcagugagcugagaucgcaccacugcgcuccaaccugggugacagagcaagacucugucucaaaaaaaaaaaaaaaaaaaaagaaaaauauucacacuguuuuccauagugauuguaauaguuuacauucccaccaacaguguaaaucucauuucuuaauggcuugggcuuguuggaaauuaaagagacaucaggaaacaggcaagccuuuuuuuuuuuuuuuuuuuuuggagacggagucgccgucugucgcccaggcuagagugcaauggugcuaucucgacucacugcaaccucugccucccaggcucaagcgguucuccugucucagccucccacaaaccauuuuuaacuuaaaucuucuuaguguaaagauaacaacuaauauauuaaauauauguuuuuuuaaauggaguuuaugcugaggaagaauuauuuugaaaauaauuuauuuggaaauauuuccauuguuagauuuuuguugcuaaaaaugguauauauucaccauuaaaacuuuccuaucuucucagcuuaaaacagcauugaaaaaugacuauuuuacuuugucuaaaaaagucuuucaacaagggucucaauaguuuuugaauucauugguuuaauuucuuuugauaaguuugcaagaacaacugauagacauuaagauagcugugaugcauuaguaaauuuuaauaaaaucuuuucuuaugaaauuggccaaugggauuuaaaagcuuggucaugguuuucuaaguguagccccaaaugcacuucuauguggauucacauagcuuuguuagcuuucuuacguaguuguaacccucauuaauuccaaguuuugggagaaaaaaaauccugaauuucaaaccuguucuuggaaucacugguuuauaaaauauagacuggguugaaaaauaacgaagcaugaccuauuauguugguuuuacuacauuuuuucuuacaauuaauaaauaagauaaaaauuauuuuaaaauguaucuuaaucuuauucuucuuauuuuuguacauuucacaauauacauuuuaugucaguaaagcagaguguguacauuaccuaaaaauaaaccaguagauacugcauguucaauuaaaaaaaaaaauggauggaggccgggcgcggugacucaugccuguaaucccagcacuuugggaagcugaggcaggcagaucacuugaggucaggaguccaagaccagccuggcuaacauggcgaaaccccgucucuacuaaaaauacaaaaauuagccaggccugguggcacacgccuguaaccagcugcaugagaggcugaggcacgagaauugccugaaccugggagguggaaguugcaaugagccaagaucaccucauuacacuccagccugagcgacagagcgagaccgucucaaaaaacaaaaacaaacaaaaaaugacaggguaguguacaguagagaauugagaaaaucaccaaauaagaugauauucuacugguacugaagaguuaauaauacucaucuaucuuuguguuacucaccugucaggaaccucccaggaauggguugaucguauauuuuauuguacguguuuuaugaaugaagugcauuuuuauuaucgaaugaagaaagcguauaggacaauggggaauuauuuuucucuuaaucuaucuuuucagcucuccucgucuagcauauguugggcuccccaguuuuaauugugaagacugggagauuuugcuacauuagggaucacaucacuuucuuuguguagauagaaucucagucucucuugcucuuuucuuucucucguggagauaauaaucuaacucugacauccaugaugugaugauuugccaggugcucuauuucuaguuacagcuacuagggaauugcaagaagacauugggaaaugguacuuggccuccacuuagcuuuauucagauuggcuuguuucccaaggacccacaggaucaaugaugcgugcagugcuaaagggcagcugcgaggucagggcguauuuauugcuugcuggggcauguuauugaccaauaagaaguuaaacaguuccuagcuacagcuaagacauugccucuuaggcaggaagacaagagaucaccucgggcaacuuucguuuacacagagagguguguaaaguggaaccaaggcuugcaacucuaggcaucccuuguguuugucaggauuucagcuuauuugggguggcugcaaggcuuugagacaugcccaugaugcuaugcauuuuucuaaacucagccuuugucaagguagucagggauuguucauuuugaaaccucuguagauaucugcauguuugcugcaaagguuuugucuaggugagauggacuggcucauguuuccuaaugcugaugcccuucccucccuuccaucugucuuuuauacacacagaucuauuuauuacuuucuuuucuuugaaaaguauaacuuagcuuuggauaaaggaggaacaggaucacauuugauuaaacgcaagcaacaguuuaccucgcaugggcuuggaugaauaaggaauccaaaaggagcgguauucaggaaaaaauaaacuguguguguguguauguguguguguauguguguauaaaguacagauauauauauacacacacacauauauauauauacacgcacauacauauauauauauauacacucagaaauaaguagugaaaaaucuccuuuuagcuuuaugagauguucugagcucagcucugagguuuauguucugacuaugaaaaauaaaaugauuuuccuaaguuuuuaaagaaucuuucuuucuuucuagguguaaaaagaacuuuuuuugugaacuauugaaugaagaggugaggaaggagaggcaggaggaagaaaacaauacaaaucaggcugaaaggccuacagauuaaaaacuaacacugccuccccugcagugagauaguccuuucauuuuagcuccuugcauugaaauagcauugaggauuaaauuuguguaagccccacaaaauucaaaauuuaugugcuuuucugaccacuugccuucuaguggaaauuuuaagcauauuagaggauauguuucugugggagcugaucagaaugguacuaggaguacaaaagaauaucuaaaacuaaaacacagcuauauuucagaucauacugcuucaucacaucgagugcaucuacaaagguaauaaauaguauguggcugaguuagggcuugggaccauuuucuagaagauuugcccuuucugcaauucuagucucuauaaugauuggaguguaggaguuaaguuguggagcgucucauaaauuuaacuagaaucauccccucuuaaaaucuaaaucaaauauugacauauuagucggccauuauuugauuacauuuuuauugguuuaggcagugagagauguuuugugcagaaucugguuguuuucagcccuaaaguaaggcauugcauuauuucuaaauaauccuauaaagcacuaaauuaaaaaauuaaaacaaccaacuuuauaaaugauggcacuccuaguuuucuaugugccagccucucauuccggaauuucugaaaggaagaaggaaaguaaauuaacauugaucacgggccuacuccaucccuggcuuuguguuuauacaugacuuauguucccucccuucucagaacucuggcguguuagugguauuaccuugcuuuuacaagugaagaacgguuaacuaauuuggggaagguuacucaguuagggaguaauugagcugaaguaggaaugcagugcugacuucuguaaucuuucucuuucaguuuuaccaaaauggacucauucugacucauuuggggguuuuacaaguuagcccucgguaacaagugcccagcagccuugccuguauucagcucuucuauauuugugugaugggcacagaacaccuucauauguaugcuuucuuauccucaugaucagccaacagaggcaugaaucuaccaaaagaggcaaauuccuccuuaaaaaaugcagaauuuuaggcugggcacaauaguucaugccuguaaucccagcacuuugggaggugaggagggagcaucacuugaggucaagaguuggagaccuugucuuuacaaaguauuuuuaaaauuagccagacuugguggcacauaccuguugucuuaguguacucgggagccugaggugggaaagucgcuugagcccaggaauuugaggcugcagugagcuaugauugugccacuguacuccagccuggguaacagaguaagaccuugucuuuuaaaaauguaaaauaggcugggugugguggcucacaccuguaaucccagcaauuugggaggcugagacagguggaucacgaggucaggaguucaagagcagccugaccaacauggugaaaucccgucucuauuaaaaauacaaaaauuagccgggcauguuggugggcacuuguaaucccagcuacucaggaggcugaggcaggagaauugcuugaacucaggaggcggagguugcagugagccaagaucgagccacugcacuccagccuagugacagagcaagacuccgucucaaaaaaaaaaaaaaaaaguaaaauaaaaugcagaauuucuccauaugcaggaauggcaguggguuuccucucucaaagaagauagauccuuugcaaaagcauaaaacugaaccaugaaggauguuacagggaaggaaaggcugcucagucagggugauucacuggggaugaggcaucuuggggguuccuuggggagcagaggugagccccaaugaaagacagcuuuguauuaaaaccauggggguucagaguacuuauuaacuuauaaaauaucaucagaaugagcucaucugagcuaauguuucagaccaagcacagaguaggcuguuuacuauucuguaccucuacugaauaauggaaauuguauuuuuugguuuagccaguuuguuuuuaucuuucuugaucucuuucucaaagcaauuucuguuugaguuaguggcuuuaaccacuuaucccuagguauauaucaagauuaguaaacuauggaccaccagccaaaucuggccccuuagagacagagguucucaacccuggucuauauucaugauuuuggggguuuauuguaccuuauguacuuauuguaaauaaauauaaauucuuucugaaaguagguaggaguagaacucuaaauauacauccaucaacauauccaaguuggucagacugaaaauugaaaauuaccccuuuuugguguguuaugacgauuuguuaaaaaaaauuauauauauauaaaguauauuauauauaaaguauauauauauaaaguguguauauauauauauauauaguaugacaacuauaccauacggggaagggccaaucaaugccucaauuugagcaucuccacuuuaaauuguccagacaugcagaagaagacucucccucuucccuaguuaaugagcuucauugcaauugaggauuuugagaggggugccacuucccucaaaugguauucccuguuuaacgacugcuacugcuaaagguauuguggguguaacauggagaaggaacucaaggcaucuugcacuuuaucucucauugugugcgagagcuggguaacauuauagagaaguguuccagaauuaaaguagugcucugcuggccuguaccuacaagagauagugauggaaauuuuaguuguuucuccuauaaaaauguuagcugcuuggcccagaaugggcuaagauguucaaugacagagauugaguguucaauuguguuacaaugagccauuugaacaauuucuguuuguccucugccugucacuuuucucuuuccccuuuccaauccugcuuuaagaaauguaggaauagcaguuuugcaaaggaucucagcaauucuaauaugaaagauuauuuuucugguuaccgagucugcauuacaaauuacuccaaaauuuacuggcauaaacagccauuuauuaaguugauggauucuggggccaagcauuaagauaggacggugcacagaugacuugucuuuguuccacgauguauagggucucugcugaagagcucaaaggcuguggcuaaaaucaucugaagcagcguugugucugguagaacuuucugugugaugaaaauaugcuauaucuguacugaccaauauggcagccacuagccguacauggccauagggcaacuguaauguaacuagugccauuauagaauugaaguuuuuauuuaauuaauuuagauauaaauacccacuaguggcuaccauauuggacagcacagaucugaaggcuugcucacccauaucuagcaguuggugcuaggugacaguagacuuuaguuggggcucucuccauuggaacaccuuucuguggccgcuuccuguagucggcuguuccuccucauaugguggcuggguuccaagggcgagcgucuuaagagaaggaaccaagggaaguagccuuggagccagcaaucuugcuuccacuguauuauauuuauccugucuggauucaaaggcaagggcaguagaccccauuucuugaugagaaguggcaagguucugggagagcaccaggacaagaaauauugcuauaaucauaucuggaaauaaucugccacaguuguuccagguacccaguccauucguucauuuauuauucauucagcagacagugaaucccuacuugguuacuuggcaucagguuacuuagagaauggcaguugaugauaaugaagcucauaaaaaugugaaggaggugguugggaaggcauguauagguaucuccaaagcuguaugguauaugccaugauaauacaugguaagcagagaauggaugauuagcuuagacacauaggggcaucuuugaagaagcaacaugaaaacuggaucuuaaauuugcaguaaacuaaggaguuugccagagagagagaaagagaugucauuuaggcaaaaaguuaagccuacacaaagucagagaggcaaaaugguaagcuuuuccuggggaugccucaacucuacauugcuuguucagaaaagagcacuguacagcuacccugccaaccacguccuucauuuucaguguguguccccacccacgccaugcauauugaaaaccagccgcauacccagcaggucaccaauccagaaaaauccauagcccaaggggauaucauugaugaauuacagacaaguugccuaucagcaggaauccuggauuggauuagagaauccucauaccaugcuggcuuuucuaaagaagaucuggcucucagagaggaacaaagaugccugaacacauggucugcauugaaaacaaauauugauuggccccugcuggguugcugagcuagaguggguuagaaucugaugucaaaaagugcugggguguggaaaaccauuaacucugcugauugaccagaauaaaagcuccaucuauuuuuaagaucuuaaaaaaaugagggugaaaucuuuaagugggcggaagggcagaauugauggugagaacccauaguuaggcaaaaacacucucucucaguuugucuucgugacucuggacacagaucuuaggccauuugucccuaucuucuauauagcauuuuuuggaccugugacuauuuauuaaugcugcacuaaauuuacucaguugcaaauuaacguccaaauagcugauguucugugguguucagauuuaggauucagaccgucugcuggguguucuuauuacacugguagaaaaaugcucuggcuguaucugauugcauccgacaguuagauauauuucugucacugccagauguacaagauacuguaaaaggagcauuuucucuagcaaauuagacuugcuagcuccauggaucuagauugacuaaaacagcuuguugccccagggauguagcuggauuuggcuuggucauuucuuuuaaauauaggacuucagaaaccugaucuagaguccuuuucuuuuggagacaguaucuugcucuguugcccaggcuggggucuaguggcaugaucauggcucauugcagucucaaccucccaggcucaagugauccuccugccucacucucccuaguagcugggacuacagacguguaucaccaugacuggcuaauuuuuguauuuuuuauagagaugggcuuugccauguugcucaggcuguucucaaacuccuagacucaagugauccaucuggcucagccucccaaagugcugggauuacaggugugagcaacugugcccagcugauccaaguccuuuuaaugaagauuuuccaaaucugcugccuuuacuuuuaaaccugagauguguuugucuuucuagaguagcccucccaauagaacuucuuaugaugaugacguauucuaaauguacgugguaagcauuagccacauguagauauuaaguacuugaaauguggcuugggcaaauggggagcuguuuaaaauucaauuaaauuuaaauuuaaauagccauauguggcuaguggcugugucauugggcagcacaguucuagcauccgcuuuuagagaugguauuugcuuagagaagaguaagaacuuugcuagcucuguaacuuuuuagcaguaucuuaauuugagucaucucuuuccucuaacaacaaucuaggaaaagaagccauuggccauuggggaugccauuggccaacuaagggcugggauggggacuugagcaagggccacuaggcuggccauaaaaccugucacuuuggcuucuuuacucauuuuccugaaguauucuccgcaagauaaccaggacauuuuuaguagguuccauagccuaaucaaagguguuugggaaggccugguuaauuacaguuguacggguuuccuuccagaagauuuucucagccuuaacuauacucauggauugugagucuccagaugaggcugugguaucacugccaaacauauuugauaugaacagaaccccuuuucucuuucugguguuguucuguguaauaauaugcuuugggaaauguugguuuaagcaaugagacuuccugcuacaauagaugauaaacuuaaggcauauuauaggcaauuaacauaucccuuuucuggacuuugguggaauuugaaaucugcauuuauaguuugacucuguucauccuucacuguguuugcauuuuuaguuaacuuuucaaguacauaaauauccaggcuggccuggcuguauccugccgggccagagacuugugucaaguuuaguucuuauaguuggagaaaugcuaguguuuccuccaucaguaauuuuuuuaucuguugauccccaugcagcugugaguaugaaugcauacauauuucuccuuuuuuuuuaaaacuugaucagccagcaggagaugaaauagagcagaucacagcucccuguucauuuaaucauaugaguuacuaaaggaaggaaaaagaaagaaauguaaaaauggagaaaugucuccuccccuuucuuuuucucucucuuucuuuuuaaaaauuguucaacaaguuaucugcagaaaacaucugccucucaaagaaugaauguaauuuggguucugaacucauaugucccucugguuggaaggaagaguuuuuugcacaugaagugaaaucagcuaagaugcugucugugaagcugaaauauugagauuuauaagaugacaguaaaguagugaaaagugguguuuuucugcuugacacugucaccacuguggaauaagaauuccgggaagaagagacuuagauacagggucuacagcugucuguucccaugccacggaagguucuuccagccaccuuguuauggcgauccuccuggcagggaaugagagccaucuccacugccucccuuugagugguuaucuggcuuguguugcuugucuugucgggagaccaagggccuugcaaaguaggugccugugaagagugucagcugaggcccugcagggagcuggaagcuuggaaggccugggagaaaaugccuggcuaauguaugaggccuggaagacucuucuuuguuaagaagauucaugggucucugaggaguggaguaaucaggacuaggagaagauguugggccaagccuucguauccuauauccaucugcuugaacauuuuuuuuuuuuuuuuuuuuuuuuuagcuaguugaaaggaggaggucccguugaggcuuauuugaacaaauauuugcucucccuaauuauauacccagagcugcucuccugaauguuuaaugcaaaccuuaauauuuacaauagcauaaggaagaguuuauaauguguuugggaggcuuccgaaguuggggcaguaauucuucuuugcacuuauguaauacuuuucuuccuaagagaccugagccauguuuaccuuagccacuguucacauugagaugaagugaagugagggagggagaugaaaacuccagagaaaggaggagccccugugggcagcugccaacauguuuuauaggugagacacuugucuuugccaaaaguugugugccagccacaaacuuuucuuucuggucaggaauaacauguaagccugugcuuacaauugccuucugauauggacguggagagugucacagaggugccaugcuggguuuuugacccugaugguaguagacuucuugcucagugcccugcuguaugacaagccugacccauucccuuauuagacucaagauuuagugagucuuaaaaagauauuuggaggcuaggugugguggcucaugccaguaaucccagcacuuugggaggccgaggaggguggaucacuugaggucaggaguucaagaccagccuggccaacauggugaaacgcuguguccacuaaaaauacaaaaauuaguuggguguggugguaugugccuguaaucccaacuacucaggaggcugaggccggagaaucacuugagcccgggagguggagguugcagugagcugagaucaugccacugcgcuccagccuaggugacagagucuuacuccaucucaaaaaauaaaaauaaaauaaaaaaaggaaaauaacuccaguaggguaguugccaaguucaaaaggccaaagaagagacucagaaccagcaaaagauacaugggauuuuauuaagggcuuaauucaggggagaggguccaguggugguaggcuggacacgagaaccaccuuauguacagaaaugguccaguggcaaugagccggacaaaguaaccacuggcucaguggcagcaagcuggucgggaaaaccacaacugcuugcagacaucaugcacuuuauauggcauuucacaaauauaaaauuuagcugggcgugguggcaugcaccuguagucccagcuacuugggaggcugagacacaagaauugcuugaaccugggauguggagguugcagugagccaagauugcgccacuguacuccaucuagucugggugacagagcgaggguccaucuaaaaaaaaaaaaaagacaucgaagucuggagaacugaguuugaaaccuucuuccauuccguguauggaccuugggaaggcuguuaagccuccuggugccuuguuuuucucaucuguaaacaggcauaaugaacaccauuugcacaugguugguacgaagauuagaaagagugcaagucuaguaccuggcugcauaggcucuuguguuggagcaguggugauuauuaguucugucaucaccuguagagccuguugacacuugaaggccaccuuaauuuugcaguuugcauguaaggguccucuguagugauuuccagaguuuuuccuccaugcacggugccuagaacgaugcaaacugggcaguuacuugggguuugcaucuuuccacaaaacaaaagaugaaaaagagagauccugccaaaugcaagcaagaugaggaagcaugugccaaugcccaagacuucaaggaagucagguugugggcaguguuuaugcaagugggaacugcauuccccagcacuggaucugugggucuuacucuuaggcuugccggccuuagcauuauggcagcagccacuggagaggcacaagugguuccugagcauuuugcugucagggaaggcauagguucaggugaauauguguaagcacucaucuucuaggaugcuggaaugugucgagauaucgcuucagcugaguuggcuuuuccuucuucuccaacuuuuuuugugaaaucugguucuauagaugcugugcccagcugucagauugucucaguucucuggaauuaguuuaaaaugaaaguuuuuccuugucugcuauagacaguucuacaaacagaauuacucuccuuuucuuaauugcuucugucuucaagggcaggaagagauaacuuucucuauaggaagagagggagacccagucuggguucuuuucuucuuuucucuuuuuuuuuaggcggagucucgcucugucgccuaggcuggagugcaguggugcaaucucugcucauaacagccucugccuccugggcucaagugauucucgugccucagccucccgaguagcugggauuacaggcucauaccaccacacccagcuaauauuuuguauuuuuaguagacccaguguuucaccauguuggccaggcugguaucaaacucuuggccucucaaagugcuggaauuauaggcgugagccacugugcccgccuccagucuggguucuaagggaucauuugcuuuuucccauuuuccacauaagcaagugcauuuguuuuuuuggcauaguugcugucacaugaccguguaggugagaaagcaguggggcucuucuggcagggcauggcaccuguuguccuuaggcauggacagcaaaugugaguagcuaacaucucgcccagauggaucucuuuuguauaaauguugaugcugaaaacugacuuccuguucugaacuuuuuucuuuugaguggcugagugggugacuguccuaagauaccaguaugacuuggccguuugcaaaggauugcucaacagggcuuuccccaaguuguucuuccccaugagaggaacaguuagcaaacagaauggacuuuggaguuggucaguuuaaaagagcuauugaguacugcaggcuccauuaugaggucuggggccacaggaaugaacugaacacuuaagggucuuuguucucaaggagcguguaauugaguggaggcagacagacaaaaaacauggaagcagaaauaaacacaaauaguggggggcaggggcaguggaguggaagcaaggagaccccuucgcuggcuuuugauguacuccagaccauaguaauguggcuuagccgacgcaggagccaggugaggcagugggauggggguggggggaggaauuccuuuuguauuuuagagcuagagccaaugggacuugcuagguuuugccucugcuauggcuuagguauguuacuuaacuucucuuuaaaaccuucauuuguuuuccucugaaaaagggagauauuucacagaguugugguuaaaauaaaauaguuuuuuuuuuuuuuuuuuugagaggaggggucuagcuguguggcccaggcuggucucaaacuccuggccccauugauccuccugccucagcuuccugaguagcugggaugacaggcaucagccacugcaccugucagauuuuuuauuuuuaguuguuauuuaaguaguuauaaaagaaugagcaccucagacuggauuuuagaggagagcccccuagacugucucuguguggccacuuguccaauucuggguuggaccggcaggagccugugcucaucuguccacagggaccaccucaguguuuggcauuaccaggcagcgguugcguccauugccucuacuauccccuucuucgcauuggaguagacuucccugggggcagcaugggaagagguuccugcugcaccuugcaggccucucuugacauugggguugggagggugcuggagguggagggaggugggaagcucaggccugcacuguuuuccucucugcccggccgauccugaccccucucuguuccuagcagcuaccacugucuuugcugaugcugugguuaccuuuacagcagugguucucaaaguguggucugagcgucuuuugcaucagaaucaccugagauaauuauuaaaacugcaggcucugggccuuacucuagaccuacucagaaucacuuggacugggcccaggaaucuacacuuuguaaugaccucccuaauuuagugagccuugugugcucuaaauuuugagaaucucuuauuuagaaaauuugauuuuccuuuuggaguaauaauaacaaguaauauuuguuagagguuaauuaugugaugcuacucaguguuuuauaugcaauaaccgaauuauuccucaaaaauaacagugugaaagagaaacuaauauuagccuuguuuggccagugggaaaauuaaggcaaagaguauuugcucuaauguugauugaagagccaauauguauguauguauuuauuuauuugugacaggaucucacucuguugcucaggcuggagugcaauggcaccauuacggcucaccacagccucaacuuuccaggcucaggugauccucccacuucagucuccugaguagcuggaacuacaggcaccugccaccaugcucagcuaauuuugguauuuuuuguagagacgagauuuugcuauguugcccaggcuggucucaaacuccuggguccaagcgauccuuccgccuaggccucucaaaguucuaggauuauaggcaugagccacagcaccugaccaacagccaguauuuaaacccacauccccagccguauccuucaccuacucucucccagccucccuuauguggugauauuacaugaaugagucuucuuaauuuaaacugacuacuggauggcuuccuguuauguuaagagguagcaacuuaaacauagagcauuuuaaaauugagcuuuaacguacaucagagccuaagauuugacucugauuuugauacccugaguaaacuuaagcacuuuucuccuucauucacuuugguaaaugagcugugcagccaugcucuucucguaaacuuuuaccugcugugcuaggcugugagccacgaagugccugcacugcccugugccagugucuggaacauucuccaaguaauuggccagugccugcgcagauagaaugcagguagaaugccaguucuccccaacccuugccauugaucugcaucuugggaggcugugcaaggaguuggaggaucugggguuuucccagugucuggucacugaaagaaauuuuuucuuuuuagugacuccagguuagugucugagaaaaguuggccaucaaaacaggaccagcccgagcagguuugaagauaaaaaucaaucauuccguucauaguacuuucuuauuucauguuccuuugcuuccaacucccauaaggaauuugcuaaagauacaaccucagagauagcuuaagguggagagaaauuuucgaccauaaguuccuuggagaauacgaauucaaguagggugagugggaagagguuucuaccaacauuuucuccuugcaucucagguccugaaucuuccaaaaagugcugcuugugcccuacacuggcucaaauuugcauuucugaaacuaguuugguuugcauuaauuucacuggaguugugaucacauugaaaaugcaaagccuaauuguuaauuaagaaaagucauuuugagaugugaugguguuuuauacucaacaugagcagguucuauuugguuguggcaaccuuaagauuuaugacugacuguccuaucaacacuuggcaaauguuuccaugcuauggggaugcauuuuacaggcuguuaaauaagaacccacgaagugguccgguauguuuuuaaaaaaugagccuagcaccaauguauagcuuucucuagaauuuaaaucucauuguuaauuugaaguuccucucuuuauugaaagcuggguauugaauacaccuacugggagauguggccacauagagauagucuggauuaaugggcuuuggucuuauuuuuuagaccuaaauuuauucuucauuaaaagaagaguaaaauuccaggugcgguggcucacgccuguaaucccagcacuuugggagccugaggcggguggaucacucaagauuaggaguuugagaacaacuccucaguuggucaacaugucaaaaccccucucugcuaaaaguacaaaaacuuagccaggcgugguggugcaugccuguaaucccagcuacucgggaggcugaggcaggagaaucgcuugaacccaggaggcagagguugcagugagcugaaaucacaccacugcacuccagccugggcgacagagcgagacuucgucucaaaaaaaaaaaaaaaaaaaagaaaagaauaguuaagcaaggugcuuuuuauuuucacuuggaaaguuucuuuauauuuucacucagaauacuuaggguuacauacaguaauaaaauuuuuaguaacucuauuaaaggaauugccuaacacucaggagucaccgcuuuccuuaguaaaaaaaagucaagaauacacuaggguuuauguaaaacaagaaaucuccaguccaaaaucagugaaauaagaauacagcaucaaauuauauuauugaaguugaagaacagugcacagggagaaaacaaagugauaacuuaauucaaugcuauagaaaagugauuugugagucacuuuaacauuucagauuuguuuaaaccauaaaagugauaaauuagccaaagagcuaacaauugauauuaucuuaaguucacauaaauuuugauuuaacugaagcaaaugaaaucaauguaguuacucccuuccgauugcuucaucuuuguacaguuuauaaagcuaagaauaaguagcucuaaugaacaguuuuuuuuuuaagcuuuuuuguugagguuucucuaauaugugucuuuuaguaaucucuucauuuuuuuccucccaguucuucaucucuugggcucagcaucuccuucuacuuagagcacccugaacauguagacacagugguaaugcaccuuuccuuguggcuauuuugccacacuaggaacucuuuacauuccaggggucccauuccagagaucccaauaugcagauauucuacugucuaugcucagugcugugaaguucucuguuagggaccgaacuacaaggcauuaacaggcaggauuggugcccgcuagagguuuucucucugaaaucaucagggaaaacaaacaaacucaaagggcaaaugugugcauagcaaaagggaagucguggaaagaggucuguggcuugugccuuugagagcuggcagaaugagugagcagcacaggcuuggugaguguuccaaauuuauucagagaucccucagauuugguuugguauguaugggcucuuuuuauuacuuccuuuguuagcgguucgguguucaaaaguuucaaagagucgccacagaguuucuucaucauucuuggggagccaggcaggugggcaacucuuucucuuaagcagccaucugaaagaccucuuaagcagccaucugaaagaccuuaccucaggauuacacuuggagagucagagcugugagaugccugcccguccguagcguuccugacuguguuacaagucugguagccugucugcaccugguuccaagcuuuucggguuguugaucauuuuugaggugguggaaacuguuaauguuuccuccucauuuugaguucgggagagauuugcccagccaacuucuaaucagagacucuuucaaauccuguccagucucucucccuccacuccuuccucuaguuauucuccaucaggccuucagaaugugcuuuuugguguguccagucagaucauggcacucggcuuccugucuacacaaggaaaaaauccacaucauguucaccagaugcuuguucaacccgcuucagccccccagguuuccugcugccuucccauccucucccaacacucuggccucagggcuuuugucuggaccacucuucccaagguaucuuccccuuuugcucaaagucagucaugagggaggcguuccuuaauugccacaucucuuuucuuuucuuuucuuuguuuuuuuuuuuuguuuuguuuuguuuuguuuuugagacggaguuucacucuaucacccaggcuggagugcaguggcaugauugcggcucacuucagccuccaccucacccugcaccccagguucaagcgauucuccugccucagccucccaaguagcugggauuauaggcacccacuaccacacccagcuaauuuuuguauuuuuaguaaagacaggguuuugccauauucgccaggcuggucuggagcuucugaccucaggucauccaccugccucagucucccaaagugcugggaugacaggugugagccacugugcucggccaguugccacaucucuagcccacauugccacuggguugucauuugucuuucccuguagcaugugggcuuccugaaaguaggauaguucucugucuuguuaaucuaucuagcuuuagcacccagaacagugccuugcauauugugggggcucagucaauauuuguugcaucguaaauaguggguuugugaguuuuccauuucucaacuacaacucucugaagauuccaauaggagggagaaacaggguagucagagagauaauaaacaaaaucagccaacguugauaaauucagaguauggaggaccagguaggaugugucaucauaccuaagaacgcugccucugcuuaaaaauuauuguuagcucuagaaacaaugacauaucuauuuguguagcccuuugcaguaaacacauauacauuaauucauuagauuccccuaaaagauucuauuaaaaugguguuuaacuuuuuagugcugauaauguaagaucuucuuuguaggauugccucuauuuuguuguuguuguugaaggccagggaggguauuguaaguguuggaugauguuuagaacauaccugugacauuggggcuguuacuacugagcguccauguugccauuuggauuuucucucuuuuuuuaaaaauauuauuuaagaaaagauaucugucugucucccaggcuggagugcaguggugugaacacugcucacuguagcgccaaccuccugggcucaagcaaucuucucaccucagccucuugaguaggugggaccacagacacaugccaccacacccaucuaacuuuaauauuuuuuauaaaggcaggaucucaccacguugcccaggcuggucucaaacuccuggacucgaacaauccucccaccucagccuccuaaaguguuggaauuacaggugugagucacaaugccuggucucauaguuuuuauucugauaguuuaugcuguuauucaugacuccuucuucuaaccuucccuggcugguguuacuuauguagaaaaggaagacaggucuuguuaguugccuucaggaagacuaaaaaucuuguucgggagagagaaaccaugaaaugaaacuaauuuauuggccuugaagaagugucaacaacauuuaagucaagagcaggagaauggugcuggggaacaaauuuaaauugguuuuuuaucuuguaaaaaauauuaauuuugaauaaugggaaggaaugguaggcagaacucuauagucccuaagauuuucauaucaugguauauuuacaucuguuuaucuaaacuaacauuaauguaggugcugcucugaaaauauuuuugcaaauauaauuaaagcccuagccaggcaugguggcucacgccuguaaucccagcacuuugggaggcugaguugagcagaucacuugaggucaggaguucaagaccuggccaacauggugaaaccccgucuccaccaaaaauauuuuuaaaaaauuaacugggugugguggcgcaccccuguaaucucagguacucgggaggcugaggcaggagaaucacuugaacccaggaggcaggggcugcagugagccgagauugugccacugcacuccagccugggugacacagcaagacuccgucucaaaaaaaaaaguaauaauaauuaaagcccuaaauaguuggccuuaaaauagggagauuaucuuagguggaacuaccauaaucuggugagcccuuaaaaggggcuagacacuuuuuuuccagcuaaagagucaguccaugaggaagcaucuucuuugauggcuuugacgauugggggaagggagcguaggcaaggacgcaaguguccugugguagcugugagugacccugacugaugggcaggaaggaaacagauaugucagucuuacacccgcaaggaacugaauucugccacaaacgugugcuccuaagaagaccuggggcucuagacaaggacguggccgacugacaccuugugagacacugagcagagaaagcagccacacuauguccccagacuugugaccuacagaacugugagcuaaaacauggguguuguuuuaaguugcuguguuuaugggaauuuauuacagcagcaauagaaaacuaaucauugagggaaaucucauucugacaaaaucuggaaaaaaaaucuaaacuguaaaaaaugaaauuuaguuuaguuucugaaagaaaguacuuuuucccucccucccuccuucucucccuccuuucuuucuuucugccugccuuuuuuuucagucuugcucugacacccaggcugaagugcuguggugugaucucagcccaccgcaaccuccgccucccagauucaagugauucucgugccucagccuucugaguagcugggauuauaggugccugccugccugccaccaagccuggcuaauuuuuuuuuuuuuaguagaacugggguuucgccauguuggccaggcuggucuugaacuccugaccucaagugaucugccugccuuggccucccaaagagggagggaucucccaugggauuacagccaugagccaccaugcccagcagaaaguacuuuuucaagaacaaaugaccaacauacaucaccaaugggaucaagcuccaugcugcuugccuugccccuuugagaccugguuaaaugaauagauaagaaguguuguaauuaguagaucaaguauuuauaaauuaguggguagcuccaaaguacuagaauagaccuaaaauaguucuugccaaauauuuaucuauucuuggaacaaccuuacucaugcauuauaauuugcuuagcaauccuuuguucauaggcagugcaaagauuaguuacagcccuccuacugucugaauuacuguacuuucugaauuaguagaguuggcauugauaaucuuaaaaauauaaacaguaaauaaagcauuuaaaaccccccaugcugcugacuucauauaaagagauaguuguuuuugaauauuuugauguccguacacauuuuucuacagaggcaguauuuaaauggguuuguauaaauaaguucucuuucuugaagcuugugcaaagcaucuuuacacaagaagcuuauaagcacagucaauaaauucaagaaaauggcccuuuugaaaggaagccacugaugcaucugugggcugacuucugcaugaaugacagcgcaguaauaagaaagcagacaacggcuuccuccgccaccacugcccugccgugcucacgcugcaugggggugcccucgcagcgggaguguguguuuguccugguggccggggacugcggcuuggccuuuuuguuuacaagagagaggacagcagccucugcccuccagcugcugugaaaacaguguuggaaaaccagagcgaaguuuccacugaagaacucacacuggaaaaaaaaaaaaaaaaaaaaaaaaaaaaaaaaaccaccaacacccgaacaaacaaaccuucccucauaaaagaccaucuggguuaaaguacagaccacugggucagaacccagaugguaaugagaauaguuguucuucugcaaacuuuccgagugggauuuccauauauuaaguuggaagagagcccaacguugaaaaacaggaaacuaacugaagggcuguuaguguaguuuguaaggaagauuuuagcagugggauuaauuguguauguuggauaaaggauccccaucacuggaggucuccuuccaagugaaaugggugcuccugcugauuugaauugggaggugacaguggcgauggcagauggguauggauuagagcaauauuuuggaggaagucucagcugggguuggggauagauugcauccugaggggugcaaaaggggaaaagagagggggaaggacgaggaugacucucaggucauuucuuuccucucuuauccuuuguucuuuucucauauuaucacucaggcaaaaugggaaugggcaugugagaugcuuugauuagucagugccagcauccagcaauguggaauucucuguggggcaucuugaagccucuggguguugauguggagugcugacccucucugaauuaguaacacacuucuagcuaucuuagacaggaaaccacagucauuacaccauggagaucucuucauuauagcuuugcuaccuuguccauggucacauuaaugacuccugucccaguucaucauugauaacaccuacaguaacccauggugcucugggagaaauauugggggagcagacauaugaacaaaacaauuuguuuaagugguaauuuauuuucuagcuuuucucugucacucacuaaagguacaaugguccaaauaaaugcugucuuguauggauauuuccccuggcauucuguucuauugcagugcuuuggaaagacgaagagucauucuacccauucaaggguagagauuaggggccaaaauguagaacauuuuguuguggagauuacgcaucuaggauaaaugguguuuugcccggucuaguuacuaaaauguggaggggaacugacuuuuucauguucguguuacccuuuucuuuuguaacugucuaccaugauacuccugguugcuccacugucuagauuuuuuuuuuuucauuuuugauguuucguuuugaguuagguaucugaguuccagaacuuuugcuacuugaucacccucugccaaacaaucauuaaaauaugcuccuguaaucaguaaugaagacagacauaaguaauggauaaggaucuuuuuuuguuuuguuuuuuuguuuguuuguuuguuuguuuguuuuugagacagagucuugcucugucgccgaggcuggagugcaauggugcaaucucggcucagugcaaccucugccuccuggguucaagcaauucuucugccucagccucccgaguagcugggacuacaggugcacccccccagugcccggccaauuuuuguguuuuuaguagagaugggauuucaccauauuggccaggcuggucucaaacuccugaccucaugaucugucugccucggccucuugaagugcuaggauuacaggcaugagccaccgugccuggccgagcauuugcuuuuuaacucaacauaguaacaucuucuucuuggggccauggccuggaaacugauggugggacaggcaugucacuuggagucauuucuagggguccacucugaggucugcugguuuccagcucuggccuucuguuucuucauguuuaacauaauaacaauacccauccuaccuccauuacaaggucagagggaaaauuuaacaugaguuggcauuaucagugugguacagcacacugucgccacagguaguuguuaacuuuauuucuggacuauucugagagugaacggggauaccccaaaccaaagcuagccuuuguggagucuauguucuggugauaaucacugcuuucaaacaaguaccauuaggucaaaacuaaaagcgugagucacgcagcugugauacauuuguaaagaaaccuuucugggcuuuccugggaauuuuuaguuuauuauuccuauauaggucauccagagaaggacaucucuucccuacuccaccucauaauccucaaacagaaauaugacccagucuuuuuuuuuucauuaauuuagauaaguuaugaauuuuagggagaaaaguucagauaagaaguacuuuuacauaguugaaugugaccucuggauuccaaagagaugaugugcuuacuggcugaagaaagccugcagauggaggauggggagaaagucaugaacuuauuacucaguuucuauuuuguaaccacuuggaauaaauauuuguguaaaauaugagcguaacaaugugguuuuaguuaaagccagaaugugguuguucagaaauaacugagcaaaaguuugccagacauucacauuucacugggcacccuuuauugcuguauacuaauucuggccaccuuacccaggaagcaggguauaugacauuuccauuuauugcaugccaccuacaccuuucaucagcaaagggacaccuguacauccuggggacagagcagauagaagacaugcauuccauugccuucuuucaaauagauacuuuucaaaagauuuuagacccugaguuaagacaaccucacucuuaauuauuguggucaggaauucuuuucuuugaaaugaaaccugcauuagcacuguguguuuccuuauuuacauuuuuguuaaauuucuggacaauacguagcuccccuuagggacuuucuaaguuugguggagaaagaaacccuaguggcuaacuucacuguuuaguccuuaaauuuaaauucuuuauuauguacccaccaggccacuggucauggguaguggguauggagacauuuauguggaucucacucugucucaucugacccuccauggauuagauagccaggccaggcaaugauuaggaggaccccacaacccaacugagggacaccccagcauuuucuuucaugcaaggauuaauuugcccugucuagugucuauauuauucuccccuuuuauguauguucuuuguauccagcugacauauuuaaaauugcuuguggucuacugugagccccacaucaucuuuaccucuaaaaucauuaacucauucuaacuucauuucacaucugacaacuucuuuuccuacuaacacuuuauuuuccuacuuugugauauaccugaugucucugcugagugggcccuuggauauauggucuuuuuuuuuuuuuuuuauuuugagacagagucuugcucuauugcccaggcugguaugcaguggcacaaucacggcucgcuguagccuccgcguccuggguucaagcgauucuccugccucagccucccaaguagcugggauuacaggcauccgccaccacgcucagcuaauuuuucuauuuuuaguagagacaggguuucaccauguuagccaggcuggucucaaacuccugaccucaggugauccacccaccucggccucccaaagugcugggauuauaggugcaagcuaucaugcccggccagauauauggucaucuuuuuaaaaaaaaucaggauuaaguguccucauauaagccuuaacauauuauguaguaacugauucccugaaugaucaguuccaaagauuuugcuacugugccccaggaagcaaacauuaaaaccucaguauucagggccccucuccuuucaggggucaaacuugggauaccaacgcccugacaucaucuuuuuugcauagcuacucagcuuauccaaaagggucucuaccccucucucccuaaccccaccaggauugcucauuaacuacuucuucaccuccaagccccucugcuacuauuuuaggauuaaaucuucuaugagacugagauaucuaaacauauuuauuuaaaauuucauuaaaguauaagcuuacauaaaaugccaacucuuaaaugugcaaccguaugaauuuuuguguaugucuauacccauguaauuaccaccagguucauucaaaauauagaauauuucuagcacccaauaauaccccucaugcauucucucagucaguaauuucuuuugcauguuuuuugauuucauacacauggaacccuacuguauacagucuuuugucuguaacuucuguaacuugccauuaugucugugaggauccaugagguugugguuaucuguggcuuauucuuugcucuugcuagcaguauucguuuuaugaauaugccagaguguguuuacacguucuacugugggugaacauuaugcgugucuccaguuugggacuauuuaugaauaaaguuucuaugaacauucucauauguauguauuuugauggaaacaaacacuuauuucuguuggcuauauagccucaaaggaauugcugggcgguaggcuauuugugugguauuuuuaaugcaagauaauagauuuacauacugagaauugugcuucauaguaagcuuuucuggguguauuuuucauugauagagaaauagcucuaauaugggccuaaauagcucauguguacauuugcuuaaguucuuuauucugagauaaaugauuucuuuaaguuaccaaugucauuuugaagacuaauucaguuauguuuucuuguuaaaguccuggcucacuuccguagcucauguuacuguuuuguguauuagccuucuuucucuaccagcauuuagauuauuguugaaaaacuaauauaagcgucgagggucaacacuaucacaaucuuucuuguaaaauuacuccuggguugacauugaacugcagaugacaaguaugucagaucaugugagguaaaacuacagagcaaggagguuaauuuuucaaauggauuuauuugagcaacaagcauuucugaagcacuguaugaagccauugcucugucaaguaaaguaaaauauagccauuauuuucaaguagcugacaguuugguggugggggcagaaaaugaaaaccauuguuugcaauguccuuuaagcaagcauugccccgcauguuagaggggaggaagggagugggggguggugaugagagagcaugaaugagggcaucagaaucagauuggagauucagagaaggcuuccuagaaacauauauuuugauggaagaaaacaaauuagauauuuggggagauagagugagggugagggcuuugcacuguaggggaagggaccaaauagcauauuuaaaggaauggaggcaugaaauagcauuauccaucuaguagucaauuuaggggauaaaacauuuuuuauuccauugaugguguuauugccauauacauuucuggaaugccucuuuuggaaugacuuuuagagcuaauuuucaaaccacaccagaaaaucacucuugauacuuuauagcuuugacccaaaugguauuucccagcuggacgcucaccagauuugucuccuaaacacuuuuggcucauuccaaagaaauacaaucugucuucagaagguuuaaggcuuaccacuauugagaacauucaaaagccugugugugucccagaacucagaaaucaauuccaaaaggccacuugugugcaaaaagcacuuaucguuggaauaagucuguaaccuccuaacgugaaaguacagguucccaaagacuuggcuuucaaccaagguuuuauuuuagaaauuuuaugucaaaauuggaucauuuuauauggugggagccaggggaaagagaugguggggagugagugggugugcuuuauacuaagcccagugcuuuucauuaguugucuuaggauaugauaauuaacucuggguuugguuaaacuggcucauagaucauggaaacaaggguuaucugagagguggcaacaaaagccaaauccagguagugagggcugggugugguggcucaugccuguaaucccaauacuuugggaggccaagacaggugaaucacuugaggccagggguuccagaccagccugggcaacacaaugaaacccugucucuauaaaaaauacaaaaauuagcugggcauggugacaugggcuguggucccagcuacuuaggaggcugagaugggaggauugauugagcuggagaggucaaggcugcagugagcugugaucucaccacugcacccuagccugggcaacagagcaagauccugucucagacaaacaaaaauuccagguggugagaaucuguggugucagccuguuuugaccucacuguaaagcagcuuugugaagccauggagcagaugaggaagcauggaggagauacuacagcagggaagagggcuugggaaggcaggagggggaucccagagagucgggaaaccugggacagcucagacaacaaucaguuaauucuuuugccuucaguuguauauuuugaauugaucucuucuuaguucauccacuacuaugacuuuuaaacgauaauaaccugaaagcucuucuauaaucugcuaagaucaguauagagcuuaucuguuauguuucauauauuuaauuaaucaaaccuaguuauuuuugaagaugagaauaguuuugugacccaccugggugggaggggaugagaagaauuauaaccuuuuuaccuuaaaacuuuccugauaaggcacuaaaccacugggcuggucuacacugguccaaaagacauuuauuuccuuccuuccuuccuuccuuccuuccuuccuuccuuccuuccuuccuuccuuccuugcuuucugccuuucuucccuccuuuccuuuucuuuccuuuccuuccuuuccuuuccuuuccuuuccuuuccuuuccuuuccuuuccuuuccuuuccuuuccuuuccuuuccuuuccuuuccuuuccuuucucuuuucuuuucuuucaucucuucuuuucuuuugagauagggucuugcucugucacucaggcuggagugcaguggcgugauuacggcuuagugcagucuugaccuacugggcucaagcaaucuuccaugcucagucuccugaguagcuaggacuacaggcagacaccaccaugcccaggaaauguuuaaauuauuuuggagucagggacucauuauguugcccagacugaucuugaacuccuaggcucaugcaguccucccacuucagccucccaaagugacuuuuuaaaaaagauguagaggcccuguguuaaacuagugugcuuuuaauuugcacuaguauagcuguuaauuugcacauagccaucaauaccuuuggggauggagauccugaaguuugccagaguuuucaucuguuuguucacacagauuauauauucccauacaacacugguuagaaccacacugaggaucaaccaaugcccucaaaccaagaggguuuccacuagcaguuacaguggaaaaggagggacuuacugcaauucccacucuccugucauuuugucuuguaucacgugcuaccaucaguuuauuguuucaugaggaugcccacauugaaucaaggagggguauccagagagauuucacuuccacacagaaacaccagcacuuaauuucucacagaaucaaauauuuuacaaugguucuaaaauacuacaugguuuguguuugaaaauuaucauucaggcuuaagguaaggucaacaugugucuguucuugguuuucugagccuuucuuugguuucuagugaaacauauugauacgguuuggcaguguccccaccgaaaucucaucugaauuuuaguucccauaauccccaugugucaugggagggaucuggugggagguaauugaaucauagggguaguuaccuucaugcuguuaucaugauagugagugaguucucaugagaucugaugguuuuauaaggggcuuuugccccucuucacucugcacuucuuaccaccaccaugugagaaggaccuguuugcuucccuuuccgccaugauuuuaaguuuccugaggccuccccagcuacgccgaacugugagucaauuaaacccuuucccuucguaaauuacccaucuuuauuagcagugugagaacagacuaauacacguaucaaaacuaucaaaagaaagcaauugguauucgauuuugcauuugccaccauaguaugugugcgugaguguuugcauuuuuuucccacugggauggaaaaaggcacuuagaggauaaugaaguugcucuccugacaccucuucaccucuuuuaccauuugagcaagagugguuucauauacuguugucuagcaauugaccuuuccugugucuaucuaucacuuaacuaauuuuauuugugcccagcacccuugccacaaauuugcuuuucaaguagaaaacaguaaauauaccuccacgauauuuauugcccugaaaaaugcauaggcaaaagucauaaaauuuugcaugcuacacaguggauccuuugacugcacucuggaaauccugaagccuauucuggucccaauuccauuucauuuuucuguuuuucauuuuucuuuuuuuucuuucuuucuuuuuuuuuuuuuuguuggaguuuugcucuuguugcccgggcuggacugcaauggcacaaucucggcucaccgcaaccucagccucccagguucaagcgauucucuugccuuagccuccugaguagcugggauuagaggcaugcgccaccacgcucggcuaauuuuguauuuuuagaagaaacaggguuucuccauguuggucaggcuggucucgaacuccagaccucaggugacccacccaccuuggccucccaaagugcugggauuacaggcgugagccaccgcacccggucuucuguguuauuaacagcacuuuuggugaucuugaaugcauuggcauauaacuaaaaaauuuccuuuuggaaaaaugucaagaaaggggauaccauuugcaaagaguucaacccagaugaugauuaagcaucuauaauuuacgugaccacaauuaauucauggaguggguuuuuugguggagagcaggggugcugagcauucuuuagcccuucaucgccaauauuaauuugaauggcuucuguaccuccuuguaauugaauuauuaauaaucacaaagagcuuauaaacuucgaauuuaaucuucauuaauauauaaagcucaaagaguaaugucuuuugaccaugaguagacugcuucucuaauuuaucuucaaaguugcuuuuuuuucuuccuguaaguuucuguaguccccuugacuccuaaaagugagugucauggaguggcuuugaucagggaacauacaucaguaacuguuuugugaccuuagucccggcuguguuuuauggcuuggccaaaguuuaucauauaauuuccacuuuaggaauuugcccacuuacuaaggcuuugagggcaggggaggugaaguaguauugugggagaggaguaauaaauguguuuucuuuucaguuucuacagugaguggucuguuuugaaaugagugcaggugguugcaguccacucccuccccaaacaggacaaauuaagaucauuuugcucuuucgggaagcugagggcaagccugcacaggugaggucacgagaggcaagcuaugugcacaccugguguccucgugcuucuugggcaggccagcuccaugcagugcagugccccugaagggaauggggccaggagaagacauaacagggcaugaggaucuucucugugccaagaaucaugcuagguaaccccccugagauuucucauccucuugagaauccugugagaugauccugcugcccuuauuuuuccagauggaaaaacggauuacccaggauucaccgcuugugaguggcagaaaguggcagcauuagaacugcugcacuccauggauacauccagcacaugugcucuccucuagugugugauuccgguucauuuaagucagauuuuggauuccacucaaugaaguuuguaacugcuaaguugugaugugagcacuuagaucaccaagaauuucaacuaacccacuaugcucaaagugugguccauggaccaaguaccuuggaaucccuugaaagccccuguugaaaauucagauuccuggccgggcaugguggcucacgccuguaaucccagcauuuugggaggcugaggcaggcagaucacaaggucaggaguuugagaccagccugaccaauaugaugaaaccccaucucuacuaaaaauaccaaaaaaaauuagccaggcauggugguacacaccuguaaucccaacuaaucaagaggcugaggcaggagaaucacuuaaaccugggaggcggaguugcagugagcugagaucacgccacugcacuccagccugugugacagagugagacuccgugucaaaaaaaaaaaaaaaaauguagauuccugagcccugccucaaaccaauuaggucagaaguucuggggguacagcccagguguagguucucugggagagucugucaugcacuaaaauuugagagucaugccauaaaaccucuuuauagugcuccaguauaaaaaagaucuugggguuaagcuuagcuaaacaaauacgucugcaggcuggcaguucaugaauuccaccuaaagacuaucugguuuaucccucauuuuacacaaaaggaaacugugguuuagaggguugaaguaacauguuaaaauucucauggcuuuuuugugguagagcagacacuagaaucaguucuccuuccuccgguccauagcuggcugcuucuaaucuuuuaaaaaucagcuaaucaagguaacuuggauccauuucaauccugucagugacccuacguucaauauaaaagaugaguccugggagaacugccguucugauucacauucaucugaauguugaaaaagugcauuucuucagagugcucuguaggagguggaaauauucaauaagcuugcgagaaagguuuccaucucaaccacaccaugugugcaugugcaugcacauacacgcgugcgcgcgcacacacacacaccacugccaccaccacauagcucagaucugucacaacaugagggaggggacucgcaaacaugcauaauuuaugcaggauuuucacggauuuuucaguauuuggaagugauuucuuaaauuauacauugaaacagcuccauaaagaugaagcuggaguuaguuucacaauagccuuaaaagugagagaauuugcgucucugggaucaaugugcauauuucaaagugagacguuucacuuuauagaauuuagagggucucaaggcugugguugacauuuuuaguuuguugggcuaaacaaccauuugcuauacaauacuauggaaacgaaugguggaagagauugcccuggaaaacucuguucaauuccguuaagaaauauuaaauuccugaggacaaucuacuuguuuauuauuuucaauuucucuuaaaauaguauaaaaggaucuucuuggguggcaguacagggaugacaaggaagggaccaaaucucaguuguucacauuuuuacuuaguuuggauuccaaauaauggggcuucucauaaaagauuuggacccugccccgaggcuuuugguaauaaauguggccgcuuuguuuuuuucccuaauuauuucauucguaaaagucuuaucuucccaauaaagaugguaacuccucuggacugggucugcuuuucgcauuuuccuucuuuuauauaccaccaugguauagaacuuauuuuugcuuaauaaacaguuuggacaucaggaagagacagagcuguauacaauagguaguuuacagucaaauauuuacugcuuuaaauaaggcagaauuggcugggcacaguggcucacgccuguaaucccagcacuuugggaggccgaggcgggcggaucacaaggucaggagaucgagaccauccuggcuaaccuggugaaaccccgucucuacuaaaaauacaaaaaauuagccgggcgucguggugggcgccuauagucccagcuacucgggaggcugaggcaggagaauggcgugaacccgggagguggagcuugcagugagccgagaucaagccacugcacuccagccugggugacagagugagacuccgucucaaaaaaaaaaaaaaaaaaaaaaaaaaaaaaaaaauaaauaaauaaauaaauaaauaaauaaggcagaauaaguaguauuuaauuagagcacagacuuugugguaaggcaggccugaguuugaaccucagcugugauacuuauugccucauuugaaaaaaguaaauuuuggccaggcauggugacucacaccuauaaucccagaacuuuaggaggccaaggaaggaggauugcuugagcccaggaguucaagaccacccugugcaacacaacgagaccuuuaaaauuucaaaaaacuacuaaaaauuucaaaauaauuagcugggcacgguguugugugccuguagucacagcuacuggggagguuggggugggaggaucgcuugggcccccgagauggaggccacagucagcuaugaucaugccccugcauuccagucugagugacagacccugucucaaauaaaaaaauuuuaaaaaguaaauuuuauuguuuauauuuaaggcauacaacaugauguuaagagauacauguauauguagauaguaaaaugguugauagugaagcaaguuaacaugucuaucaucuugcauggcuacccauuuuuuuguauguguggcaagagcagcuaaaaucuauucauuuagcagaaauauggaauacaauacuauuaacuauaguccucauguacaucagaucuuuagacucguuuguuuuacguaucugccacuuuguucuuacacacuugugugaucuugggcaaguggcuucauuaccucuccaccuuuagauuucuguucugugaguuaaaaguaacucucagcacuguuguagcagaauccaugaguaagcacucaauaaguggcaagugcaaucauuauuagcaacaaccguaauaauagccauaguuccauuauuaaaggggaugauugcccuuguuauccaagugcucaucucauuugacuuugggccuuuggaauuaauaaagcaggcuuaguuccuggguuugguuuuccuuuuucccccaaaguuuguuuuguuuaguucaaaccauauuuuauguuuccauuuauaaacacauucucucaagugcugaacuuuuaagcauggaagucugaagauaccuccucuugugaagggaaauuuaaaaaauauuuaaugacugcuuuuuaaguuuuuggucugaggaaagagcagcauuaccuuggucauugacuaaaauaaagacauaauaaagguacuggaaacugaacagaaguauggaguuugugagugaagaguuggucacacagacagcucuccuuccucagacauucaggugcauucuggguaaguugacugauuucaaaaugcucaccuucaagugccaggcacaaaauuauaaugagcuuccuuucucauaauucuucuuuucaugauuuucucagcuggauucuucaaaggauuauuuguaaagaccuuuaugguguguuaugauuuaaucagauguagcccgaauuucccaagauguguuaauuaucauugccacacaagugcaacagaggaagcaaaauguuuuucauuugggcagguugaggguuuguuuaaaacguacuuagggccauuaggaucacaucaaaauauagugcaugguaauuaugcaugaaauagaagguuaccugcuguuuaaguagcuaguuucuugauaauguugcaauaaaguauugagagaaaauugguuucucaauagcaguggaacaccuuguuuaagggacaaagugaacugcauuaggcugaaaaacgaaaagggggaaaauaaaaauagauuuuaucaucaaaguugucaguggauauuguucucagucuuaaagaauuauuuuuagucuuucccuucaucaaaauggagaauuauuuguuugcauguagauugugguagaguugguauguuucagauuuaaugaaaugcagaacagaauaaaucccucgggaaagaaaggaaagaggggauacgccagacuuaguauaugagaguagucaaaagccuggcuuuaaaagucaaagaaaccccaaaguugacaccuggucccuaugcuaacuagcugugugaccuccuccauguuacuuaaccuuuccgaccucccaguuucuuuaguagcaaaauggagauguuauuauuaauauaacagaccuuguugaaaagaugaaaugagacauuguauguaaagcacuuuaggaggacaugucugucacauggcugugcuaaauuagauguuauuauccugucaacaggcugaauagcaagggggaaaaguucuaaacuuuggaauccugucguaauacacacagagaucucauuccuugugaaagaauccucguuuuggaaugggaugcugccuuggggaacugccaugacaaggauaugaaguuacaacugugauggugguccuuugaagaauauguggagacuuuucucuauauuggauuauuauauuuuuacuuuugggaaauaauuacacuuugaaucguuucaugauuauuuggcuaacaaaacaggugauuucugugaguauauauauguauaugugcguguguauauauguguguguguguguguguauaugcauguauguguuuauuuauuuauuuuaccauggacaugcccuugaugaaaaagaaauacuuugcuugguuauuccuccaaguggaaauuuggacauuacccuuuguucaugguggggaagauuuuuaguuauuccacauaucagaauuaucuacgugaauaguuagcacauaauuaggauuaaaaaguaacuaguugcagaaaacucauuauuuuuucuaauucuaagaaaguagcuucauuuuggguauuagagaaaagcucaagagauucacugauuaauauguauugagccuguuacauagcugacaaugugcuaguguuuucacaguuucuaucuaacuuacaaaauaacugaaagaggaagaaaaauauucuauuccauauguauuagaaaacuauccuuuaaguucuaaaguuggcuuaugaucuccugaauugcacaauauuuaucugcaaaccuugaaacuauuuaaucagagacuucugaccccaaaaugccaacauuacucuugguggucuuucaagguaauucccccuuguuuuuaguguauccauugaaacacuaaauggaaauauuuagugcccugaugcuaagggaauauuccaacuagcggcacugauuccacuccagguuauuaauuaaacaguagcaaucagcccaucugaucuuuaauauucuauugcugcugacugaugcccagacaucagacauuuuguaaucuaauacaaaauugcucugugcuuaggacuaaagaaaaacaacacauaauuuauacuauguuuuaucuuuauuuucaaguuccagaggauacgcugguugugucuuucaaugauuaacuuaaaaaaacaaacaaaaaaacaagacacuacguaucucaagcccaacaugaaggguauugagaguaaauuauaguuaaaucauuuauuucugacuuuuucauuuuuauguauucauuuuuucaacaaauauuuauugaaugccuacugugugucaggagacauccuucuaggcaccugaacuuauaacagugaguaaaacaaagauuucuggcugagcgugguggcucaugccuguaaucauagcacuuugggaggccaaggcgggcagaucacccgaggucaggaguucaacaccagccuggccacuauagggaaacccugucucuacuaaaaauacaaaaauuagccaggcaugguggcacacgccuguaauccuagcuacucgggaggcugagacaggagaaucacuugaacccaggaggcagagguugcagugagcugagaucaugccacuacacuccagccgccugggccugucucaaaaaacaaaaaacaaacaaacaaacaaacaaacaaacaaacacacacacacacagacauaaaacccacaaaaauuucucuuucugugaaauucacauuccucccaaauggagguuguuggaaaauuuuaaggugcucuuuugacuccugugguuguacuuggaaagaagaauuaaaccagaagaggagauauucuacaaaucauauuugggugauuuaauuaaccucuguccacuauccucacuccccacuccuucacugcuaccaccaacaaauaucaugcuuacacacauaccuugaggggaggaggaagggaagacaaaucagaauuugcuguacaugcaguacucuagaagccaauguggaguugaccuaaggggauccuuauaaaaacuuagcagacaagaauuauaugcacuucauuggaauuccacuaauuccagauuucagaucagcugggaggguugucuagacugaagcuuuacauuguuaucuuuaaagauaauguaaauuaaaaggauggaggggaaauagguaaaguguauaaguaaacaaaugauacaaagcacuguaauuccccaaagcaguuucuuuggcaaugcacagugguuucuacuuaauacugcauauuuuauaguuuucacuaacuuuaaucaacauaaccauuuagccaaaauuauggugacuuucaucaaaugaaccucaugaugaaaggguugggaggggauguggguugcauguaauaaaaucuccauauauuuugcauaaacaaacacacacaucauccucuugggaauaaaauaguuagcaggagcauuuuuagagauaggguguuacucuuuugcuguugugccaaaccccaauuaaccucaauaggggccgggugcaguggcucaugccuguaauucaagcacuuugggagucagaggugggcagauuaccugaggucagaaguuugagaccagccuugccaacauggugaaaccccaucuccacuaaaaauacaaaaauuagccaggcguguggugucuuccuguaaucccagcuauuuaggaggcggaggcaagagaaucgcuugaacccgggagguggagguugcagugaguugagauccuggcacugcaguccagccugggugauugagugagacccugucucaaaaauaaaauaaaaaaaugaaaaaccaccaccaccaccacaacaaaacucgaauagagaaggcgccguguucaaaaggccaaagaagagacucagagccagcaaauaagacauggaguuuuauuaagggcuuaauacaggagagagaguccagugguggcuggcuggacaggagaaccaccuuauguacagaaaugguccaguggcagcuaguuggacaagguaaccacaggcucaguggcagcaagcuggucgggaaaaccacagcugccugcagacaucauguacuuuauauggcauuuaacuuaacaccugcccuaacgaccuccacugguaaccuucauuuaaccugaaacucaacaccucaauccccuauacagccuguguuccagggaacaggaagggaaggaacaagacuauuggaugggaugggaugggauggugggagagcagcucagauguuccucauagauaaggaaagacucuccagauuugucauguccaguuuccuaccuuggaacacacauucaggugcaucugcccuagagggucauucuaaggguaugcuuaaauuaaugcuaucagggguguguacccuacagucaccuaggcuggagugcagcagugcaauuacagcccacugcagccuugaacuccugggcucaagggauccuccugccucagccucuagauuagaugggacuacaggugugugccaccauuuuuucucuuuuuuuugggggugggggguguggggggauggagucuuuccccauucccuaggcuggagugcaguggcaugaucugggcucacuguaaccucugucucgcagccccaagcaauccuccugccucagccucccaaggagcugggauuacaggcaugcaccacaaagcccagcuaauuuuugcauuuuuaguagagaugggcguuucaccauguuggccaggcuggucucgaacuccugaccucaagugacugcuggcuuuggccuccaaaagugcugggauuacagguaugagccacugugcccagccauucuuggcuaauuuuuuuuuuuuuggagaugaggucuugcuguguugcccaggcuggucucaaaccccuggccucaaaaugcuaggauucuuccaccuuagcuucccagagugcuaggauuacaggugugaggcacagcaccaggcccccuuggcuaaauuugguuugccacacuuuacagaagcaacguaagcaguuucugcuuuucauagcauagauucauagaaagaagaguauuccaaauagauaaugguuuguuuacuauagccacuggguagucugaagcauauucuucuaccaggaagugguaguuuugccuaguaccuggugacugaggaagaaaucagugaccuaaacugacaaaugagccuacugagguggcauuguuuaaaugcacaaaucugaggcaguggaaagaaggaauugauugccuugcugguauuuuuuccccugcacugacccuucuuaauuaauacaugagguaccauuuacccaaacagauuuuucagcacucacuuauggaggacacuaaguggcgaguucauaguucaggcagagagcuggcagaucaagacuccuuucaacuaugagaucugugguucuaugcaaggcgaccaugaaaggaguuguuuagaccccguuuuucaggccagcagcaggagcucagcccgccauuaagaguuuguucugugugcauguuguaagcaccugaaguuucucuugaauguucucuuuagaaagauccaucguuagggugcaagagcaauucuuauuugcugcaagaauauuuauccuuaacagcauauagcugaaucucacuuuauauaugaauucuugaaauaagugcacguauguuucaugcuugcaaauugcauccaauuagaauagcuuauuuuaaaagcuguuuuagagaauucagaaguauagacucauaaaaugucaacuuauccccuaauauuccuuuugguacauuuagauuucuaggugcugguuuugcuuacauucacuauaaaucuuaauugcaaagcauauucaagccaaugaucaauaucaaagaaaacuauuuuuuuuauccuaaggcccauaugccagaaucccccugucccccaaucuuuaugcuucuuccucauaucugcuuccaaaucaagaaaugauuggaaucugggugcagucaccugcacccuguagucccagcuguucuggaggcugaggcaggaggaucacuccuugagcccaggaguucaaguucagacugggcaacauagcaagacuuugccuguuaaaaaaaaagaaagagagagaaagacagaagggagggaaggaaggaaggagggaaggagggaaggagggaaagaaaugcuuuggcuaagaaaaugcccugaaauuuggucaaaguuggaguuuccucaaugccaaaguaaacgaccauuugcccauuuacccucuacuucccacaaaagaguuuaugacucuugcgcagaguauugcaccuuguucuucuuuuuuugauacuagaaucaccaggauaaguguguaguguagaccaucucaggcauauuucauugcugucguguuuuuccccgcuauuauuugaaaaacaaaggauuucuuguagcucuucagugcacuaacacucacacaaauugccccaggcuucucauaaguaggaaguuccaaaauuaaaugucuaauuuugcugcuuaaacauccuuuguuggcuccguguccaggaugcucuuaucacuuccucaagauggccaccuuaggcagucgauucuguuagaaccaaauuguaauuaaacuauuuuaauuuuaugcacugauuacaacauuuuucucuuuauuaugcauggugaaaguuccucacuacacagauccagguacuuauaauuauguacaaaaguagugaaacuguuuucuaagcuguauucacuuaccugauuuguuucucuauccaaucucaguugaguuccucuaagacagggugauggugguggugaauuauuuguguuuggcuuagauaaauaaaaacuggaagaguccauuaagguuggagcuuuuuauaagcuuucaaagaaagcaaaguugagguggaguuaaaauguuggggaggauugcauuuagauuacauguacaaaauaguuucaaguuuuaccaugaaaagugcaaauugcacuaaauuugaagacaaauucacaacuuuguauauuuuauuggguaucuauuuuauuuaauuuauuuauuuauguauuuauuuuugagauggagucucgcucugucacccaggcuggagugcaguggcacaaucuuggcucacugcaaccucugcuucccagguucaagcgauucuccugccucagccucgugaguagcugggauuacaggugccugccaccacacccggcuaauuuuuguauuuuuacaaaagauggguuuucaccauguuggucaggcuggucucaauuccugaccuuaugaucugccugccuuggccucccaaagugcugggauuacaggcgugagcaaccaugaccggccuggguauuuauuaugugccaaucuguuguucuauauaacguucaugacaacucugugaagucacaaugaagcuuugaaaugauaaguaacuuuacuaucuuuuagagaaaguagaggcagaaguggauuaugaacuuaggcagccacccuccuuaacuuggguuccuagaugcugacaccgggcucaagugccugauucacugugguuugagcagcuguauuaugaagaaauauuacaaugcauuuaauaugagcuugggcuguguaaucacacaaacguguguccaauauaauuaucucccuuacugucugugaucuccaguguccucaucugugaacugaggagguuaaauaagauaaugcgaagugcuuauccagcaucugccucaagcaggugaucaugaugacagugguaaggacugugccgagaacugccucaguuacauuguccucuuccuuagugguaugcuucccaugguuauaauuugaagacgcuucuggccuucaaauauagugcuagcuagcaagggcacagaagaaugaaacagaguuguuugugggaaacaugaagcagaagcgagugauggacagaggugaggccaggggaacaggcuagagcuugaucagggccggccuugugugcuaggcuagagcuugaucagggccggccuugggugcuaggcaggagaguucugucuccugcgggaaaagcugccugucccuuggccagcuuucccuaaggcaugcagcuuucacaggcacuagccauucuuaagccauuuucucuuuccuucacuuugugcacaaccuguuggaauuucucagguccaaugugaugcuaauuggaggaaguguggaguuggaccuccuaggaguucaaacaagggccccuuagugauugcaguuagaaccuggacuguuuggucaagggaaguaacuaggaucagugcagaaaaacccaaccuauugcuuguucucaguagccucagaaaggagauuuugcauguggaguaaaaugggaauguuuaguaggggagccagagaugguaagugcaagaauugugagagaaauggcauauuuaggaaagaaaaaaaggccuugaaucuguuuucaauggaauaauuuaacuuuaguaaauuacauacuuuugcuuaggcuaguugaaaagaaugcucuaguucuaugugcagguaguaaaauuagugccuuucgguacauaguaaaugcucaauaaauauuuaauagacuugauuauuguguuucucugauauuaaauuuuuagacucuaguucacuauuaucauugcuuuaauuuggaaagcaauuaagcaaccaaauuauaguagaaugauuuaaauagaaagauuauuuuuaguuuagaugugauucagauaaauauuuugaugaccuagucuuguuuucauuucuauguggauucagugucaauguuucuucauuauccaauuguuuuugguguuggaggggagaagugacacauuuaauucaaaugugagacaagacacauguuuggcucuuucgggaagucaaggucauuuuagaagguuuagggucauauaugggaagugugaugauguagcucuauagauuucauuuucuaggcucuauccauacauucuguuucuauuucuccugugaaccuucaacaucuggaugcuuuccuaugagaugaauguuguucacaaagaaauuuaugcuugagaaaaguccugaggcauucuucccuacuuuauguuagucuccauuuaaauaaguuucuaaaccuuugaagagaaagugcacuuauuaaaaaaaaaaagacuugguaacaggaacucuugagguggguauucaguuuguuaaaggcauuaaauacuguucucuucccuccuuuuccaaaauaaccauuagguuccaccuuuaccagucucauuaacucuguuuuaagaaugagcugauuguuugaguugguuaagauaagaucaccucaacaucuguuggugauaacuuuaucucaaguguaucuuuaaggaaguccauuucaacugaaacauaguuaaguaucuugaacugcacagauaugcuuucaacuuugagcuggaauuagcauuuuuaucuucuuugggaacuggacacagagaaggaaaagaauaaacuuuguuuacuccuuccagcccaaacccuccauuaaaaauuuuucuuaaaguacaaaacguuugaaugccccaugaaaacaucucaaaugauugugcuggguguguaagcaaggcaggguuuuacuguuuuaaaaacgcacuugggggaaccuugaggaguuugccuuuuuauaaaccccucugaucuucuaugugaggaaacggagguccagugagugaaagugauuacuucugggcagagccaggcccgugccaagggcuuccuguuucagugucugucucccguuggggcucccuccguaagaccugcagccuguuuauuccgggccgagaggccagggggaagggccauuaugaacucacugccauucagggaguuauuggaugcuuauuagaggccccagcaucucuuuagaggcauuaauuuaguagcacuguuucgcugguugcauaguuugcaacuuagucaaaaguaaugaauuuaaccaauccucagcuuucaucuuguuuuagcagucuuccaaaaauaucagcaauaagggggugauguaaaaaacucuuaaaacacacacaugagaucuucugcuuuuaauauuugcugugguuucucugcacuuuugaggcucuuccccucguuguguguguaacucuuggugacucuuaacacagugcugucgccaagacacaaagcaaagagaacgugccaugaacugcuuccccggaacuaucagaugguuccaguuaagaaggaaauuaugacucuguuguuacagccugggaaaagugaaacaacauguuucaaacuugccacuucauggucacgggauugaauugggcagaacauuuuccaggccccagcugguagugccuccuucacggaggcggguaucuugugcccacucugguguauuugcacucccagaaccuccuucuuucucucuccucuucccccaucaggaauauaugcucaugguuaaggaaaccuagcuuggauuuccuuggaauauauguccauuuaauuuauaauuuuaaggcuggaugcaguggcucaugccuguaaucucagcaguuugggaagucaaggcagccggaucaccugaggucaggaguuugagaggagccuggcucauguggugaaaccuugucucuacuaaaaauacaaaaaaaaauuagccagguauggugaugcgugccuguagucccagcuauuugggaggcugaggcaggagaauugcuugaacaccagagguggagguuccaaugagucgagaucauaccacuccagccugggcgacagagugagacugucucaaaaauuuuuuuuuuuagaguuuaagaugagaaagcaaagggaaccuuuuccucuauguugaaauacuuccuuggaaucauuugguagauucucauagaaugguagucagagucuuccaccaguagucaggaaauucaaguuucacauccuuuuuauaaaccccucugaucuucuaggugaggaaacugagguccagugaguggaagugauuacuucugggcagagccaggcccgugccaagggccuccuguuucagcgucugggauccccgacuuguuuuuuuuuuuuugcuguuaaaaaaaaauccguaguuaucacuuucacuccuuuuccuguguguguuguugucauucauuaauaaugcuuaaaauagauggcagaggcucagauuaucuguaaacagcaaauacucuaaaaucauuuugauuuuuaaaucugcugcugcuuuucucauuauguuaauguuccaucuuuuugaguauuguuuauuguaauguaagaaccagucaugccugggguacacucaagcuggauccuugccauaagggcaggcuggggugaauggugguacacucuugguaaaugugacaugauaagaaauauauauuugggccaggcacauuguccugcaccuguaaucacagaacuuggggaggcuaaggcaggcaaauugcuucaggccaggaguuagagaccagccuggccaacauggugaaaaccuccucucaacuaaaaauacgaagauuagcugggcgugguggcuccugcccguagucccagcuacucgggagguugaggcaugagaaucgcuugaacccgggagguggagguugcagugagcugagaucacaccacugcuuuccagccugggcaacagagugagacucugucucaaaaauuuggucucugccccuugacacccaacugcuaaaacccuuguaauuuccugagugauagaggugauaagaaugucuuccacagaauucccaaaucccuuggaauuuccugggugauaaaccuuuuguucuaaugaggugauucuuaguggguuccuggauagcuucaaaguggugaugucaucagaaagacuaaacugucauuagaagcuuggaacuucuaacccacccuaccccuauucuccagggaggagagaggggcuggaaauuguuuaauuaucuaucaugccuaugugaugaaacccccucaaaauuucuaaacuaugagguuuggagagccuccagguugauaaccauauccacaugccgggaggauggugcaccccgacuccauggggauagaagccucuguguuugggacuuuucuggacaucacacaguguaccucuucaucuggcuguucauguguauccauuauguccuuuuuaauaaaucaguaauaguaagcuguuuucuugaguucugugaccccuucuagcaaacgauugaacuugaggagggagucaugagauccccugacuuguaggcaguuggugagaaguauaggagacccagacuugugauuggcauuugaagugagggauaaucuuguggcucugagccccuaaccuguggugucugcauuaacucuggguaauuacugucagaauugaauucaaucauuagauaucaaguagguuuccaggaaguuggagaacuuguuguuggugugaggggaagaaacccauaaguuuggugucagagcauugccaguagagaaacaggucccccccacauaugaguuggaugguguuaugcucuugguagggcauuuguuuugaauaauucacagaugcagaguguuugcagaaccguaaugggguuuugaauuauauccuuguauaggugggauuacaaauaagacuccaaauauaggcugguuugaaccucaguuguauucauuguuuguaucauuuagcaaggacauauauaaucuaaauaacaacgaauagagugggaggggagcuucagaguuggcucaguccauggcucagucauaucccuagaguuuuagacacuuuaccuuucuucacuuugccaucucagcaugccaguuugggucacaaauggacaucuuaugggggcaagacagcuguagacaucacaucagaguaugacaacuucuagucuccuccuugggucuccucuuaggagcaagagacuuuccuggaacccguuaguggacuuccucucugcuucucuguuuaaaucauucacuggcagaauagcaguacccuggauagcuagggcagucaggagccauccccugaggggcagucagagcugggcuuccauuagucgcgggucaagcaaacagccccugggaagagaggagauacacaggagagauucuucuagaaaggaagaacaagaccagaaauggauuacugcagccuguuuccuuaguuguaagguggagauaauaauagcacuuaauaagauuauugugagaaccggaugaguuaauacauauaaagcaugcaagacagugccaggcacauaauaaucuuucgguaaauaacaguuuuuuuauuuuuauuuuuauuuuuucuguuguuguugagguggagucuugcucugucccccaggcuggagugcaguggugcgaucuuggcucacugcaaccuccgccacccggguucaugugauucuccugccucagccucccgaguagcugggacuacaggagaguuuauuuguuaauacauuguauguauuauuauuaugacaauauugaaggcaucauaauauauugguuuuauaagaaauguuaaagaaugggagaggugauaaaacaguugcagggaugacccaacuacauggcugcauaacacacucuaaucugaaaugggagcagaggcaucauucacucucaguaauuuggcgcugguuguuuggcacauugagucauaagcauuugagucuuccacgguggcacugucaccauacaugugacccacagauuagauacgagauagguggaguggagaaagcagaguagcugagagaguacuugaugaggcuguuugcuucauuggggcucacagugcuaagaaaaaccauuugcagaaucaugggagcagaaugaucauuucuccuauaaucuggggucccagccuuuaggauguaucccuauucaauguaaaacacuagguuuuauucagugaauggcagucuagcaugguuaugcuagcugaauggucuuauagggaaagauuauagcagauauauguauauauauguauaucuaucuaucuaacuauauaucucuauauaauugguauaguuggcuaagugacagcugaggagccagcuggaucagaguucaaaauaaggugacagucuacaaaucccuggaagacuggagcaacaaaagagggaaucguuauuuggacacaguggggaaagugaaugaaaagaagaaaggcaaauuaauuaagauaauuaaaacacagacauucuuggcaauauugaaagcuauuuaauauuuggcuuucuaacucuacuauucagucauuuacaaaauauggcuuauaauaugucaauugaugaauaaccuuuauuuuacuauaaaauucaugaacuucuuuggucuacacaaauccaucuuccauuuuccauggcuuaccucauuuaagccaaugcaaaacugaaaguggggaaaagaauauugaggcuuuauuaugaaaugccuucucauccacuuuuuuuuuuuucagucucccuguguugcucaggcuggagugcauuggcaugaucuuggcucacuguaaccuccgccuccugguucaagcgauucuugugccucagccucccaagugacugggauuacaggcaugaacuacuacacccagcuaauuuuuguguuuuuaguagagacgggauuucaucauguuggccaagcuguacucuugaccucaagugaucugcccaccuuggccucccaaagugcugggauuacaggugugagacacugcgccuggugucucaccauauuuuuugaggguugauuauauuuuccuucuaaacauagauuccuuaaaugacugucauucucaucuuccuuuuucugcuguuuagcaggcuaccuggaaggcaguacuacucuguaaauguuugccgaauaguuuuugaacaaguaugaaccaacuauauuuuaaaaguaauuugacacuaacuuuguauucagauaacauuguaguauuucauaauuuauuaccuauaccaguaauguguaugcuauuuaauaaagacagaauguggugauguguauuuaaaaacaggauuuuuaugacugaugugugcugggugauuuuccuaggguaauuaccgaauuaguucuuuuggaagccacuaggagcuguguuuuuauguguucugauacuaauaauuucugacauugguuuaauuuacucuuauguuagauaagguccaaaccaucuaaaccagggucagcaaaauaguuaauauuuuuggucuugugagccauauggucucugucacaacucuucaauucugccaugguagcuugaaaauaacuauagaucuuacauaaaugagugaguguggcuguguuccaauacaacuauuuaagaaccugaaauuugaauuucacauauuauucuucuguugauuuuuuuuuccuaaugcuuuaaaaguguaaaaaucauucuuagcuugcaggcuguaccaaaacagguggcaggccagauuuggccauggguuguagcuuauagaccugacauaguccacgucaucuauuaagugugcuaccagcagaggaaguggucuacauaaagaggauaauuucuaaaucaagaguagccagaagaguggcuuguauauagucauuugucuaugucucuaucacagucauaauuccuuugguucuuguuauuugucuuuuuccauaggcagcagguaucuuccaugaaggcagagccaugacucauucuucccuuguguucccagggucuaguuuguaugaauguaugaaugaauacaugaaucaaguuuacaucucagaaauuggugcugugguuacugaauuacaaaauaugaaaugucuuuugagaaaaucacaaaaacaggagucugcuuaugccauuaucccauuugcugugagacccugaaccuauauucucacuuucauaaacaggcuuuguauaacaugugaaagauagaugaguaaaagaggccaauuuagguagggaaauauacaaaucauuucagaaagacuuccauuccuauugacuccugguugccaaguuauuucuguucuucccuuaaaauaaccagucacgauaacacucuaaaacauuaccucuucucucacuuucuccuuuuacagagggauugauuagcucucagaaaagguuuccauaaggaaaugaucucaaauacaauuagguuuuuuaacuaauguguauucauauuauuauuucugacauugauuuaauccuuaucuuauuugggguccaaaaaucaauaaggcuccccccaaaauauaauuugccucuuugguuauaaguauagaaacuuacaacuuuuaaaaaaaaaauuuuuguuucuucauggaguacaauguagaaagccaguacaguccaccuguuaaacauaugauagggugauaugcccagucuaguuacagaaagcuccugguuaggacccaguaaaacaaucaaggugaacuugaauaacaucuuuguguacauuucauaguccaucuauucuaaugguccaauauaccuauuuuuaaaaaucucuuucugugccuguuuuuaaacucauuucuucucccaauguguuuaucccugguucuaucaggguaagcccuaaagggacaauuuggacuugacccugauauuggcagaagauagcuuuucuccuauuguggccucuuuccuuuagcccucguguuauccuaucuugaccaaguaaagguucauuguggcaggaguuuacauaaacaggaauuguacucauaccccauuucuaggaaaaaugggaacagcaggcauuaucugauguaaaauguguugaacccugaacaaaguacucaguguaaauccgcauuuggcuguuacaaccagccagcugagaaucaguuacuugaaauagcugcuggucgaaaggucuguggccuuuccaaagauguguuguugacuuuauggcaagacuacuagaacuuuccuuguuagugauuuuauuuuauuuuauuuauuuuguuugugaugggaucuugcucugucacccaagcuauagucgaggggugccaucucagcucaccgcaaccuccacuucccaaguucaagcgauucucaugccucagccuccccagcagcugggacuacaggcucacgccaccaugcccagcuaauuuguuuuuguuuuuuuguuuguuuauuuaguagagucaggguuuuaccaugucggccaggcuggucucagacuccugaccucaagcgaucugcccgccucagccucccaaagugcugggauuacaggcgugagucaccacaucuggccuccuuguuaguaauuuuagaagaauguuuggaugccaucuaauccucccuaagucccaguuaucuugucuuaaaaaugggcauaaugucauuugucaaauaagacugauauugggcuuaaaagaagucuuuuaaauaaaguacuuaggauaguuucucagauuagcagauccucaagaaugauucuuuuucucucuuucguuuucuaaauaucccuuugaaaucuuaauuaguaagaugucucuuuauuaccagguuuuauauuguugaguauuuuccaucauauuauuacuuauguaugaaauaguugagcucuaauuacaaucuauuuuguaauugugcaaaugauucacaaugaagcuuaaaugaauaacuuccaaauguuugcacaaauaugauauauaauacguauauauauuauauuuauauaucauauauacauguauauauauguauauguguguauguguguguauauauacacacacaaacuagguacugauauuagacuuaccuguggauuauaaauaugucaacuuucucucugguccauuauuauuuuuuaaugcucucaaauauuucuaaagccauaaguauguaggcuuaugauggaugcaucgauuuuacaugaauauuugguauucaaacuaaaggcuauuuaacugguuucaacugccuuuuauuuuauccagcuuaauuuuaucuuccuucugaggauaauuuuauaaacaaauuccuaauauacuuaauaaggauuacaaaauugggaacuugcagaaucaucugguucugaggguuagcaugagauuuuuggaauauuugucucccaaggauacauuaaccuaucucuuaaauacucucaacaaagaauauuagagucguuagacaacauuuaaaauucaggccuaucugcccuuccaguuucaaguuggaauagaguugucuuccacuggggaauaauuugucucuauuaauugagaacaaaugugcauggguguuuuaauuacacaguaaauuaggagaauuuaagaugcagaauaugugaaagccaagaauuaaaaaccaacaacccaaaacauaaguagauaaacaggaaaaauaucucagcauaagaaugcaagcacaucccaagauaaagagugggaaaaaaugaagaccaagacaaauuacuaggguuuuggucaaguuccuucaaguggaaugaucccauuuuuggcuacaagccauuguuggcuauacauggcaggaggaagaaaccacacucaaaggauuacuuugagaugucuggcuucaacuagugaccuuuuaugcauucagugaaaaugaguauugaggauuuccuauacaaauuucaacuuuacagagaacucccacagcaaguauucagucuagguucauggaacccugguacuauguguaaaguuguaugguuaugaguuuaugggggaaauagguccagaacguucuuagauucugaauggaguccgugauccuaaaauauaagaauacaaccugcugcuugagcagggugaacauuuguugaccuuguucucugucacuuaagauaaguaaaguuagcaucucauaaauuguuacuacuccuuuuuuuuuuuuuuuuuuuuuggcaagggcagucagaaugacuucuuucugccucucaccucgcugugcaugccagauacuuccaaccaaacuuggugcuuccuugcaagaccaaccugcuacuacuucagagcacccuccucuaucucuucuuacuauaauguauuuagauauuucuuauuuuuuuuuacauugcccuaggcauaugagccuuuacuguaagcuaccuuaaaucuuuuuuggaaagagguaggauauaaauuaaacauacaccuccccaagaucucagaguguugauggacugauuacagagacggggagcagguauuuccucauucaucacuggaggcagaaaaaucaccuccaaauauuuguucucugauagcaguugggaaaaguccuccuuaaaugagaggcccacgaagggaugaauagggauuuuggcugaccuccaaagugaagcuaagauaaugccugccuucccaguauuacuugaggcuaauuacucagauauaauuacuugcacucuguguuuuugcuuccaauaggguuguguccuugcuuuuguuuaucuuguaucccccauuagacuuugagcucuuuaagaauuaaggcuaucacuuccuuucuauucaucauuuguucuugaggcaaugcuuuucacagaauagucaggaaugccauuuaaguuaaugauuaagauguuaaucucacauuguugcaaguuaggcaacuuuugaccauccuuucuaggaaccccaaguuauccgcauugugaaggacccuaaagugagccucaggagauuguggugaaagugucaucaacuuuuggaaaguuucugaacuuagugaugauuugugcuuuuucaggacaauuuguggugccagcacuuaagcgauaaacaucccccuuuaaauagagcugaucaaguuuaauucacaguagucgaugccuaaaaauuauaggaugcagauguauauuuuucauguaaacauuaccucaaaagaaauuaaaggaaagaaagaaaaaagugacuuuggauaaaugucaaguauauauaauuuauguguuugagcucugaacaaacugcuaaaucguuuggccauaguuggagagacagaacauuuuaccugucuguagcugggaaucaaguguauuuacccacaagaguggcuuauuuccuaguuuauguggauuacacacaucuguguguaaucaugucugcccuuuccucugccucaaauccuaaauggaauuaauaacuuauuguggucccuuuuaacaagacagaacagaucucucugccucaggcuuaggaggcuccuuuauaauaauucuuggcucggguaacccauauacuccucaaaaauccgccccauaaauaucauaaaacuggccucaaagccauccacguuuuccucuguaaaaugaagaugaagcaauuguggaagaaggaagccuucucaaagagaagccagaagucaauucuguuucauuccuccauauaaguuucacuuuccccagaggaagguggaaaaucccuccgaacggugccagguggugguguaagcacugauggugaaguucacgugggaacaggagaaguuaauaauucagaggccgugggcccucccacccugcccuggaucaaugccugcuguuugcugaaacaagcuaggagcccacgacugguccucguguauaggauuggcuccauuuguggaugacgcuuuugucuguuuuccaugcucgcccaagcuacgugccugcccgcuccuguagguugcucagcgcccugguugugucuuggcaggcccuggucugucuguaccuuccuucucugugaccagcuucaggagcaggccccggagagugcugggauuaggcgccacaaaugcuuauguaggacuuuacugugcacuaagugcuuugcagucccuuuuauucguccucccucagagcguugacauaaaguaaaaaacaaaaaaccauuacucaagucuuuaugccaaggggaaaacugaguuagacacagucaaauaugccucauuagcaaaugcagauuaaaaugaagacccucuagaccccagucauacuuuugauauuagauuacaguuuccucauccauaauacaguaaucuaggccaggcgcgguagcucacaccuguaaucccagcacuuuggaaugccgaggcgggcagauuaccugaggucagaaguucgagaccagccuggccaacauggcaaaaucccgucucuacuaaaaauauaaaauuagccgggcaugguggcacgcgccuauaaucccagcucaggagacugaggcaggagaaucacuugaauccaggaggugaagguugcagugagcugagauugcgccauugcacuccagccugggcaaaaggagcaaaacucgcaucucaaacaaaacaaaacaaaaacaaaacauaauacaguaaucuuguacauugauauuuuucaaauauucuguagauguagaauuucaugggcaagucuaacaucugaaauaaauaaccacagaccaggcgugguggcucacaccuaauccuagcacuuugggaggcugagacggacagaucauuugaggucaggaguuugagaccagccucaccaacauggugaaaccccaucucuacuaaaaaauacaaaaauuagcuggguaugguggugggcgccuauaaucucagcuacuccggaggcugaggauggagaauugcuugaaccugggaggcggagguuacagugagccgagaucacaccacugcccuccagccugggcaacagaaugagacuccaucucaaaaauaaaauaaaauaaaaaccacagagcacuucaacuggaagaggaaaguggaguccccugauccuuaaacuugccccccuuugcccaaauggcaucaagagcuccguggaguccagcuugaaaagaacuagacuaaaaaaucaccagggucucuaagugcuaaaauggaaccucagagagggguccugaugauuugauugaggaagggugauguacagggguuacaagcaugggcaucaacacccagcuuuaccaacuugcugugugauguucuuaacuucucuaggccucaguuuccucaucaauaaaauggggacuguaagugagaugaucuuuuuuauuuuauuuuuuucuugagacggagucucgcucuauugcccaggcuggagugcaguggcgcgaucuuggcucacugcaaacuccacuucccggguucacgccguucuccugccucagccuccugaguagcugggacuacaggcgcccaccaccgcgcccggcuaauuuuuuguauuuuuaguagagacgggguuucaccguguuagccaggauggucucgaucuccugaccucgugauccgcccgccuccgccucccaaagugcugggauuacaggcgugagccaccgcgccuggccgagaugaucuauuuuuuuagcacugagcauagaccugguccauagagguucucagaaauggugauauuauuuucauuguugguauaacaaugucaauaauaauugcuguacuuugaauuugggggauaggcuuagaaauagcaucaguaaugaaaauugccuguucuuuuaauauguguauucuucuuuaauaagcauuucaaccauauuugaguuuuuccaauuuuaauggaauuguucugucuuaaaaccuauuguguaugugucaugccuacauagucuucugugcagaguacggucauagccgggcaaaccuguuaucuaauaagaauguucgcuuuuucacauucaucagucagaaacaaauacuaaauaaacagcucuaaagaguaguaccagaacaauuaaguuaaaauuaauggagcacugagacaauauaugcugccuuuggggcauuaacuccgauuucacuuuuuuauuuguuuuuuuggagacgcucuguugcucaggcuggaguacaguggcacaaucuugcucacugcaaccuccgccucccggauuccagggauucuccugccucagcuuccugaguagcuggaauuacaugugcccgccaccacacccagcuaguuuuuuuuguauuuuuuuguagagacggaguuuugcccuguuggccaggcuggucuccugacuucaagugaucugccugucugggccucccaaagugcugggauuacaggcaugagcuaccaugcccugccagauuccacuucuuuuacaguaguuaaaaguagaauuaggagagagacaacagauaaaaccagccacacacuuuugaucucccuucugucuuucauacggaaaugagaguuucugagaaagguaguugaaacuagacagcagauaacagccuauggcgcauacagagggggugggagggugaaaccauacagcuuggugagguuugccaggaguaccugcuggggcccuggcauaggugacccugcaaccaaaacaggaaugacacuagaagaaugaggccuaaguaaccagcacacuguuaaaggaggugggaauaucacaucccagcuacgcacuuccugccccaauaucuaaagguuauuucauauggcaagcuagaaacaaaauacacacguacauuauuacacauguaauaucaauggcaaaauuuaaaaucacugauaauuuuaccucucagauauuccuggugauugugaucugugugcucauaugcugauauguacaccacaggcauguacgugcaaacacucacauguacuuucuuuugcaggaauaucaucacugccuccuaaagugcuucuuucacccagcagucuacucuaggcaguuuccauucuacugaauauacuuguauaaacacauuuuuuuuguaugugacuauauaguauuccuuugcauaaauauacuauaauuuaucaaauaauuguaugucauuugguugcaauaugcauuguuacaaucggugcugugacuauuauaaucauagcauuucuuuacaagccuccucagguauuuccauaggauaaauugucaaauugccuuccacaaaagaccucccaauuuauuuucuuacuagcaguuuguaguagugucuguuuaccccuacucuugccauuaucaggcaauguuuacauuaaagacuuaaaaccauuuuuuaaaauugccuaaauaaaugcuuccuuagcaaauacucuuuaaagaagaaaguaguuagguuuucuggcuaaacuucuuagggcuucuacaugaauguuuucacaaacauccauuucaaagagcuacuggaaaauuggauauggacuauuuugcuuuauuauaaaugugaguagcaacaagauucuuuguauucaaaaagacguuugagaguuucuagcccaauggcuucaugugccaauaaucuauggguccaagaagcucuguauuuccccaggaucacuuugacugcuacgugucagggcugggaguagacccugggccauccaauuuauucaacuuguagaauuaggaucauagcguuaguauauaucaaguguaauuuucauuacauaugaauguuuaaaaaaacauucaacagaacuuguuggauauuugaguauaaucuucuuuuucuuuuucuuucguuuuuuggagaccgaauuucgcucuuguugcucagacuggagugcaauggcaugaucucagcucaccgcaaccuccaccucccagguucaagcgauucuccugccucagccucccgaguagcugggauuacaggcgugcaccaccaugccuggcuaauuuuguauuuuuaguagagaugggcuuucuccauguuggucagucuggucuggaacucccgaccucaggugaucugcccaccucggccucccaaaguccuagguuuauaggcaugagccaccgcacccguccuugaguauaauuuucuuaucauuuacuccuaccagccucugugcuagguucuggggguauaaagacaggggccaggucugccuuuccccuacauuauuacagucucauaaggaagaaacccagaggagugaugauaaauguaugccucaaguauguaguauauagguggugcaguuguggucugugcacacagguacaaugaggaugcagcaaaaggucugauucauuuggguuacagacuuaauagaaggaaugaagcuugagcugaguuuaaagaguagaagaauuggauuuuaauauauggauggguccuccauguuaaaauuaaugagguuggacauuacugaggcuaagacgguagcagcaggugaugggaaggucaucaguguuggggcccauuagaccuauaacuccuugaacaacuuacuuugauccucaguugucccaucugaaaauaggaugauacugugcauuccacuuguagaacuaggauuguagcauuagcacaggcagugacagucauggcauucacaguguggagugacacagcaagaggggugaggcugcccagccauuuguacguuuugccuguaggucuuaaacuggauggcaggaggcuugaaguugugauuucuaccucauguuuucauuauaaaaugaguggucacuugaagaaaagugacagugaguuuuguguuugaaacuuuuagaaggauccauucuggaauaaccaaagauuuaacaugagggugugccauguauaugaacagagcucuucugugccaggucucuuaagaaggcuggaugugguuugggcugaaaaaaugaucacucaccaucaacccuuucugcgcuguguguggcgaaugccuggguuugccuuccugacuacuuugcaaaguguguugcuuuuucugccucuguugaauuuacccuuuuuccagguuccacucucacuacccuagauccagccuuacuggaggcugcacagaccaccagcuuucugaacuaugggccuagccuauuccccccuccauauguuauaguagcaaagucccugcuuuaaaauuuugcagcuuaggaacucugauuuucuuaucuuccucuaacuguccaguggcuguguauuuccugcauaauaaagaucugaacaucuuaccaugauacgugguagagcugccggcauucaucagauauucaugccuggauugccugcacaugacaaucucccuacuuugguugcugcucccccacuugccucugacuuagguaggguucccuagaggagucccgagacgggguuucucaugcaagugacuuauugagagaauuauuucuuuguagaagccaguaaaggaaugugagaagcaggauggggcagggcaggaagcuggggaaggaugugggucuaguugaaguccaaccuccgccuuaaccccuggggaaucuguagcaugaauggcauguauggccccauggagacccccauaucagucaguaacuaacuggcuguaggcugccuuuggguggggguagguaauuacccaggcauuuccccugcaagaucccagcagccuaggggugacugcacugaccaauaaaaggaauacacgcaggaugccagcagcuuccauuguacccacaggucaaacuccuacugauccuucaagacccagacagauuucaauuuuguaaaguuuuucccagaccagaaauucucauucugaacuaaugauguuaccaucucccgagucuucuuaugccucauucuaggccuuaucaagaucaccuuguaucacuguggauuggcuuaaugucuggcuuccugcuagacuaaugaguuucuugagggugcagcguguuuuaauucaccuuuaaauagcuacuccccagaccccagggcugucccuguguagcuauuuaguaaaggucguuugaauugaaaugagcuguaacauccuuccuugaugccuagugcuuuuagcccugugggaauguuucuucaagccuuccagauacggggggcucuuccaggaaugcuagcucagcuugccacucuuuccaccccaggauuccauagccauugagauuauaccacagguucccugugccagcauuuucuuccaccugcuccccuggaugucagucuacaucaucucaccagucggccuaugucaucucacuagucagccugggcagguagccugcugucaucugcuguccacaugggcugggcccuaggguagauggcuugaaacaaguauuacuucuuggaugacauucuggcugccacucagaaucugacaguugguaaaucuuggccugugcuauugaaugccaugacuuauugguguaauggugaaaauuguucagaggaagacugggacauccaugguggacccaagaaucaugucaggggauggaaaagggccaccauguccuaguuuggucuagaacuagauucugcaaguuacagucacaauccaauagccaaauagaagcacucauucauucauucauuuucucaacaaucuucuguuucuucuuuucuauuuauugugugcugggugagggcaaaagugaauaagaugugguuuuugcguucaaggaauugacaagggaaggagaugagauugagacagauguaugcacaacucagaauaaugaaaggaauaaaggauaugcaccacaagaaagaaagugcacaggacauugguuaagaaugugguaucugaaguuagagggccuugaagucaaauuccagcuccauuaguuaucaguugugggacuuuaggcaaguaauuuaauuuucucaccuucacuauuauucuuuuuucuuuuucuuuuuuuuuuuuuuucagagauggaguuucacucuuguugcccaggcuggagugcaguggugcaaucuuggcuuacugcaaccucugcuucccggguucaagugauucucuugcuucagccccucgaguggcugggauuacaggcgcgcaccaccauacccugcuaauuuuguauuuuugguagagacaggguuucgccauguuggucaggcuggucucaaacuccuuaccucaggugacccaccugccuuguccgcccaaagugcuggcaugagccacugugccuggucacuauuuuucaucuucaaauggaaacaacagugguaccugcuucauaggguugucugugaggauuaaauaagauacugucuguguaaaguacaaauugacacacauucacagauguuggcuguuguuaugaaugcuauuauugaugggcuaguucuugcagggcugggggacaguccauggaauagguggcauuugaguggggcuuugaauuuuuacaggcaagggaggcuuccauuggggggaaaaaaaaacagcuugaaaaauaaaaggagggggcaugagauuguauaacuuacuugggaauggcaaauggccgugacugccugggauguacugauggaugcucgaaggguuuccgugggagcugaggcagugaaugugugcuaggauggagugcuuugcaaauagugauuauucaauaaauauuucuugaauuucuuugauuauuuuaugcuuauguguuaacacuuauuuaugauaaaaaugccagugggcauuggguccaaauuuaucuuauugaaaaauaaaaauaauuaugaguaugccuccuuuaacaguuauagagauuggcacacuccuuuuuaccauuguaaagaaaaauaacugcucauccucagcuauuuuuugacccuuucauuugaagauguguuaugcuauagauuauggagcuguccaggagaacuuucugugaugccagaaauauucucuaucuuuauuguccaguguuccagccauaagccacaugggacuguggagcacucaaaguguggcuaguuugacuaagaaacugaauuuuaaauuuuguuuauuauuauuauuauuguuauuauuuuugaguuggagucucgcuuugucacuuaggcuggagugcaauggugugaucucugcucaccgcaaccuuuaccuccuggccucaagcaauucucccaccucagccuccugaguagcugggauuacagguccccgccaccaugcccagcuaauuuuuguauuuuuaguggagacagaguuuuaccauguuggccaggcugguuucaaacuccugaccucaaauaauccuccugcuucagccgcccaaagugcuuggguuacaggcaugagccaccgugccuggucuguuuaauuaaauggaagucaccccauggggcuagacaagggcuaucauaguggauagcacugcagucuagaaacuguucuggaucucuguagaggaaaugugcgaaugugaagcauuggguuuggaauaguguggggcaaaugagauauuuccuauugaggugucugguacugcaguuucagaagugaauacccucaaaacgagcuguuuauuuuuaucaguuuuguuuuggagaauauucaggcaaucugugacuagagugagcagugcuccaauagagugcuuugagaaauaccaggcugauuacagacccacaggaagcaauugucauaauuaggcccuguuaauaaaccaugggcugcaauguguguacacacacacauucacacacucuuuuucuccuucucucucacugaauccagugcucucucucuggcauguagugcauaagaguuauuuuucuuccugaucucaguuuuccaacaaaugggaaaaugcucugaacgcguugcauacaggggaaaaaccuuacagucuuuauuguaugugaacagcuaauaaggaaaccguuugacaagagcuugcuuugugucauggcuucuggcuuccagccaguuuauuuucuugcugggacaacuauauucaggcagcagaguuaagcaacagggagggggcaggaugaagaaacacagacuucauaaaucagggcgauucagcaaaauuccauuugaauugaaucugggccaggggcaggagugccauggagcgucuguguagaagcugacauuuuaaugauuugauuaguuuaggaagaauauuuuuauggauuguguccucgauuauauuaaguacugagugaacuuguuacauuaugaugaacuuccauuaccuacacugguuguguacaagugcaaugauuucagcccaagacccuaaggguaaucucgugcaauccucuuaaagaaaugcuguuuaaugacuaaagcuguuaaucauauuaaauacauacagccacucugggaaaauaugccaaacaagcauaaaucuaaaaaagguauuugaaggagcuaaaugguguguuuugaggggauauugggcaggggaaguaauaauggagggagcgaagggauguagagauggaagaagucauaauagguacagugaugguguuuuccaucuccuguguggcaggugcuguguugaauggguuaaucagaaugcucugggccacaucuagaagacauuccaacucaacauaguuauuuauuuauuuauuuguuuguuuguuuauuuauuuauuuuuugagauggagucucacucuguugcccaggcuggagugcaguggcaugaucucaacucacugcaaccuccaccucccgguuucaagugauucuccugccucagccucccaaguagcugggauuacaggugcgugccaccacgccuggcuaauuuuuguauuuuuaguagagacagcguuucacuauguuggccaggcuggucucaaaauccugcccucaggugaucugcccaccuuggcauccgaaagugcugggauuacaagcgugagccuccgggccuggccccucaacacaguuuaaacaaggaaaacuuaucuuccuaaaaauagagaagauagacaguucccaaguggugauggugguguauuuuguuuguaaguuaaucagcaauuuggugauaucaggguucuagguugacuucucucugauucucuugguuuucucuaauuuggucauuuauugugauauuuaaguuaacaaguaaaaauggcagcugcacucacacuucuuaaccaauggaaauuuauuugacucacaaagugcauaggaugggagaaaucuccaguggacuaguggagucugugacagugggguauguggaguauagauccacaggcuguuggaauaggcucagguccucaucugcucagaagacaggcagggaaauuccagucuucaaggguuuuguuggugaggagaacauggauauggauguaauguccuucccuuuuguuuucuuugcacaaauuucaguggaaacauguugccaagucagaucgccauucuacuugagugaauauggaauuuguccaguuuuccaaaugcagagcuuuuugugggcugauggacugaauagaaagaggaacaaccauacacccuucuacagaugaaggcaagauuuuaugaaagcgacuucauucguucuccucugccugguguuccuucuuuguaaaccaggaccagggagcuuugaauauagcaguauauuauagaauuugguuucauuaaauauuauaccugcccuuaguguuuauauuccaguauauugacaacccagguccucucuguaccugugauugucuguguugagacuauuacagagcuccaaaaauuaaaauaaaaauaauaauuuuacagaaauacauauuugcauuggaauauuuaagaaaguugaguuuggaugccacaagauuauaggaguaauaggaagcugggcacaguggcucacaccuguaauccuagcacuuugggagguugaggcagugaggcaauaggauuguuggagccuaggaguuugagaccagccugggcaacauagggagauccugucucuacauaaaguaaauuuaaaaugaauuagcuguuggugcuguuggcauguuggugcauaccuguguaccaggcguguuggugcacaccucccaaccacuugggaggcugaggcaggaggaucccgugaaccugggaggucgaggcugcagugaaucaugaugaugucacugcaguccagcuugggcaacagcaagacccugucucaaaaaaaaaaaaaaaaaaagugauagauaacuaaccaggauuuucuggauuuggguuugggaaguggaggaaugccugugucuguguuuagaaaugacaaaccaaaccauggacaugacacuauuagcuccugucccuacagcugcuguguuguuucuugagagcccaggauggguaguaggccucuuuaaccuccguuaucacuuaauucucaccauaauccuaggagauguauauguccucauuuuagagauaaggaggacauugaggccaagagaguuuaguaaguaacagaauggauuuucaagccaggucugucuugauaagaaagcucacaugcuuucuuucuuaugacacuguuuaagcuguguucugcuaaguuccuaagauucucuaggauagaugcauguguaggaucaauucagggcgaaagggcuggaguggcuuugagauucccaaccucugcuccuaacugguuuucuauccugaguuucugcauaccauuuucuuggaagaagagauucugugcuuaaaaaaaauacguacauaaaagaagcgugcacauugcuguccuguaccgcagugccugagucagguauccauuugcauugugaaaggagccugaggugugaaacaguucuggguucuuugcgcacccagcuggcuggcuuccugugaacuggcugcauuucagauuucauucucuagccagaagcugaaaggcaggagcccuuugaagagauacagggaagcaaagaggguuauccagaugagaaggaagggaaagggggcgugacaacuccuuggagggaauuuccccagugggaacugccucuggaggagcuuacacagggcacaucaaugggaaaccacguccuggucugcucggaagcccuggggggccucuugcaacaugcaggcaggcuccccagacucaacccucucucucuaccagaggcgcauggacugcgccugcuucccccuucucuuauaaagccagcuaugggccauucuaucccucugccucccuggauccuucguccaugcuguuccugaaagcaagaaacaguccauuuuuuuuuuucauuuaauacuuuuuuuugcuaagugcugcugggaaacacauggaggagaacaaaacccgacaagccuggugcugcucuuacuguaucugugggguggggaauggggaaguucugaaaauuuacaggugugucucagacuaaaggguuucaaaacacugugcugaagcagugcguguugagguagaaggcacaggaguguuccugugguugggagagauauccuguguccagaauuugaggcaggagauagagguuuugcuggugggauuguggugagacuccuagagcuggaaccaggagagggggauccauugcucugugaagagggcaucuucacguggagcaaggcuggacagcaggagcccacuagggaccccugugagcaggcgucuggacuuguuuguuugaaaacaauuaagacgagcaaugugaugugaagcauucagaguaaggguaguggacuggauuaaauagaggggcaguuguaucaucuuucugugccccgugccuccuguuucuuccuucauuuguucauuaaacaaauguuuauugaugguuuauaaugugccagacuugccuaggugcaugggacgcagcaguaagugagaccaagaaggucccaguacucacggugcuuauauucuaguagacagugaauaaauaaacuugccaaucaaaucucugccauagcucucaucacuuucagacauagauuaaaacaucugagagugccuguaaucccaacauuuugggaggccaaggccgguggaucccuugaggucacgauuuggagaacagccugccuaacauggugaaaccccguuucuacuaaaaauacaaaaauuagcugggcgugauggugugcgccuguaauccagcuacucaggaggcugagacaggagaauugcuugaacccgagagguggagguugcagugagcugaaauggcgccacugcacuccagccugggcgacagagcaagacuccaucucaaauaaaccaaaaaaaaaaaaaaaaaaauacccagcagaacaucugagagugauaagagcuauggcagagauuuaagauaguuccaugaaugcuagaaacugacugguucuaaaagaccagaagaccucuucaagagagacuuuggaggcgaaaagugaguguagcauagagccagucuugggagguuuggggaagaacauaccacugagagagagcagccaguaucaaggcccugagacaggugagagcuuuguucaaggaacagaagggggccaguauggcuaggauggagugagcacggggaagauguuaggagcacguuaaguuugcauucccucuggguguccuuggauagguuacucagccacucugagugcugcccuggcagccagcucuaggcuucacugacuggaguuuggcuauccuuggauggaaauccaagcucuuuuuuacuuuacauuuuucauuuugauuauaaucaaauuaagaacagucauaaaaguauuuucugggucaucucgaugaaacuagcacuaagcaaagccauggauuucuuaacucugugcagguauguuccuauaauugucaugugcuaaaacgaaggcucaggaaauccaaaagauuuuugcaguauuugaauagaaaaaagagggguggagggaagugagugugggacagugaggugugggcagacccaagaacccuggugagcgggcaguacuauguuuauguuuugagugggauucccauuuuuacguaacagccuccuacauuuguuagaaguagucuuagcaguuguaugguauagcauuucccuuccugcccccagacucaguaauugguuuagaugccauuuaaugcaguuuuuaauuccucaaaacuagucuucugugaacaaaauaucuuuucagauuuaccagguaaaucuguaaaaucaguaugaagggauugcuccccagccagcauuugguuaaguugaauucugauuauccuuaaccugcaagcaaagcuuugaaguuccuaauaacuuuucuguucaauaguuuucaugcuuauguaaauagacacucuaacauuuagaaguuaaagcacccccccaaaaaccucaaauauauaacuuggccugagacucuauuuuucuacugcaaaauucaauauggacaauugaguuuuaguaaaacuacguaauuucgaauugaaauaauuuaaauugcuuuuguuuuaaaaaauuuguauuugugcauaauaaguuacauuucaauaaaaauaaaguaaaugcauucacuugacuuauuuuccgcgugggcauuuucuucuucauauaugguccauaauuacuuaagcuugagacucacugcuucgacuugcaaacagaacauuucaagugaucaaaaaucuaggacccagagggagugaaugcacaacuuuaggauucugaccuuagcugcaauagaaaccuugagugacuuuuaaggcuaugauguccugguaaagaaauauaccuaaaacauagauggauaugauaaaguaauggaauuuugcaucaugcagcuauucucugccagcauguccggcaacagacaucuuuggaagcauauuuuugaaaauagguauccucguucucuucauaucauuuuauuauugaucucugaaagacugauaaccuugguaaaacagccagcucaauguguagccaauaaccacgccuaggugucuggcuucccccucucuuauucccaccucccccuuuuccaucuccuucucuuccuccuucccucccucucucauagaccucccacacccccgccccacacaaaauauauauaucauuguaguuuauaauuuauaaagauuuaucaauugcuaauauaucaguuauuuauuuauuuauuuuuauuucuaagcaugccuccuuugaagggcauauguaugucugugugaguauauacaggaaauguauccaugucuggaaaggggccuccaucuagacgccaagugagaguucuuggaucuugugagagaaagaauucagggcgacuccauagaauaaagucaaagcaaguuuauuaggaaaguaaaggaauaaagaauggcuuuccaaaggcagggcagccccgaggacuguugauugccuauuuuuaugguuauuucuugauuauguguuaaacaaaggguggauuauucaugaguuuuccaggaaaugggugggcaauuccuggaacugaggauucuuccccuuuuuaggccauauaagauaacgucuuggcauugccauggcaucuguaaacugucauggcauugguggaagugucuuuuagcaugcuaaugcaauacaauuagcauauaauugagcagugaggaugacuagaggucaccuuuguugccaucuugguuuuggugggauuuggcuggcaucuuuaccgcaugcuguuuuaucagcaaggucuuugugacauguauccugcugaucuccuaucucgcccuaugacuaaacacaacuaaccuuccgggaaugcagccuccuaguaggucucugccuuauuuuacccagccccuacucaagauggagucacugugguucaaacaccucugacaaaucugucugccuguuggaaaggacuuugucaacuugucauguuacuuauauaaauauagaaauauguauuuaaaacuugauggacacuucaccaucacacucucuucuccucucccacaucacucuagcacugauccauuuuuagaaaagguuuuuuuggggauggggguugaccagauguggauauuuagagauaagucuauaaucuuccaacuguagaagucuuuaugucuuugagucuugcuuguguguguaaauguccuauuuuuuuuuuugauauaugaauaaaguaauuaauuugcauuuaguugcuuaagccugucuucauagccuggggagaaaugauggcugacacuugucauucuccacccuuccgcuccccacauuucauuugguacuucauuucuuccucuugaggugugaauaucucaagaaagauguugacuggucccacugguugggaugacaaugagugauagguagucuugcacuucuugaucaaugacaagaucacccauuuggcaaacucuuccucuucucuucugucuuuauuuuuuuuuuuuugagauggagucucucucuguugcccaggcugcagugcaaugugcgaucuuggcuugcugcaaccuccgccucccagguucaagcaagucugccucagccucccaaguagcugggauuacaggcaucugccaccaugcccagcuaauuuuuguguuuuuaguagagaugggguuucacuguguuggccaggguggucucaaacuccuuaccucaggugauacgccugccuuggccucccaaagugcugcgauuacaggugugaggcaccacgccuggcugcucuuacacuuuucuaugagacacauuacagauagaugcccauauugagauacauacccauauacggauagauauccaugcugagagaagcauguuaauccggcugugaaagcuuuauaguuaggaauuucugggaagaucuucaccuuuggcauacuccuucagucucauccccuaugucccuaauagaagcaguaauggggaaucugucaugaugacuuacuagaaaaaucuauugagccugcuuaugauucuuugguuuuggaggaggagggcacuaauuuucauugguucauucauucaaaaauauuaaguuccuacuccaugucuaauaacugccuuucuggcuagucugugagcauggcaacggacggaugaugucuuuuguuuucuguugugucucugaugucuuucacauugaagagcagggaggaagugcucguaucauauuugugccagagugaggaggaagagggaagcacucagagcugacacuuccugugauuuagccuucugccuguggaucaucuuuucaucuuuuuugagcucauguuaguuucucuacuaccugugcguuucuuuaccuuccuuggaguauuucuuccuugagcucaguguugcaggcacugcuuggucaggcuuagcccauagacagaaaauacuuauugaguacuuacuguauauauagcacucuuccaugcacuguacauguaugaacucacuugcucuuuccagcaacuuaggagaugugugucuucauuaucaccccaauugaagaaacuaaggaugagaaaggauucagacuuaaugcaaaugauccacuaucugggaagcuauuuaaucaaccugggcucaauuauuucuguuuucuauuuggccgugggcuuuuggguuguuuguuuuagugggcacagaacucaagguccuuggcuuuuucaugcccuuuuucaucggugucguaaguacuugcuccguaaggaaaugauuuuaauuuuacuuuucucuaaaaguaaaaaaauccuacucuguaguguagugguuucaucuuuuuuuuuuuuaauauugacugacaugucaagagaacccacaggcuuugcacauacacuuuuccagucauugcuucagauaucacauccaguggaaauuauuagaugugauaucugaaccaguugcaagcaagaucucucagccuccuucaauugcuauguuccagguaaauguuauugcugugauuaucaucaucguaauuauuuugcauucucuguuuaguauuuuuaucagaacagcauucuuuccuugaaagauaaaaacuauugaagauuuuaagaaaguuugaagcuuguuaaggaaacuaguaacuaaaaaguuuaagauucugugccuagugggacauaauuuguuguuuuauuaccuuuuguauuugcucgugcauauguacaugccugcauucaaccaaauauuuguuacaugccaggcacuguggacaggugccuacuuaagguaauaggcugggcagacagacucccacccuaguucaucacacucauucaaauagaauuucuagugguugaaagagcaauggccuugguuuuacccucuuugucaggaacuaacuguucauucucuggugagucacccaaauguccuggcucuucaccugcaaaaugaguccauuggccuagauguucucuaucaacuccaaaggucuaagauauguaugauaaaggguaugccauccagugaagaucaacaguaucauucacagcaggccuguucaauaaggaggaaguugccaucucaacuggaggcuguacuggacaaauaacauucacuauucugccuccaagguuucucauuuaaccaugggagcuaauaugaaaagaagguguuccuaagccagugagauuaagguuugcagguuuuagccugcaagcaggaccaacuaccaauuuacaggaucuagcacaaaauuaaaauguggaccuuuuguucaaaaauuguucaggauuucaagacacagcagagcauuaaacgaagcauggcacccuucugagaagacagggcucuagugucaccguaugggucacaggcaaacaaagucagcccuaccuguaaauggaucugauuaaaggcagaaguaucuuucuauuuuguaagcagauugagugguauguuacugucucacaauguguuauuauuuuugcuguuaugacuaagauuauuauuuuaagugacaguaccccugugcccaucuucucuuuugagagucugaaucccuucagauaaggacuacagcuuaccuaauuugugauuuuccccucagcuagacuacugacaugauguguuuguuaaaugcagugaauguaauagucauuuaucacaaggagaaauugugauuuuuuuuuuuucccccagaggaaucuagcuuaaagaagccaaaauaguacuuaauaagguguuugugggaacagagauggaccauuggaugaaaugcucugaaauaaaacuaggccuaugcaguguaaaaagacuaagacagugaguuucugccuuuuuucuuuuuuuuuccaaaaaaccuuuuugauguaacacaagucaguauuuuuguugcuaguuggcacuucaugaaagaugauagccggcuggggagagccaagaaaaaucagugaguggaauugacagacuugcaguguuuguaacucugccuuuauccugugugauauuuuaaauaaaugguuuucuuauguaggggacaguuauuacugugccuaucccacacagcagagaacccaaaagaggacgacacacugaaggagucauaaauugcacauguaaacagcuggacauuuggguguuggugaaaccucugagaugagacggaugaaauauguugagacauucaaggcuuuuguugcuaguuuuuuuguagaauuuuuagcagaccuuuaaaccaagagacacuggcagugcaguuauuuucaauaaccuggacucuccaggaaaauuuagaaauccauccaaauagaagguaaauaaacauguuuauaggcaaagccuuuuauauaagcguuuuuguugggucugaaucuuugaugcugacagaguugaacugucugccuucuugcuuuuccuuauccuguuugucauccgcuauguggcuucggcuucagugaccccucucuccuuccaguuuccuagaagcaaauugcccuuacgagcgaaugcauuugggucauuugaauuugcucagucauuuuggcaauuaaugacuuuuuguggauucaguucuugggcaccuccgcugcaucccacuucuagccaugacucccugcauuagugauucagccugaaagaaaaaauggcuuuuuuaaaaagugggagaaauuuaucugaagagcaaucaguuagauggacauggaagaggcccucucugggguuuuaccuggucugucuuaaaaggaacucacucgaguuuuaaucccuaggauuauaggcuguaaagcaauggucagcuuagauccauuucagggccaauacaucugucuaaaauauuuugaauacaagaggagaggaaggauagagaagcaaagaaguuuaugacucaaaugaucuagagaauaauaucaaaguuccccaugacacuugcauugggauuuuacuuugauuauagacuuuauguucuuuaugaagaucacaguucuucucagggcauacacaucaccaugcuagcggcuagcagaucuuaggccaagugcggucucuucuauggacuugauuuuagacuagaggcaaauugcuuaacccuuugggucuugguuuccuuaacuuuaaaauugagaagccaaaagagauaacaugcgaaacggcuauugcaggauaugagggaugaaaacaauuucuuguuuuuuuguuuguucauuuguuuuugagacaaggucucucucuguugcccagacuggagugcaguggcacaaucuugguucaccgcagccucaaccuccugggcucaagugauccucccaccucagccuccagaguagcugggacuacaggugugugccaccacacauggcuaauuuucuuuuuuuuuuucuuucuuucuuuuuuuuuuuuuuuuuuguagagacaggguaucccuguguuacuuaggcuagucuugaauuccugggcucaagugaucccccuaccuuugcuucccaaggugcuaggauuacaggugugagccaccacaccuggccaauuucuuguuuuuaugucaaaacuacuucagaucuguucucauaaaccuggggucauauggcuuccauaacugcaaaaggcuuagaagugcugugaggugauagcacucuuucucuguaggcuuuuugagagcaagauacuuuucuccauguacuucugcuuuaucuuugaaauaugcugccaaauuuccuccuguaauaaccguaaagguuuguuuuuuuuuuuugaggugguugcauugauucacucauucuucaacaauuaugugugugccagagaccauacuaaaugcugugaaaagagagaugaauaagagagacacagcuccuguugucacagaucuuagagccuuuuccugucauaugaggaaagccauagaauauaauccaggugagggacagugacaccauauuuaugaaagcacuucaaaugcauucccauuuccagccuaaagauacccacuuuagaaucugcgggauugggauugggauagcauuaucgugguuucuuuuuaccuaaaaaauuacaguucuauguuuuggaauuuuuuuucuccauggaaacaugucacuaaauuuauaauaaaagucauuuuagaaccaaacuuaacagaacacauaccugugaauuuuagguuguuagagaaauagguugcaggguuuggggcauucuacagggagcccauuacauaucaaaauuguaucauucauguauacauuucaagaggcauuugccuauauacacuacuaauaacucaucuagaauauaagauuccuuuugaacuggcagacuccaauauggggaauaaagugaugcucguuugccuaaucuuuauaaaacuugguuagguuuuaugccuuuccaaacuauacuggaccagaugucuccuuccucuugcuuuucugcccuccaggucugcuguaguguagaaagcacuguuccucugaauuuccuauuuaccuguuuuggccuguagugauaauuauuuuucucugaagucgcacgaugauguaaccaaggagaacaaugugaggucaguaguauccacaugacacaguaauuacaggcaacugcugauugcuuuuguacucagaagguuuggaaagauguagcauaaagguguaaacagaucauuuucuuuuagguuuuguuagcagugcaauccaaagggauucccauucauuuagcauuguucccguuggcuuuuauagcagccaaaaauaaaaccccuugaguacuacucuggaggguagcugaugacauauaaaguaaaucucuuaauuguaugugaacucuagaccagauugaucaauuccuuguauauucuaauaguccuggcccagcaccauacauauggugggcagucaguaaauauuucccuaguacaguggggacagagaagggaauuuucccaaaucaggcaguuuuagaguuggccauaugaaucacccaguuauuuucuuaaaaugcagauugugauucaguauaucuaaggaaauucuccaguucuagcaugcucccacgugauacgaauuccucuaauccaagagucuacuagccagacagagcuaaggccagaacacaccuauuuuaacucuuagucugggaguuauucucaguauaucaacgauggugaauacaugucucuguguuuuccuucucacucuuacuagacccauaacacuaauugauuggugaacucauucccacugagccaagaugcagcuuuggaauuguucucaauguggugcuccaugcagcaagugcugauucagagaguguuauuccagucacgcuuuggggaugaguggaaaguugggucaucuuuauacuccguguugcuucuuuuuuuuuuuuuuugagacagagucucgcccugucaccccagcuggagugcaguggcacgaucucggcuuacugccagcuccaccucccggguucacaccauucuccugccucagccucccgaguagcugggacuacaggcaaccgccaccaugccuggcuaauuuuuuguauuuuuuuuuuuuuuaguagagaugggguuucaccguguuagccaggauggucucgaucuccugaccucgugaucugcccgccuuggccucccaaauugcugggauuacaggugugagccaccgugcccagccgcuucuuuaagucaaguaaacaugcugagaauucaaagcccuuuucuuccuccagucuccucgagccacccacaucccccugcucacuguccuuuuuccuuccuucuuuuuguguuuuugaaacagagucucuguugcccaggcuggagugcagugguacaaucucagcucacugcaaccuccaccucccagguucaagugauucccugccucagccagcuaccuggggauuacagggacccaccaccacgcccagcuaauuuuuguauuuuuaguaaagacgggguuucaccauguuggcgaggcuggucucgaacuccugaccucaagugauccacccaccucggccucccaaagugcugggauuacaggcacaagccaccgugccuggcaguuuuaaauuuugggcuaaaugacuuuugcuaaaucacuuuccucuugcauccuccugcuucuuauaucuauaaaaugaacugcccauggacaauugcucaggauccaggcaguacuagcauuagaaaggguugccucuuuagcccaugauuaguccagugugggcucuuugcagaaagcaauggaaacugguuaacucaaccagaaaaagaaguuauuaaggaauauuggacgguacgcaguauagacauaaugguuaggacugggcuggagcugcugccugagcccuguccagacagccgagauacacuggauguugggcagugcuuuggcuggacauugaaaugcugcaucugauuggcuaauuuaguuuccauuuauaucccuaacaaggcaagggaagagagaagccagcuucucucuuguucuccuucuauaaugagagacaaaccaugccucucucagacacucacaauggagaauuccucaauccuaagaaagguggaucgguuacugacugugacagaugacugucauaacuuucauguucacggaaacuucuuuauaaaguuucuaaaugaaacgaaaacuuggcuaccaaccuacucuaguaacgcaacaacuugccccucuguucuuuugaguucuggcuucugauuguuucucaccacauugucaacuccuugggaaaguacucuguauguuuuaaagcaaauugccaggguuuuuguuuguuuguuuguuuguuuacuuagaccucgggagauaaaauuaaucgaccucuuuaaauacauggagguacccccuuucucguuuuugaagggagacacuugggaauuuagaaauugggagugugaguucuaagggcuggugugguuuagauagcccaugacaguuucaggaagguccugguuuccuuucaagcaaaaggggccaccucugaaccaaaguggauuaucuccugcagcagcaaauccaguuggcaguugaauuccugcaguuuuaugggaauuucagugaaacuuuuaaagcuguaauuuuuguaacuggaguuaaaaaaaaaaaaagaaaacaaaucugaauaaagcgacauaauccauugcagagucuguacaguucuauuucuucuaucaugaauguuuuccaggcagaugaaaaaauguuuugaauguugaauauaugcaaacauuacaaucaaggauaauugugucuaugugcuuugacucucauuuugcuuuucucuuccuucaucuucuccuauacccuauaggaaugugaucauagacauagaaauagaauuugcauuuguauaaauaaugcccaagcuguuuggaaaaaagacucccuguauuaggcacaagauuuagagauggcauuuucugccucaaaucucaguuugauuuagaucauggaaauaaugccuuuuaucuguauggacaucagaguuuacucagccccuuucccucugcccccuucauuugaucugcacucucuaaccucaugaaguugucugaacuaguguuauuauucucauuuugccaaugagugaaugagacucagaagaaagcaucuagguuagagauuucuaggcaauguuucuaauguuuccuucaguaaaauuguuguugcucuaucaaguauaugagcugguugcuguuuucugucuuugaugagugacaggauucccuuuuaugugucucacugggucugucuccuagaggccucaugagacuuaaugaguaguaucuguaaggugcuugaggauccccagauaaaaggagcaccuguuagcauuuaugauggaaguagcggggccucuugaaaagcugugcccuuguuguuaauaaugcuggcuagaggaguugcaggcgaggcuuugcccaaagccuuuauuagucauuacucucaggaaaugcagccucaccaggauguuacuuuguaagcuguaaugcauuuuugaaacagagaaaggaauauaaaaaccacccuuucgaugcaaaacauuaaaggaugaccugugaugguguauuuuacaaauuugaagauacaaacuuguuccaaauguacauccuguauguuuagggagggacgaggggagucuuguaaauccaugcuggugguggaguccugcuugaugauguguuggaggagcaaacugguggcacccaaggcucuguucugaagcagccacuccuguuaucccagcacgauuguggcuaaguuaucuucacagggguggucaacuuccacccagcacaauuguggcuaaguuaucuucacagggauggucagcuuccuccucccuaaaguaaucccgaagaugauaaugcugacccacuucuccaggaauuuggaaagaguaacuaaugagcgacuguaaggcguauuggucguguaaaggcaugcuguaaacacugauugcaauaacuaguaagaaagcagcagucccucuuccuucccaggagaguuugcaugaugauuauuuucugugguguuugcuuuguuaaaugaaaauguugcccgugcuuaggagauaaugcagggaaagaacacaggagggauuuaggaauguuuuacuuauugguaagugauuuuacuguugaagucacacuacagauacuguuaaaaaauuuaaaaauugggccaggugcgguggcucaugcccguaaucccagcacuuggaggccgaggcggguggaucaccugaguucaggaguucgagaccagccuggccaauauggugaaaccccgucucuacuaaaaauacaaaaaucagcugguguggugccauauaccuguaaucccagcuacucgggaggcugaggcaagagaaucgccugaaccugggagguggagguugcagugagccgagaucgcgucacugcauuccagccugggugacagauugagacucugucucaaaaaaauaaaauaaaauaaaaauugaauuuucccauuucuguugccucucucuuuguucucucuuuaaccucaaaccccuguuccuucucaucagcuccaccauaucaacuaucaacaugauguggcgugcucuugcuuccaguuaaacccgagaaaaagaaaucaggauuuaaaauucuucuuaacacauaguaaauacauaaaaucuacauucacuguuuguaauguauuaucugaccuucuaaauaaaauauaguugauucauuucauauaauuuggaauuuaaaccaggaauauuuauuuaaugguuagcucuuggucaggugugguagcucauggcuuuaauugcagcacuuugggaggcugaaguggaaggaucacuugaacccaggaguuaagaccagcuuggacaacauggcaagaucccaucucuacagaaauuuuaaaaauuagccaaauauaguagcacgugccugugguccuagcuacuugggagggugaggcgggaugauugcuugagcccaggaguuugaagcugcaguuagccguguuugcaccacugcacuccauccucagcaacugagcaaaaccuugucucaaaaaaaaaaaaaaaaguuuuaacucagauguuggccaagcgugguggcucauggcuguaauuccugcauuuugggaggucaaggugggaggacugcuugagccugggaguuugagaccagccugggcaacacagggagaccccaucucuaccaaaaacaacaacaaaaauagccugguguggugguguaaugccuguagugccagcuguucuggaggcugaggugggaggaucacuugagcccaggaguucgaggcuacagugggaugugaucacaccaccacuccagccugggugacaaaaugacaccuugucuccaaaaaaaaaaacaccucagaugucuucuuaauuaauuuucacuuuaaugagcaugaaaguuaagaagaguucuccuauuuugcuauuuuucuguaaaguugaauucuuuuuuucuccaaggaugugugaggcuaaaacaaaggucuccacaggagagguaagcuguauugaauucugcuaacaguagauuuuuggagagguaagcuguauugaauucugcuaacaguagauuuuuuuuuugccucaggaauauuagaggguucacuuaggggaacugauccauggauauuucucauauucuccuccaacagugugacuaacacaucaugucaguggauauucucauauguaauaagacaucugcaaaauagugccuuaaaacaacuuuuauaguuccucgagauccagugccuugacuggguugguuguuuuuccauuccauguggcaucugcuggggucacuccuguggcugcauucggcugguagcucagugggacgcucaguucgccuccaugcagccucucacgcccgcucuggacuuccuuacaguguggcagcugggucccaagaggcagauuccuaaagagcaaaagcagaaguuucaggccacuuaugggccacacuuaaaacagacacagugucaccucugcagcauucugcuggucagagcaaaacacaaagccagccuagauucaagaggaggggaaauagacuuacuucuggaaggaagaagcagcaaaugcaaucagggaagggaggaauugaugaggccaucuugggagacuagcacauucaugauaucugugcagcaugguuguuacugucuacauugagccuuauuuccaacuaaaggugaucuguggagcuccuuuggggcagaaucuauaauauuccuaaugauacucacaggaccuggcacuguguugggugcagcgcagaagcucacuauuguugagugaaagaacaugcagugaaauucuagaaaguugaauguaauagaaauccuaugaaguaacauugcugggaaauaggaaauaccaacuucacauucaguguagugacgucucuuuuguuacagcaucucgugcuguuuaaagcugcauuacgggaggcuuugaagcucagcaaggaagucauuuggcagauagcugugcuaaauggaggcuuaucccuggaaaaggcacaggacuccccacauuaguguucauuaugucaggauccuugcugucaggugccuaacagugugcugaccaaguuuugguugucuguguauuucuggaacguaacacauaccacccaaggcacauguuaggcauucagugaaugccagguuagugagugguggucagcagugccugaaugagugacaagcagaaaaggaauauagguccuguggacuaacagcgccacccaccagcuaccucugggauggaaccugugguugcuuguccaggcacaccuucaucugcuguucugucuucucuacaguggagaccauucuacugacagacagaaaaggcagugguaccauacgcacaucagaaagugugagugugcugaucauacuagguccagccagaacuuugcaucuuugaggugaaaccauucgcuuagcuaaaugaauauugcaccucaaaaaugcuggugagaauuuuacgaaagcauauuaucaaugaaaauauuaaaggagcagacguguuaggauguguuaggaugaagguuuuuuauuuuuauuuuuugagauggcgucucacucugucguccaggcuggagugcaguggcacaaucucagcucacugcaaccuccaccuccuggguucaagugauucucuugccucagccucccaaguagcugggauuacaggcacgcaccacuacgccuggcuauuuuugguagagacgggauuaagccauguccgccaagcuagucucuaacuucugaccucaaaugauccgcccgccucggccucccagagugccaagauuacaggugugagccacagcgcccagccaggaugaagguuuuuuaaaaagucuguaguuguaagaagcuauuuaugaaaagaucuuuacauugugguagcuuaugaaaauccuuuuucucaucuccuuuaauuuucuuucuaucaguauuauuacugauauuacaauuuugguaagaucuagagagaaaaauugauugugauaggcugucuucaauuaccuauauguuucuucuuaucuauuaccuucugaaguagcuuuuucuuaaacgguauuguuaaacuuuauuuuuuauuuuauuauuauuacuuuuugagacagagucucacucuaucccccaggcuggagugcaguggugcuaucuuggcuuaaggcaaccucugccuucuggauucaagugauucucgugccucagucucccgaguagcugggauuacaggccaccacacccagcuaauuuuucuauuuuuaguagagacgggguuucaccauguuggccagacuagucucaaacuccucaccucaagugauccuccugccuuggugucccaaagugcugggauuacaggugugagucacugcacccauccuuaaacaguauuguuaaacuuuaaacugaaaucugaacucucuguuaaacugccuuuuccaacuuuaauucccagucauuuuuuaaugccuucuauuauucuuucucauuacguauauguugcuauucucaaacucaguugcagaacaaguacaggccuauauccugagaacuauaaaucucuugaagaaagaggaggucuugcuggguuuucuggauaauggaugugacugugugggugcgcacaccugugugugucugcgcuggugcucugggcccuggagacugguaucagaauuacucugaccuaaaaaugcacucuagauuuuaacacaccucugguagaagagaggaggaaacauuugcagcauggaauuaucggucccauuaccacccaggugucaaggaaaugaaacuuuucuauuacaagauugcaguaaaucacacaagaggaugacagcuucauuaacauggguaaaguuacuguaauuuauguauaaauaacuuuucugugucaagauauaguaucauucagucccaacagaauagcauuuuuucuauaaaagaagugaaaugccaaaaaaagcaguuucuaucaaagaaauccacaaaagacaacgguuuccugugauaaaacugacuuugacagagcccacagcaccucugcuuuauaguuuuaaguuuuuacauucagccaaaacagaauauuucagacuuuaucacaaagagugacuuuuguuuuguuuuguuuuguuuuguuuuguuuuguuuuguuugagacagagucucgcucugucacccacgcuggaaugcaguggcaugaucuuggcucacuguaaccuccgccucuuggguuuaagagagucucgugccucagccuccugaguagcugggaccacaggcaugcgccaccaugcccggcuaacuuucuguauuuuuagcagagacaggguuuugccauguugguuaggcuggucucgaacuccucaccucaggugaucugucugccuuggucucccaaagugcugggauuacaggcauaagccaccgugccugaccucaaauagugauuugauauauuguuuguuauuugguuguugaaauaaauauuuugauuuuuuuauaagaaugaaaaauuugaaauaacuuaaauuucuaucaguaggagauugauuaaaagcauugugguacauccauuugguagaauauuaggcaggauuuuagaagaaugagggagaucuaaaugaaugccuauucagguauauauauauauauauaugguuauaucuauuaagcaaaaaacaaaaauuugaacauucuaugcagaauuauuccacucaaacaauaucagcagaagaagacugaucaacuuguaauaauuagucagcauaauaaaaccauauugaaauaguuucuuaguggaauaucaggggaacccgcccccaauauuucaauguagauucuuucuaucuuccaaaaguguuggccggcugagaaauaaagagaaagaguacaaagagaggaauuuuacagcugggcugcugggggugacaucacauauugguaggaccgugaugcccaccugagccucaaaccagcaaguuuuucauuaaggguuucaaaaggggagaggguguaagaacagggaguagguacaaagaucacaugcuucaaagggcaaaaagcagaacuacuaauaaggaucuaauaaagaucacaugcuucugagggaacaggacaaagggcaaaagcagaacuacugagcacaaggcaaaggguaaaagcagaacuacugauaagggucuauguucagcggugcacguauugucuugauaaacaucuuaaacaacagaaaacaggguucgagaguagagaaccggucugaccacaaauuuaucagggcagaguuuuuccccacccuaguaagucugaggguacugccagagaccagggcauaucucaguucuuaucucaaccgcauaagauagacauucccagagcggccguuuauagaccucccccuaggaaugcauuccuuucccagggcauuaauauuaauauuccuugcuaggaagagaauucagugauaucuuuccuacucgcacguccauuuauaggcucucugcaaagagaaaaauauggcucuuuuugcccaaccccgcaggcagucagaccuuaugguugucuucccuuguucccuaaaaaucacuguuauucuguucuuuuucaagguguacuaauuucauauuguucaaacacacguuuuacaaucaauuuauaccguuaacacaauuaucacagugguccugacguacauccucagcuuacgaagauaacaggauuaagagauuaaaguaagacaaguguaagaaauuauaaaaguauuauuugggaacugauaaauguccauauuaaaaugaaaucuucacaauuuauguuccucugccgaggcuccagccggucccucuguucgggguccuugacuucccgcaacaguggaagauaccuguaugggccauaaacuucuaggagacaccauauaaauuauaguucaaaauaaagaaaucauaccccgccacccuacccuuagaaguuaaguaggauaugcugacucuucuggguccucagauuggaaguccagucccagcuuuaauguugacacagcuuugguauagaagaacuuuagagcuaaagccugcccaccaaaguucaaguccugaggugggcaaauugccuaaucuuucccauauucagcuuuauuuaaccucugagucuuaaauuccucacuggaaugaguuguucauucuuccaauguuguuauuaaaagcaagugagauaauguuuguggaauuauuuugugaauuguaauguguucuacccuuauuacuuauuauagagucauugaugaaguaaauccaaggaauuauccuuaccacuuccuacuucccucccagaguaagaagcugagaguagcaggccaccagauccucucuuugcugaggaugacauuuauggcaugaaucauggagauggaaaccagcucaggaccaaacuggguuagcgucuccuuggcauucucuggaaaagaggcuguacugguuaaagagagucucugcuuuugauuuuauacuuaacuaaugacaauaggaaagaagauucuccacaugguuuaaaaaagggagauuuugcccaggucuuuggaacaguugaagugucugaaaaacagaaggagauacccugaacugccacuauauacuggggccccuagacuggagaugagcugaagaaguaguuacugaggcauuuucugugguuugauguuaauuucuagcgaaggggacagggaagcuaggggaaccagaacccuggcaugcauuguguucucuuggacugucugacaccuuuuaaaaaaaauggagucucuuucugucacccaggcuuggggguaguggugcagucuuugcucacugcaaccuccaccucccggguucaagcgauucuccugccucagccuuccaaguagcugaaauuacagguacacgcgaccacccagcuaauuuuuguauuuuuauuagagacaggguuuuaacauguuguccaggcuggucucgaacuccugaccuucagugauccaccugucucagccucccaaagugcugggauuauaggcaugagccacugugcgcggccacauuuuaagaaaugcucaguugucccauuguuagcucuaucacauaaauuuauccuugucuuauuuaguucuuaugcaccaauuaccuggaaccuagcucaugguuuccagcauagccucccuacuguuaugagaaauaauucauaaauugugggaagaaauuuuucuucagauugcucuugacuuugggacauuauauguauaugcuuucugguggucauguuguaaaauuguagaugauucacuauuaggggaucaggauccacucuagccagaauaaacucaucacacuuugucgcuccuccuuggccucugccacccagugcucugagacuguugaugugauccaggaagcugaaugaacacuggcccccaaguuaggaagccugcaucccagacucagcuugaucucuuguaagcccaugguuuucucuccaacaaagaagaccacugaaauuaauuauuuucaagaucucuucuaguucugaagggagauaauuaguuuuuaaauacuaaauugguaccuacccauuguaauaaauaaauaaaggaauaagaaaagggauaaaguaaaaagugaaaguucuccuaccugccccuuagguccuaaaauagaaaauuguaaaggguaaaucucagggcuugaaaauuguugaggcaaucucuaaugauggcaagaucuagcucuguuaggacuucuaagcaguauucuuuaguauacucugcuauaggacagaaccauuugcaaggaaaggauguuaauuugggucucucucucccucuugcaauauggugccauuuuugaucucagagccaucgugccucauuucuaacaccuugucuucaauagucuuuuuuucuucuucuucuucaggugccuaaaaauuagcucucuuauccucucucucucuucuacucuucuuccuuuuccucuuuuucuucuuuucucccucuuuuugugcauuucugcagggauauccuaaaaauaacuaaacauagcucccgugagaaagaagauucauauugcagauugugucaguguuuuuuaaaaauaaaauaauucuguugguguaaucaacaaauauuuacugagugcuugcucugcagaaggcaucaagcuaaguacuagaauaaagugucaugaugugauauugaaacaauauuugcagcaggccagcucaguucaaagugaaagaugagggagaauucuggguauccucgaaccuggcacuuuuugcugagcucagaagacccagguguugaagagacugcuuuuuacaagcucgcagaauaaguguuugagaaaugugaaauuuagguccaccguuggccuucuuucugaggccagucucaaaggguuccccauuugcccuuagcucuugacuugccuucucuuggugagcagggcagcucucugagcuugagugggcugugauguugguugcugacuuuugucccuuuuguaggcuucauugaugggauuuagacucaguugcucauuggauagggaaucggaacuggccauucagaaugagggaguuucaucucuuggguuauugcgguuggaguaaucacuuaucagagccucugcuuuuuugugaugguuagaguaacaugcuuccugccacccuacagcauaccaggagacaggaggccuuuucuugugccaagguuuauuuggagcuuaucuguauuuaugaucuuuuccugccauuggcuuaauuacacaacuggggaaauuuaauuaucaaagaacuuaauaacacuaaagaacuugccgugugccaggcacugggcuaaacacccacuggcaccugaggcaagugcuguuaguccauuuacagcugaggaugcugaagguuggagagcacguguuauugucagggucacuuugccagugagucuugcagucagaaaucagccuuggacagcucgacucuagaguucacgcccuucaccuugauccuucuggcaucauccaucucugcagccugacaucuaacagauuuaggccucauuggccugucugugguuacauugcauguaccaguggcacccagcagcaaagcuauuucugagacacauacagagcauuaguugacuauauuguuucuccaguucaggaucaugcggauccugccaugauuauguggaaagaguuugcaaaguagagucaaagcauuugguccuguugcuaggcuuuucuaagcuuccgucaacucauaugugaaaugaggacaaugacacuuggugcuuaaauuguauaacauaugaagcagagacaggcucacauauaauugauucucuguucauuuaauuuccuuucccuuuucccaguugacucuucuuccucccuccuccuauuucaugauuuucucucuggcugucgcaguaauucaguguaucuguucccaggcuguaguuccaaguagcaagaauaaagcaaaacuagauguguuuucggcagucucaagcucucacaggaaguuuuuguugugucuguaagcugugguuggaucccacaccggguggaccaucuuuccuggagugguggagaggaaggagugccuagccaggagacagauaugucaguaucuguaaggugaccuacuaguggaaaacacucuugcucuuauuugccuuccuccuggcagcccgguuucuucaucaucagcagcccccuuugaccuccuaugcccuuacucgugugguuuaacuggagcuugugaaaaugaugacuagucuauugugcaucuggcugaggcauuuaauccacuguggagacacccuuauuagaggaaauggaaugcaaguuaugcuuaucauggggauaguguauuagggcccauccuggacagcuuguaaaagaauuaaugcuggugcgguggcuuaugccuguaaucccaacgcuuugggaggccggcacggguggaccacuugaagucaggaguucaaggccaguuuggccaacacggugaaaccccgucucuacuaaaaauacaaaaauuagcugggcauggcagugcacaacaguaaucccagcuacuugggaggcugaggcaggagaaucgcuugaaccugggaggcggagguugcagugagcugagauugcaccauuguacucccaucugggugacagagcgagacuccaucuaaaaaauaaaaauaaaaaaaaauuaauuuacaaccuuuucugcagcaggauuuccaggaaaugaacugggaaaugguggcaaugaaugaugacaauaaaugauggcaaaugcauguaccauccaacuaugauuuuguuucuuuucaaacuauuaauagcaccagcuuucagauccaugucgggcccuccuucucaaggaacccuugcucagcuuaaaucugcuuguauuguaaacuugaaauaaauauaaaaaacaugggaacaaaaaaauacauauuuuuugaauuuauucauuauucacacaguucacuaaaucaaacuagcauaaucucugcugguccacaaacaggaucacauacauuuacaguuuuuaaaagauguugguucuccuuuuauuacauacuauuugaucucuuuaaacuccaguguucucaucuacaauauggccuaauaugaugauaaagauaacaugcuagaagugaauuuucuuucuuguaaaugaaaaacauaguuuuaaauuuccaauugcaacugaagggccugauuuggcauuucucaaugucuuacucuuaguuuagaauagguugcaauuauuguucuuuuuuagccaugacaccaaguuauucaucuauagcagcuuuucucuuuuuuuuuugagacagagucucgcucugucgaccaggcuggaguccaacggcccgaucucgguucacuucaaccucugccuccuggguucaagcaauucuccugccucagccuuccgaguagcugggauuacaggcgcguacaaccacgcccagcuaauuuuuguauuuuuaguagagaugagguuucgagguuucaccauguugcccaggcugguuuugaacuccugggcucaagcgaucugcccuccucagccucccaaaacggucggauuauaggcgugaaccaccgcacccagccgccuggaauuuuuaagccucaaguuuguuccacuuugaaugcaagaagccaccugcuccucuuucugucaucaauuuaauuguuuauaaauuggggcuaauaacgauuuccuuaggccacuauauucuuuacccagcuaguuccaaguuguuuuguguguguguguuuuguuuuuguuuuuuguugguuuuuuuuguuuuuguuuuuguuuugagauggugucucgcucuguugcccgggcuggagugcagugacacgaucuuggcucacugcaaccucugccucccgaguucaagugauucuccugccucagccuccugaguagcugggacuacaggcauacaccaccaugccuagcuaauuuuuguauuuuuaguagaggugggguuucaccauguugcccaggcuggucuugaacuccugaccucaggugaucuuccugccucagccucccaaagugcugugauuacaggcaugagacaccaugaccagcaguucuaaguuuuuaucauugucugacccuauuguaaaaugaguuuuuaagagacugauuuguaagagauacagaauaguuuuaaguuucauuuauucuuuguaaaugcaguuuugggaaauaauucuuuugagggaacauauaucaucccccuuaauccuguauuacugauagcauuuguuugcuuaaagaguuuuuuuccagcacacaguauuuaugcucauuuuuggauaccaaaugaauguuaccuaaauuagugaaacuuuaauguuuggcuaaaaugagccagaaagcuguuucuuuaaacuuuagauccuauuuaagaaauagaaauguauccgauguuuacgauugcccuuuaauuuuacaagugaugaagagguagguauuuggcuuuuucaaaaauauugcagagccaaugccaucuuacuguucaaguguaaaaacccacauguggcagguguauuuuauaggcuuauaaauaccugaacuugcucacaggcugauuacuagacuuuauagaucgcuucaaaaagugagaguuuccuaauaguggauaaauacuuacccauuaauuuuuuuuuuaaaugugaauuuaaucaggaagaccuagaauagauucuuaccaaguucaaugugguaugagaguaaaucucacagcauaauuuaugaauucauauauaauauggcagaacugauagcuauaauaaacagcaaagugagagcauauuccuaauucagaguaucucauuuuccauuauuaacaauuaauggaacuuuccauuuuuaagugucacuacugaaaguguuagcgugcucaacaguaagcaggugaauucagaauguuauuuuaaggcaauaggguucccacugacagcaaaagucaaaggauggacaggaagcacacuuccuauuaguaaggggaaccaucaugaugaaacagauagaggcuuugucgauuguucucuccaacccuuugugcaaggcucugaugcuagguaccuagagcaaauguuucacaguguuugaaagcucagaaaaguaagggugaggguggagagaaguauguuguuagggaaaauugcuaaacucuuagauggacugauugcauucguuauuaaaagacuaacaauucauuuucaccuuuuuauguuuggagaauaaucaggauauuaguagacuuugcagaggcagcuuuguuguuugaucugagaauuguuugggggauggagaaaaggaagaagggauaccuugaggaaagcuacauccuuuauagagaagucagggcuguauguaagugaaugugcauggucagccaugguuugggccaucuuaauuucguggggugagggagauaugcuacagcaaacuguuccuuuuuucuuguuugcuuucucugcuuggaauucugauucuccaaauguugaguaauagccauuccaaauuagucaagcaauauuggaugggguuugugggguggaguaagaccuguaugacaagaccucugccuucugcucugagaucugacaccugcucaugccaccaucauucuccuuaaaauagguguaaaccauacaccauucuuucccaaggagacaacugcuuucccuguaagacauuuuuaauucgugaauuuuucaaguguucaugauguacaucaucuuucgguuuugaguauacuaguuguguguuagaaguuuaagauacaggguaugaauucugugcuuuaaggaauuucguaggaaacauugcauguguuaagacagauuugggauacauuuucugaggucauaagguguuggagagcugucauacuggaggauauuuauuccugggaaugacuaauagauuucaacugauggcaacuuagauugauugguaguggcuuccuggacugcuguguuagaagaauucuaaggguuccuaaauugaaugggaaauaaaucuauuacuuuagucugucacaggcaucagucuuauuaucauuauugcuauuccugguuuguauauucuccuuacaugaaacuaguuggguagagacuuaacauaagcuaguauuuagauggguuccgaacuuguguuccaagaauuaaaucaaucaaaauuaaauuugagcauuugccuugugagagaugcugugaaaguaacacauguucaaaguuaaaguguuaagugaaauaagaccuugaauggugaggaauggucaaacaacugcuguaagaaauacgagggauagaauaccaagccaagagucaugcaaaucagggauacuaaagaaugaggaagcagaguugguuuuauguaagcaaaagcaaauagcaggaaguguagccuuuuuaaagaaaucucaguaccacagccuguugggagagauuauuugugauugggagaaaugggagccaucagcaagcggaggggcuuggaagugauggauuuuuuucauggucuuuuucuucugacuccguucgagauuauaggucccuagaagguaaaaaucuggucuuucauuccacaaaguguuuuuuguuuuguuuuuuugagacggagucucgcucuucucccagguuggacugcaguggcgcgaucucggcucacugcaagcuccgccucccggguucacgccauuguccugccucagccucccgaguagcugggacugcaggcgcccgccaccacgcccggcuaauuuuuuguguuuuuaguacagacgggcuuucaccguguuagccaggaugaucucgaucuccugaccucgugauccacccgccucggccucccaaagugcugggauuacaggcgugagccaccacgccuggccuguuuugguuuuuuugagacagucucgcucugucaccaggcuggagugcagugguacgauuucaggucacugcaaccuccgccucccccuucuacaaaguuuuaucaagcugccccccaugugccaggcaccauauuaaaacaacaggacuugguguggacucugaccuugaugauuuuucagagcagaguaggaauggggaagggaauaauacuuguugguaccuacgugccucuugaaggaaguuacucuuuacuccauuauacagaagagaaaaaccaaggcucaggaaugucagcuugcccacggucagccaacagagcuagauuugaaucuaggucucucccacuuggaauucuggcuucuuuucaccagaguuccuauaaguacacuuugaucaagugguauauuuauaggucuuuuugauuuaauuuuuuucuuugcucagagcuagaaauggaauguucuuuuaguucuuuuuugaaagacacauuuaaagucagcuuuuuuaauugaggcauaauauauauccaaaaaaaguucacacaucuuaaauguccagcuugaccaguuuucacaaagugagcacacccuuuguuaccacuuccuagaguaaauccuucacuuucuuaaagugaguagaaacuaaccacaggguaauuuuuuuuuucuucacacuuuuuuuuuuccaauuucucuguccuucuuucucucucucuccuacuucccucuccccaaccuucuccccaccaccccacuuuuuccagcuaaagcauucucuuggacuucuugauaauauaauuuagucccaagaauuuucaugaagccaccugguguuggggggcagguaguacccugagguguaccccucuucugggaaucacuugaguuauaagaggguaaauguaagagugacaugaaucaugagugucaauuuaauucuauauuaagucacauccuagcauuuaucauauauaacuacaaaguaccggcuccuaugauauuuuaaagaacauacccauuucaaucuucacaaauauucucauuuuacacauaaagcaauagguauguuuaugccuuaaagugacuuaccuaaaguaauauacaaucuaguaaaugguagacuuccuuauacucauccauuuuuccuuaaaauacaccauagcugccugcguuuaccuucauucuuuguuaaacauaaguuugcaugcuuaaaaauaaaacuaaacuaagaaggacauaggcacaucagguuuguuauaggaacugcuuuuuauuucccuuucuuuuuuagaaaaagaaauuggauuccagauaauuguaguccuggaaauaggacaaaguuucauauuugagaaguuauucucacguuuccaguuauccuuaagagcuggucuuugcagccauguuuaguaucacuguuagcuugaagcuguugcaacugauuuucuuagcagaaccagaaguuccugaagauaagacacauucuuuauguucuaguuaauuaaagaacaaauuuuaagaacuucaggucaguuacugucucuugaguaacgcguguuccuaagaaauacuuuacaaauucucugagaauuggcacaaaugaaguucaagagaagugcaucuaagaauuugacuguucccagcuucugccauuagaacauccuuuauaguucggauuuuuuggcugaaggccugauucauuauuuuuaguuauuucucauguuuuuucaaacccaguaacacuaacauguugguauugagccuguccguacauuccugauuagaggcgccauuuaauuugauauuuugauaaagacugucuguggcaaguuguuguaggacuaauuucucugggcaagcaagacugaagaaaaaggaggaaaaugggaguuuaaucauuggagacugaaaauaauuuuuaauacugucugacuccuuucuggaaugccauauuaauucauguuuaguugaauccaugauaaaucuuuaaauguacguguguuuuauuuuaagaguugauucuaacucaggggugaucugccacuuugggaaacuuauacaauguucuaauacauuaacaauaaacauagaguuuuuaaguggaaaaugagaguauuuucuuuucucccuucauuuaccuggguguuuuggcucaccaaagaguuguguucugcaaaugucugggcaauccauggagcuaaacuggcauuagagucaaguaacacuccuccucucucccuguucuuuuccuuaaaaucuucaaaggcauuggggguuuuaccuuagcaacuugcuauuucgucuucuuaguuugaaccuucaaauauagcuggauauaauaaaaugcuccucaaaugaggaaguaccagaaagaccagaugcauggucucaugcuucccuugugcugggcacagaucuaaacaaaaacaauguuguguccauauuaagagcuucauaaauacagauggagugaaugaaugauuuaugacaguguagguuguggagcuugguaguaacacgcagaauucucagaaucaugccuguccguggaauaaaaagaaaacaacuuuucuuuguaagguuagagauuugaugggaaaaucaagaacaucuaaggagcuaaagaaagaaauuccuuauacccagauuguuggauguauuugcaacauuccucucauugucugacaacgauaaggauucuauuugaagauaauguguguuaaaucaagaaucugaguuuuuccuuggcaggcauagaggagaaagugaaaaaaaugaauggaagaagaugccuaauauguuaguuuuucacccuuggauccucuuuccucuuugcacaggguuacuggagguuguagcaggucauuauauuguuuuccuaauauguuuugccauuuauuuuguuugccugggaagccauaaaagugcuggugugagcuaauuauaacaaugcauggccaagucaacaaugacgucauagaagaugcugggcuuauaagaucuuaauggaacugagaaauuccuauuagcuaguggcaucauaccuguuauacugucuuggcacaaugcauuacucacgcauuuguggugaugcugguauaaacaaaucuacuguauugccaguuuuaugaaaguauagcacauacaauuauguacaguacauaguacuugcuaaugacaauaaaugaccauguuacugguuuacguauuuacuauacuauaguuuuuuuauuguuauuuuuagagugcacucauucuacuuauuuuuuuuuaaguuaccuguaaaacagccucagacagguccuucaggagauauuucagaagaaggcauuguugucauaggagaugacagcuccaugcguguuauugucccuagagaccuuccagugagacaagauguggagauggaagacagagauacugaugauucugacccuguguaggcucuaggcuaauguguguguuuguguuuuggcuuuuaacaaaaaaguugaacaaguaaaaaaaaaaaaaauagaaaaaaguuuauaggcugggcgcaguggcucacaccuauaaucccagcacuuugagaggccaaagcagguggauugcuugagcccaggaguuugagaccagccugaauaacauggcgaaaccuaaucuguaucaaaaaugcaaaaaauuagccaggugugguggugcauaccuguaguccaagcucccugggaggcugagguaggaggaucaccugagccugggaggucgaggcugcagugaguuguuacugugcuacugcacuccagccuaggagacagagugacauccugucucaaaacaaaaaaaggaaaaaggaaagaaaauauuuuuguaaagcuauauacaauauguuuguguuuuaagcuaaguguuauuacaaaagagucaaaaaguuaaaaaguuucuaagguaaaaaacuuacaguaagcuaaguuauuauugaaaaaagaaaaaaauuuaaaauaaauguaguguagccugaguguacaguguuuauaaagucuauaacaguguacagucaugcccuaggccuuugcguuuacucagcacucacucacccagagcagugcccagucuugcaagcucuauucauuuuaaguggcccacagagguguaccauuuuuuauguuuuauauccuauuuuuacuguaccuauuguauguuuagauauguguugauacacaaauacuuaccaugguguuacaacugcccauaguaaugugauauacagauuuguagucuaggagauacaggcuacaccauauauucuagguguguagaagguuauaccauccaggucugcgugaguacacucuaugauauucacucaacagcaaaaucuccuaauaccgcacuucuuagaacguaaccccauuguuaagugacucaugacuguauucuaaagagugcucuggucccuggaaaacgauggauuugauacucuagaucucauuucuugcagaccagaaagcuggcuuuacuggaacuuuuuacugaguccucucugcuucauguaagacugagacuuuguacaggguuuacccaaguaucugccuugguaggaauuggagaaugcucuuagugcuugaacccuagaugugccaagauuacuugaggaaaagaauguaaaacacuuagcaucaagaaguaccaauaaaugguagcuacuaguuugcuaaaauuaauuuucccuuuucuucagccuuuuuuuacccuuagucccaggagccaucaaauuuccuauugcugaauguguggcacccaggcuugugagagcagagggcuuaggaacagcagccugugcuauggaagcugggucucuggcuggccccaugccucugcugacuccaagcccaaggauugaauuuacuuacuuugguagcugcaacuuggcaaauauagcagcuuagcccguuugucagugaggggagugauugcaggguagaauggagaccuaccccagaauuagacuugggguggucagcagccuccaacaaugaauuuauuucauggcaucagcccuaaggcucugugcuguaucccaccguucuuagucaugaauuggaaugaacucaggaagcauucaugcccagguguucucuggcagacaauaaucauauaauaagauuguuuugaacuugcuguuaaaaacaaugugaggagcuuccucaugaguuuucuauaugaaaagcaggugguguguauaaaaucccaugccuuuggggagaaacaguaccgacguugccuuagcaaacaucauugcucuucuucgcugggugcuuccagaccaucagucagcucaggcgucauuucuggucaucuuuccugaccucuaggcaggacuuuucugcucugggcucccacagaacacuucucuuuaaguacccaccacauuguguggaagcgaacuguuuucucauuggauuucccaccaugacacaugccccuggaaggcagggaccuccguguagucaccucggcaaauccgucucuuagaccaacaccuggcaugugaugggagcucaguccauuuugcuguaguugaacggagaacuucaccagcucaucagggggcucuuuugcucauguaacuacaguuugaguuuagauccacucuuaugagcacacgguaagauauuuugaugcccaguggcaaacagugcucaaguugccacauauggucauuuuucucagacauguacuuuccugacuccccagcccugaaagguagcaucaucuaaaacaccaacaacugauaagcuuuauuuuauauugguugcauuuaucuugcuacuccuugaaacacaggccuugagggccuuugagauguaaucuucaguuucccccaccccucuaguuggauuaauagauuuauguagcuguugaacacaagcugccuccgaaugcuuguguuuuaacucaguaggaacccagcugaucguuccgaaagcagcuuuuaagagaagcugauguccugugaacacguuagcaagcugucauugugacuuugucagcaggcuuaucucagagcaucugcagacucauuuugagauugccuaauuauuuauacacgagauuucucuccuuucuggugaugggcugagaugaagcugguucuuaaguacggggaagauauauuaugaaugcuuugucauuaaaauaggucacuuuucuguuuuccuccuauagcuaguauuaggaaauuauauuucucccaacuucuagaguuguaaaacuguauuuuuaaaaacucaccuuuccaguguuugcaaaaugugagcacaacauauacuacugccagucuaaaaugugugugcauuuagacagauaauguaaauuuaauccuaguaagugcuuauucugaagaccaucuucucucuagcguaaaugugugcuuaucaguauagaauaaauguauucaaagaauaggagaguaaauggcccuuuauucaaauugcuuucauuuauuuuuuucuuuuggaaguagugaaagcuuuauuaucaaucacuucauuuuucaccagcuucagauuuagaggguaaaaaaaggaagcauuugggggucaguguuuugaaucaaaacaaaucaggaauugauaaaaccguaguuuccugacuauuuacugaccugauuggagucauauucuuagcuuggaagagcuguguucauucauuuuuuuuuuuuuccugccgucuggguuuaguagguaauguggaaaccaucuaccauaaauacauugcugcaagauaacaaauagaauuggaaucuaugcuugcauuucccugaguuucuguuuuuuuuuccuuacauccugcucugccuggcaaggccagucacgugcuuuuuaggacguuuugugcucuaacuuaaaaaccuucaugggauccacagccauucacacauuuuaccaaaccuagaaaaguaacagugggaaaauaaguucgaauucaacuuguacaggucuaacuaaacaauggcugaaucaaaaagagccuucucaauaugaaaauaccaugauucuguuacacagacugcauuuguaguuuucuuucuaauccaaugcuuucaugcuuucaagucccuagcuccuucuguccacugaguuugcaggauugaaacuagaaaaaagagugaacaucuagaacauccccaggcuggccuugccugggacagugugccagccagcccacaggaagguacuuccuccaaagaacagguucaucacacauuacuucugagagcaaggaaauaaggguggagaccccaguaugggaucuuggaagcccccagaauguauauggcuaauuugaaacuuugguuguuaaaccaccacugugacaccucugauuuugagguggguccaugggagacaacaggaaguuauggaaagaguauacacuuuggggucaagaaaaauuaaguagccacuccuggcuuugccuucuggacaaaugacuuuaucuuuuaucuauaaaguggguauaacaaggacaauaaucacuuagaaaguauuuugugccaugccuuauguucaauaauauucuuaccuaugagguggcuucuugcauucaaaguggaacaaacuugaggcuuaaaaauuccaggcggcugggugcggugguucacgccuauaauccgaccguuuugggaggcugaggagggcagaucgcuugagcccaggaguucaaaaccagccugggcaacauggugaaaccucgaaaccucaucucuacuaaaaauacaaaaauuagcugggcgugguuguacgcgccuguaaucccagcuacucggaaggcugaggcgggagaauugcuugaacccaggaggcagagguugaagugaaccgagaucgggccguuggacuccagccuggucgacagagcgagacucugucucaaaaaaaaaaaaaaaaaaaaagagaaaagaagcccggcaaugggcuacaaagacacucuuggaaagugcugaaucugagauugaaaacaaggccugcuuuagauccagagcucaaguccuuagccaauaugaccuuucagauugcuacaaguguucauugaaauaaagcaggaacagugccuagcacagauuccagcacacaggagaccugcaguaaagauaaacccacuuuggcacuuccacucgugggggagagcagucagcccuuagcuugucccuuaacaguaagacugccacaccaucugaugcaugacuaccagcuccuuuugaaucuacucggaaggacaaugugcacgcucugugcccugcuggauaugguuuaauuuucucauuucuacaagcucuagguuacaggggauaaagccacaugcagcuaguauggacagaacaacuaguucugguugaauuauucaguucuuaacuggcugcagcuuugggaucuuagaaacacaguccuuaaccuugcauucuuuccacuugaaaaauaaaauguaggugcccagcagggaaauuccauggacagaauagcugucaaguaggggcacuucuuagagcagggaggaagcugagcaagugggggugaagggaaacauggaggcagaggcuggggggcugggacccuggguggcaagaagcugagcacagaucaucauucucccuuagggcuagaaccugugaaccugaacccuucauugaggggcacugaauuuagaaggcagcucuucuguuugucgcuuguucuuucucucaauguaauuaagaagacuuugaagaaggaauauugugcuaaagccuagauaagaaccuguucuccauccaccuccccaaaucccuaaagccuuguuugauuuuaauauuuuucuuuuggauuucacuuugcugcugugugaaggggcagcagguggggaggguagagaggaggguuccuggggaagcagaaacccuuauggaaacccauuuuuaaucuggaugauggcucgguaauguaagccgugagaguuggcagaggagugaaaacuguaggauuaauggccuugggccuaauucccugauaccuuuuaaaaggccagcuaaccagcuggcuuccuccuuuugcuccauauacacucccuccucccuuaucuucauuguuuuuugcuuucuuuuuuggcugauuuuuaacuccuucucugaaucugaaagagagaguuguauguauaugaugauuuguguuaaagaugcuuagaaauuaauauacuaaaggaagcucguaauaaaauacaaaagaugaugauuugcauuguaaaguaaucuggauuuuuuuggugcaaguugucuuuaaauagaaacucuucuugauuugugcaugcaugugcacacaugcacacacauccauagacaggcauaagcaugugugccugaaugugaguuuucaaguuuaaacccuuagaauauguguuuucuguguagguagaaaugaaaucccacaaauguuaucaauucuugugagguuccagguaaaauauacaugcaugaccuucucuacguuuuacaacauuacugcuuuccccaagugcccguuuaucuguauuucagaaacccaugugaucuguaaaucagguaggccaauguggaaugauauaucugugugcugggaucugcaugugggcugcuggaaguuugaguuugcagguaaugagcguuacuuuggaugcgaacggaggcacuaggcagggagcaaaaaggaggguaacuuacuccagcaaaggaggacaugauuaguguuuccagcaugaaaccuuugaagugggucagcaggaaaggaagaaaaagcaaaaacauccagacaugggagaaucagaacauuucuuguugccuagguuauucugguagacuuugaaaugccagucccuauuaguuugguggguaaacauucucauuauuuucuguaauuggcauuauuauuggaagguaauuaacgacaguaacauuuucguauaacacucagaccuggaugggucuuaaugacuucccuucagucuugcgugaaguuguuuucuguuugauuuuugagugcuugaaacuacuuaggguucuggcugugaguggacucugcuggcccugcuauguuuuauaauauaauugcauugaccaugccugucaaauugucuucauucuuucuguccuagccuaaugccuggccagaacaggugcccaauaaaguguagcaguuauugcagcauuugucaacuaaaacauugaaacccguuuauaacuccuauggucaugacugguuuauguccguagacaacgcuugauauuuuuggauuguagaaugcuuuuaccaaaucagagguaaaccccacagagacccuauuagagccgagcccaagcaagccagauguuaucaaaucacucacuguaacuucacagccuucccugguucacgaccauuuugaucaugucaucuaagaugacaucaugaucgaauugacaguggauuauuaguucacccaucagagguugugacaauuugauacagcaaacccagaagcuuauagacauuguauuugccaguugaugcuuaaucuaaucagccuauuuauauucagugaaacucucauaucuacacauuuccacaucuauuuuuagcuccuuuaucacuuccugucauuuccucuugcugucccucaccuccucaaaugaggugccaggacuaaacuggacauugcgagaagggaggcggccuuauuuagaguguguugccuauaacacauuuaauuugccgcaguccagaucagucgcagccucucuaacuacaaguggcagagguggcugucuugggaagaggcacuuacacuguccauucucugcuuuuaaacagggccugguugugguuggaaggauguggcauaacuaauucauagucacuuuaaauucaguccccaaagggacguaucucucccggguuacuuaaagaggaauuaaaggcagggagcugaugggggugguguugggggaucaagugauacuaggaauauagguacaaguaagacugucguuuucauuguuuucucuuuggacugauucuguucauuauaacagcguugugaaguagaggugggauuaggaaccuucugcuguaaucaacucccuugcugcccaaacaccagccucauacacaacaccaacaggaccagcauggagggaaauauuccaagggguauuuacucugcuggugucaaagaaaaacacaccuguaaucucagccacucaggaggcugcggcagaaggauugcuugaacucaguuguucaagaccagccuggacaauauagcgagaccucaucucaacaacaacaaaaaaaguaaaagaaaagagaaaagaaaagaaaagaaagaaaaaccaaaaccagagagugauuagaguaguaaaaacagauuuuagucaggaacuauugcaguaggggcccaauucugaacauacuugaacaaguggggauauguagccaaaaggcaggguuaggggucaguggguagauagccccuaaaagggagcaucagaaguaaggaagauucuugcuaaacagaccuaacaggagucgugcugaaggcaggccagggugaucagaucucaccuggggaauggugagagaugaugaauuuggugagauaaccagcguggggauucuuucucaagugauguaacaagauuuuugcuaaaacuaggugauaacgggucuggcaaggauggacuuguaagaucgagaccuugaggacuuagaggaaccugauuucauuuaaucaaggagggagucuuguuacuggucacugucucaucucagugacucagaaguacagcaacaguggcaagcguuucacuugcucaaagcgugguuaguccaggcugcagcgaaaggcggaaggcaccagggauugggacaagcucaaguguucagcaucacggggguuuagcagccugcuugagugcaaauaucuugaauugauguuacugugcccuauggaggucagccuggauccuucuugccucacugcccaaauuccauuuucacccagcaauccucagagguuuccaaaggccuuuuguuucuucgugccauucucccuguaagcuuuccauauggccuuggcauggaacagguuuauccaacccugugguauuaacaguguggcuuuuguuguucuuggagaccuuugcuucuguccaaauggcuuuucugugccucaucuguugauagauuggaaaaugcucauguuuuucuuuuacuugauuguacuuagaauauuuucguuauuuauuuagcagagaguucacuuggaaaaggaagaugauggcauaucguggauauuucuguucugaaagaaauaaguucaaggaaagaaaaagaagaguaugaauggaagauuauucauccaucaauccauucuugccuucugugcacacgcacauauaccuauacauucauauauaauguguacuguaauguuucagcuacucucucaggaauguuuagaaaugaaacaguaaacacaauuuuaaauguagaagaucaugcugauauuuuggaauaacauucaaaaccaaguucuugauuucugucucuucacccuccccaauauguugcuucugcaguuuucccccuuaguaaaaagcgagccuuuucucugaguuccucaggccaaaaccuugccguuguccuugacucuuuucuuucucucauauacagccaacucaucugcacauccuguucauuguagcucuaagauauauccagcauucaaccaguucuuaccaccuccacugcugcuucuauggugcaagccacaguuaccucucaccggaccauggcaauagccucucucuucuucccugcuuccauuucccaccuuggcccaacuacaaacucuucuccacacagcagccaccaggggaauccuuuuaaaggauaagucagcucauaucucuccucugcucaaaauccucuguggcuuuccaucucacucacaguaauguccauauuccucacugugacauacaggguucuguaguuugaugcgaccucccaacccucuucuuccucagcagucucccaguugacaaguauucuccaaacagcagcagcagcagcagcagcaauaguagaaguagaaguaguagcagcaguuuucuuaccagauucaagcuggcuuuugcuggcaagaauccucaugucauauguauccuugugagaucauugacuuugggcauuguccuaggugaaugcauuggagccuuugcugacaaguccuuaagcaucacuuagcaguggccuguguaguucugggguguuuggaaucuuucucugcauguucaaugcucaggagguaaacuggaaacagaaaccacugucagaagaaggauggagccaaccucuaccaucaguggacuggugcuaagaaaaccuuucuugaaugggcacgguggcucacgccuguaaucccagcacuuugggaggccgaggcggguggaucacgaggucaggaguuugagaccagccugaccaacauggugaaaccccgccucuacuaaaaauacaaaaauuagccgggugugguagccugugccuguaaucccagcuacucaggaggcugaagcaggagaaucgcuugaacccgggaggcagagguagcagugagccgagaucgugccacugcacuccagccugggcgacagagcaagccuccgucucaaaaaaaaaaaaaaaaaaagcaagaaaaaagaaaaccuuucuugcccucacuccugcuuaggaugcugccuuuaaccuugguccuuagaguggguaaagcucuucugaauauuuuuuaugugaggagggauaaaaagguucaauaaacgcaaugacaaguggugcugccccugcauacaacuguguucagugacuucuuuugaguucauaggaaaagcauauuuacauauauugaauccagggccaugauuuugaucacacccacucugucuuccugacuuagagcauuuuuuuuucacucaagggcauucucaacaaaggaguauagcuuucagauuuguaaacugccaccuuauuauccuauuagucaauuacagcugcucaagagcaggguaagugacaguauggcagauuacagcaauuuauuugccauucucauagucuuguuuggcauaucaucaggcuguuuaaauuuaaugauaggaguuuuacauguguuuuagagcaguuaaaguuguaaucaaaauguuuaggaaaaccccuacugaccugcauaaaugcucccuucuucaacguugcuuguaaagccucauuguaaucuugauuaguaaaacugacuccaauuaggaaaaggaacuuauuuuccaaagaaagaaaggccuuuugguguucuuguguacaaagcucaggaaagauggggcugauggaaauuauuuuccuugaguuggcccuugugggcaaaucaguugcauuuaaauaagucaccauaaauccccugagaaacuugguagagucugugggaacagaagggccugcaggccuggucacaggauggggguguauagcauggcacugggaguaguuuggaggaaggaggaaggagagcuguggguaaaagaggagaaaauaauugcccuccauuaugucugguucucuuucaagcuaacggugauaguuauuguaguagcggcugcacugaaacgaaaaacaucucuaaaaagaaaaguugagugcuuuuauagaaucuuuagaucuuacaagaugggaugagaucuuggaggaccugcuaccuugaacuugcucacaccuucaccuucacugguggaaaugaaggacuauuguuauuaauggaaugaucaagagacccgaaccugggaauacccaguuuauucuuugcuucccuaugcuaagaagcuaagaauacugucauugucaacaacuauagacucucuucaucuuuauugaacucucaaggugcuaugucauuuggaaagucaacauugcccugccuacuaugaguuuaauaugcauugcuucaagccaauguaagaccagaguuucucagccuugacauuguugacauauugggccagaaaauucuuuguugugggggcucuucugcgcauuguaggauguuaaacagcaucccuggccucuacccacuagauaccagaagcacccacccauuccccaguugugacaacugaaaauaucucuagaaguugccaaagguuucuugggaagcaaaauugcuccugguugaggaccacuacuauugacugauccaaacuuuauauuaucacuugcaaauaacuuuugauauuauucaaauaacuuuugaaucauacaaacuuuugguauauguuaaaaaauauuuagugaaucucuacuguauguaagucagcacagaaaccacugaaauaaguuacuauucuuacucuguuguccagcauagacaguauguauugcauguugauguaaaagauacaaugccaauuuuauaguaaauuuggggggacaaauuuuucaugcauuuugaucauauguuuucugaaagcuauucuaagugguuuugucagggaaauuaucauuuuuuucauauaaaaacuguacauugugugccagaacccagcuauagguuuuucagaguuggcagaguaauuaaaucgcaugguuauucuaugcuguaaagugaaauaauggagauguuguucgaauuuuccuauguaguuagaucucacgaugauuuuauaacuuuggcacauugcuuuccuuccauaauauagugccauuguaugcaaaguaauuuuuggauacuguuuucugaggauagaaagggaggaugaacacaucuaaucugccagcaauaucaaaacagguauaugaggcacuuuuucuguguauagccaugcugaugacuaaaauugcugaccuuuagguacuugcauaucauuguggagguaaaacacauaucuuucuauagucaucaaagauuuauugggcuccccugauccaggcucuguacaaguccccuaggauaugaaaucacaugagaaauaacucuagcuuuuuaaggaaaauauggucuagugcuuauagauuaaaaaaaugcuaacaccguuacaggcuauagagcagagagucccugagcuaaauuuguugaauguguuuuaacucacgguguauauuuuaaaaacuugaauuaguuacgguguggauuagggugauaaauagcuaggagugacagaaaacucaaggaaauaguggcucaaacaaaauagaaguguauuuuucacucaccugaauuuagguagcucaggccugguaacgaggcuccgugaucaucagggacccaggcuccuucugcuuuguugcuccaccauuuuaaacacauaucuuacaugcuggaguccaagauagcugccccagcuccagcuaucacaacugcauuccaucucauagcaaaggaauggagaagggccucucccuuggaaauaacacuuucuauacccucuuacguggcugcaggagcuccuggugaaccaccaucagggcuuggaaugugcuugguugaccguaggaauaucaucagauuagguuuuugcaucagcgagaaagauugaguacauuaauagcagaaagagcacaggcaugggcaggcugagguuugaagauaggcagcauuacuuacuauaauaguuaagggagcagaagguaagugcuaaaugacaacauguauuagcagaauucagacaaaggaugauagcaggggcuggagaugauauggaaggcaaauggggaggagguggaacucgaacagaucuugaauaagcagagaaauagggaaucccaagagaguccaccguaaagagaaacaucagcuucuggcuuccuuagaugccauguuuuaagggcauuuagcuaaaaucugagaucagaaaauggugagguuccuggguguccagcaagcauucagcuuucucuaggccauuuauagaacacuuaacuaacccauguuguccuuucuaggauauauauauauauaguggugugacucuauguggcaauggccuuugggguuuugcagaaugagaacuauuauauuacuuuauucagccgauuucccaagcuguuaagcaaccaauuuugaagaucugaaacucaugcugucuccauccacaaggaccaugaaucuauaugaauguaauuguuuuauuuaaucuauuauuauaucaucuaucauuuuuauuuucaccauaaucuugacacaguucauuauagcauaaaaugauaaccucugugaaaaugacuucauguguauuucuaugaacugcauguuugucuggguucugcaagucugcagacuuuuugcuuuuacuauguucuuaaaaauuaguggucugagaagaggcauuauauuuauuuauuuauuauuaauuauuauuauuauuauuauuuuugagauggaguuucaucuuguugcccaggcuggagugcaauggcgugaucucagcuuaccgcaaccuccaccaccuggguucaagcaauuauccugccucagccucccgaguagcugggauuacaggcaugcaccaccacacccggcuaauuuuguauuuuuaguagaggcaggguuucuccauguuggucaggcaggucucaaacucccgagcucaggugauacgcccgccucagacucccaaagugcugggauuacaggcgugagucaccgugccaggcccgagaagaggcauuauauuuaaauauaauagucuuauuguauuuuaucaguuucuugauaauaauccuuuaaauuauggauauuugaucaaaaagagaggucagauaagcaaugagaaagagagaaacuaaugaauagaaagaguaagaaagggggcugggcauguuggcucacaccuguaaucccagcacuuugggagaccaagcugggcagaucacgaggucaagagaucgagaccauccuggccaacauggugaaacccugucucuacuaaaaauacaaaaauuaucugggcgugguggcacgcaccuguagucccagcuacucaggaggccgaggcaggaggaucgcuugaaccugggaggcggagguugcagugaaaugagaucgugccacugcacuccagccuggcgacaaagugagacugugucucaaggcaaaagaaaaaaggguugaagauguuccuggaaacauguuuugcuugaugcaaacuccuuacaaaauauuuuuggaaaauuucuccugccuuagucaaggagaaggaaauaucucagagucacguaaauacuauucugaaagaccuaccuaaaaaaauaauuggccaauagauaucuuagaaaauuaagguauggucuagaacauaaacauaacaauauuuguuauauauuacaaauaaaagacaaaggugaucccauuuuaugacaagaaagcuuucuugguugaacuguuaaacagaggcuauaucgucaauggcaugccuacuaugauuuauuucauuccuguuauauagaugcauauuaagguacagaaagaucaguuauccugccaaaagucaccuagcugggaacucauaaaacugggauucaaacucuggccaucugacuucagauucuaagcuuuuuuucuuuuuuuaaaucuuaagcuuuuaaccucuguccuauauuauuuggguuuuccagcuaggaagauugaagcccuugaauaauuuugcccauuuaagcaccacuucauagcagguagaaaccaccccuucugaaauugacaaaugggaauggacauaauugccuugaacauggaaugagacgaacaggcagauggcagagaucuaggaguuucugcaggauuuugcccagugguggcugaugacuggguaaauaucuaguuuuuaucucuaaaguguagcuuuucuuuggaauuugacauuuuggugcuuagccaacuugcaggagaaucauccgucacauaaguugaguaguguggcaauuuguuuuaguagcuauuuacuaagucaacaaccuaacugcuuugucuuugaaaguaggaguauucaugcucauuuauauuugggggacauagcagguagcaccaaguauuugugucaucaaauugacuggcaugccacuuguguaguaguauuucuaguagagcucccacuggaauggaaagaaacuaacagaacacuggaacccuagugaauagcauucaccaugagaaugaauucagugcaguauaaggugguuuccauuuuguacuacaucaaagaggauuuaauuccugaaauaccaaaaaacaaaacaaacaaacaaaaacuuuauucugaagccagcucauuuacaagguacaauuuuauauauacugcuauuuuugcuauuuuuugcuauuuuuugaucuuuauaugucagguauuuaguaaauauauucaucucauucgugaaguguuuauuauuuguuccaucguauacauuuuaaaacugagauucagggagaggucacacaauuggcuugcacacagucaugcaacuuuuaacugguauuugaaaccagguucaauaggcucaaaauucuaagcucauuccaccauacucuaggaucuccugccagcccuugauuaaaggucaaagggccaauguccacuggagcaguccacagaaaugcuggcuuuuacagagauaauggaguugggaagcccccagguguacauguggauuauagugacauaugagagaaggaaaaagauuaaugaauucuuucauaggauaucuacuagggagaagcucuaaauuuccucagaauaugugaauggcuaucaaaaauacagagacaggacaggaagaaaagucuugguggaacaaguugguaggagucucuugaagaacuucaguaucacauuuuaagccaagaaauaguuuccccuccucuaaugguauguuaccauuuuguaccuguaggaggcacugacaugugucuucaucacugugucucaaagaugacauucuagauuucuuucuuucuuuuuuuuuuuuuuuuuugucuguuacuuuccauuuucagggaaaaaaaaaucuauuuuaggguuuccuucuccuccccugccaguacgguuaauauugccagaacaacuuuagacuuuagauauuaagaaacauuggcuuaauaugacaauuugauuuugcuguuaaauuuacauguaaaucucuaggcaaguucccaucuuuugauauuuacuuaaaauauuuacuuucacauguauacauggcacuuggaaggaaugcauuaagaugaguguugauuuauuugcuuuauucuuuaguaccuaauacuuucuguccugaaaugaauuagagggaaguuauuauauaaguaauuauuuaucuugaagaguauauugauagguaggcuguaccuugacaccauuuucucaccuucaacaguguaugguagcuggauguuuuggauguuuucaaaauaaacaccuauuuguagcuauguuuuuagauucaucucuaaugcugcacucacgggaaaaaaucagcaggccuguauuaacuagaaaaccacuuuuauguuguauuucgauccauugaaacuaaagcugauuagcacuuuuugaaaagugauucuaaaucuuugugcuaaucaagggaaauugagccagguugcugcuacagaaagcuggagagaagacgggaugugauggcaaguuccuuuuucauucauccugcagcauguagcugggugcuauacccaccccuuucccaacaaaccacucuccuaagugcuuguuuaauaaagcagcacagcaggugaauauuuaaguguuagugggauucacacaguuucauuucagugcaaugaacagaauagaagagaauuugaggggcggggggcuuuuuucuagcaugcuguuaagaaaaguauagagacuguugcacacuaaugauacaacgguaauuugaagcaggauguguuugaugugcauuugcugugcguguuuacuguaaucaguggcuguuuauccuugggugguaugaagccgacugcccaccuucuacauuuggcaguaaugauugcaucuaagaaaaagcucacuuaccuccagcaccuccaaguggcugcagacuuuaacagcuggacagccugaagguaggcuugacuugucacagauuucuacucuuucccaagcaaugacaccaaagggauauuugccaaucccuuucccccuucauucuucuuugggggcuuuugggaauggaagacucuuucuuguuuuccugcugucugggauggaguagcagaugccaaggaauggcguggagaaaggagaggaagguaugauaauauuuaguuuucuucuuuucaugcuuaaacagauagaaggaauuuucagagcaaaaucuuguuucaaguguauggccauuuuucaauuaaagucacuuauuaaccucuauguacauaagcagaaucuccugagucucucugaagacacaaagagaaaagauuuccuuccucccuccgacucucuccaaauccccaagugacacucauaagcugguugagagggugaaaagcucacaaaugugaaggcagaagucacuuugcaccuuucuggcacgaaaacuuugaagucuucuuacagaggaacuacacuguguaauucaaauuuuuaaaauguacauucaagucggacugcaguuuaccugcuaaugcuguuagacggcugccuggucuaagcuccagcugaucuguggucucugaaaagacagccacacaaagcugcuugcauaguucccuaccacuccaaagggcucuccaggugcacuucguuacaaggauugcuucgcuaguggacuuugcugacauuagcucuaguuuggguuugucuguuugccugcuaugaagguauugagggaucuuagaaagccagaaagaaaagaguugucaacagaugugccuuuaggagagagacugaguggacucaaggauuagucccagccuuucggaauugucuguggcuguuucauagcugugaugauuuugaugagcuuuuaucauugcuuuuccuggcagcaccauccagggcaauaaggauaagccuugucggaugguuccugaaauuacuuagaaauaaguuguaaucucaagaauugcaguguagcggccaaagaaguuuuacaagaaguugaccaggggaugaugucaaacaaauggaaccuuaaaaguugacuuuuuccuccucaaaggcugggugcccaggacuaguuuuaaauguuccgauacucaaaagaaaaauucaaaucacauaagugaacccucuuauuuauuggugaugucagacaagacuuauaccucuggggugugcuagcuggguuagaaccccucacugaauauugaguaugcauuaguauucgaacauaauuucuuuucauuuuuuucaaccuugauauuacaugggcuuaggccuuucuuucucccagacaacaaauucucuuugaacaaaaguaugaugccguaucauuuuuuuucuuucuuuuuuuuuuuuuuuucuuugagacagagucucauuuugucgcccaggccggagugcaguggcaugaucuuggcucgcugcaaucucugucuccccaguucaagcgauucuccugccucagccucccgaguagcugggauuacaggcccccaccaucaugccuggcuaauuuuuguauuuuuaguagagacaggguuucaccauguuggccaguaugguaucggacucuuguccucaagugauccaccugccucagccucccaaagugcugggauuacaggcaugagccacugugccuggccgccauaucauauuuuuauacccagaauaccaaaaaaaagugauaggcaccaaggacugauuuaguguuccugcuuuggagaaaaugaguugacuuaggguaccccuacagcuucauaguaaugauuuguguccuuguucuacccuggggaauuuuacugagaugaauuaggaauuaguauggggauggggaggaaaggagccuuaaucauaguggcauuaacaggcaagaggaaauuaaaguaggacugcuagacaccucucaaccaaccaaucaaccauccugccacuugccauucaaaguuaacuaaacgagcuggacgugauggcucacgacuguaaucccagcacuuugggaggccaaggcgggcggaucacuugaggucaggaguucgagaccagccuggccaacaugguaaaacccauucucuaccaaaaaagacaaaaaaguagcuggguaugguggugcaugccuguagucccaacuacucaggaggcugaggugggagaauugcuugaacccaggaagcggagcugcagugagcugagaucaugccacugcacuccagucugggcgacagagugagaaccugucuaaauaaauaaauuaaauuaaacaacaauaaaauucuagcucacuugguuuugucugguuacagguuccuuaacagguguuaaauggcagaaaauucccaauagauugaucagcacuugacuuuuucguaguauuucccaccagaauaacgucuguagaagcuacucuauccaggauaguccugggggaucucuggcagaauauaaauauuucugcugugugcagcagcagcuguagcuuaggaggagcaaugggcguggguuuugugguuuccuucugacuuuucaggguagcucaucacuucgaccacaaaaucacugccaaccuucagaagagggaagaaggauuggccaaccuacauuuucuuuucuuuuuagggacaaacagugacuugaguuuuugcagaccagccggcuuaguuguguuuggaguuucccaauauagucuuugcagaaaugugaguugguuuuuacguugccgcaaaccaaucaucugcauuacaauuggccuuaguccuggaaccacagaggugguuugcuuuaccccuugacucaaguugccuaauuucugugucacuaggaagaaccaacaccucucaccagcccaugaguugugagacaguaagcacugaaaugagugaugaaugcgggguagccauuuguuaaaaaccaggagucauuuauucauucauucaacugguauuuauguagcccuccuaaaugagucaggcauugcuccaggagcuguggauacuguaauaaacuagaucccuagucccaaauauucuuuuuuuugaaguuccagauaguaaauauguuaggcuuuguaggccucaccauuucuauugcaaccauuaaacggugacauuuuuucuuuuucuguaguagcagccacagaaauacauaaaacaaguucaagcugcguuuuuuaaaaaaucuugauuuaugaaaacaggcaaugcaugaaccauaguuuaccaccucugaacuagaccauaacuugcccuuguugagcauacauuccagucaccugcacuugauuucuacuagauggcuuuauuguauaaggaagauauguucuuaaauacuacaccuaauccaaaacaagaguaaugcaaaagcguuaaaagaugcauaagguaaaaaaauccuaaaaagguuaauaggucgauaaacccaacaaacaaaagaguucauaaaagagucaaaacaggccgggcacgguggcucacaccuguaaucccagcacuuugggaggccgagguggguggauugccugaggucaggaguucaagaccagccugaccaauauggugaaaccccaucucuacuaaaaauacaaaaauuagccaggcgugguggcgggcgccuguagucccaccuacucgggaggcugaggcaggagaauugcuugaaccugggaggcggagguugcggugagcugagauugugccacugcacuccaaucugggugacagagcaacacucugucucaaaaaaaaaaaaaagaaaaaagaggcaaaacauagcaauauauauuuuaaaacuuucuggugacucauugguuacuaauuauggaauacguuuuucuagaucuuaaacauucauaagaaaacaaaaucaucuuuagcuuuugaugaauugaccauuccuuuaauacuaugaaggcaguaggaaaaccugucaugaacuucagaaaucuaacaauuuuaagaacacuccaucccauuauauacaaacuacugcaaacuccauaaauaauuuaaaggaacaaguucauaaaccuggugaauuuagaaaauuggucauucagcacgcugucuuuggugaauugaccauuuguugauuugguagcuuggcauguugcuugaagcaaaugaaucuagaacugguaagcagaguucuacacacauguuguaacuuaaaaugcucuuuggaugaauggccgaauacaugccugggaccaaacuugcuuguagaaugguauuuauuguuuagguuauagagguugucaaaaauucccacaugguaagggaauuucauucaugauuaugcauagagaauuauugcuccugggguucaaaggcuaacucauuauuuucaggcuuacugaagguccaggcuuacucauuauuucccccuaauguuuuauuuauaaauuaacauaaauguuuaaacauguagaaaaguugaaagacucauccaaagcacaccuuauaugguguauggauuuugaaucauaagugguaggcuguuuccaaaguggcugaaauaauaccaacucaaaucuguuuuaggaccacaucuuuuuaggagugaccagagacugaucugaacuauuucuaguucucuuuuguguuuuggggggaaaaugcauaaaauacuccuuaacucuagauugugcauguucuuguaguugcuuggucacucuuuugaaacaaaggccagugaugcccauugcaauugcuaagguaugucuuuccuguauucuaauuucaucuaauugaugcauaacaaaaauucaagagguuagugucaccauaaccugucuccuuccuccugccuguauaaaguaccauguggaucucaggaagaauuuacuagcuacaaaauaaaauauagaauguagucuuccacauuauagaguuccuuuuuuuuuuucauguggaaaggaaugauugagggggaaaaugaauuguuugacaucuaaccauagaaagaaaaauuaguuuucucuaacuucuccaggcucuguuuuuguuucacuuuacguucugugugcuacuggucuggggagaaauuaugacaugaaagggaguaguuucccuucagaagauucacucacaauuuaauaguaaucacaugucugggaaaauggaaggguuagaaauauuuuccacaucuuuuuugguagucaccugcauucugauaaaugcuacaaccuauucaucacugaguguuuuguuugcuguugcugccuguaggaugauauauucuugagcuguugacaucuagcuguauuaucugcuuuggccaaugaaaugagagcucaagucaccugugccaccuaggaggaaaagcuuuaagcgccauuuuauggcuucaccauucucauguuuccuucugccaugaaaacaguaacgucucagaggccaggugcucuacagcgugggucucaccaugaagaaguggagcauagcccacagccaacccucaauggauguguuguugaaagccauugaagugauggggucauuuguuacugcaacacagcccacuggcaugacauccucaucauacuguugugccuguuuauaguucucagguucuagaauggaaucacuggaagauucuaaaccuggacuuguggugaugaugagaauaagaaagggcauugagguaguugcauuuacagcacuggauauucuuaucugcagagauugguuguucuagaaaucuuucuccuucuuuaaugcuccucacuucagcccuuugagagauuuuaagcugaaucacaaacaacuuggccaaccuuaugccaggucaucuaauuucuacaacaugguuuguguguuuaaugauaaaauaagggcuccaugaaggcagagguuuguucuugaugguguaucucaagugccuggcacacaguagaugaccaccaaauauuuggucgaugaaaugugcuaugucauuuauuuucaaugaguuuuuccuuugauuuuauuuuacugaaguguauacucaggauaaucacauuccuuuuucugccucuaauagaaaaucugacucuggauaguagguugaauauguauuuguuuauuuauuuagagacggagucucacacucugucgcccaagcuagagugcaauggugugaucucuauucacuauaaccuccaccucccaggcucaagugauucucuugcaucaaccauccuaguagcugagacuacaggugccugccaccacgccuggcuaaguuuuguacuuuuaguagagauggggguuucaccauguuggccaggcuggucuggaacuccugaccucaagugauccgcccaccucggccucccaaagugcugggauuauacgugugagccaccgcaccuagccgaauauuuauuucucuaaauaaauugacaccacaagugaaaucaccaaggggcauagccucaguuuauuauaaccaaggugucuuuaaucacuugaaauacuaguagucuuugcguaauuuuagggagaaaaaaacauuaaaacuuguuguuuaacagaaaaaguugacugugaacuaguacuuuccuaaaauucaggauucugcuugacuuuugaauugugucagaaaggaagcauauauaccaccauauuguacucacagccucucugagccaugacauugauuuaagcgggaggggcugcuauauuuccacagacuuagcccauucacucauuuccucugcuuugucaucguuagguuggauuuaaguagcauuacuguaaaauuccccacugagaaauuucaacaugaaguggcuuucugaucucuuuaaaauaaaaugguuaaaaauagaccuugugggaacaguuuuccacuucaagaacaaaacccugcaaaaauguuuuaaugcagauuugggaccuaauuauuuuuuucucaccucagcuuggcuguaguugugcuacaguggagacaacaagucucaguguugcagaaucuggccagaaaaugcucuccacucccugugaagguuuccuauuggguuggccauugcuuacuucccuuccccucccuggagcuuuucuugggguggcggcuccaacuaugaagagccuacaucugguuccucauuaauucagcgacuucucucaugaggcuagggaaggccugaccauuucaguugcgccggccuccgguuuuugcaaacauuaaagucugcacuggguaaagaugaacugacuaaaaggaaagcagcgugcaaaagauacucugucauuaacauccagagucuucaagguacucagucauuagggcugguuuaaucacgccucugugacaugaccagagccuuaguuagcuuugaggcacauccagggguucucuguuagaaaaacggguuccuggcuggccauaucguuuucuuauuucaaugucauccuuuuuucccacagccugguagcugaaaugucuauggcauuucagcuuacuugugacauuccuuuacaauuuuguuguuuacuguuguaguucuaauaccuuagaaagauggccuccgacuuaauacgcgcuuccguaaauaucuguggaagaaugaaugguaaacaaaugaaucuccaaucacuagugacuaguaauuguuuaauuuugugucagucuucauuacuuuccugccugauaggaaaguaaugagagagaaaacacaaaguguuaagaucuuuuauaaauagaugcuaugccaugccccacaucucccauuuauuaucauuauuauuguuauuuauuuuauccuacguccuuaccucuagcagguagaaaauucuuuuuucaaaauaguaaauaacccaaauucuauuuuaucaacaaggaauggaaugcauuucuuaaaauucccauuggaccacauauguggaacauuuuaaaaaagcaguuuuauaagcauccauccuuacucucugggucuggagucuaguauguuuuaaaauaaauuuggguguuucugaaauaaauugcucuguguuucugccuuuucuguugcaaaguucuaaauuauggcauacucuuuugcauucucucuuuugacacaaguacuccuuguuucucugucucuuaaguccugucauuuaaaauucauuucaagugucauuuccucuggauauauuccuugugaguuagaugcuucucugucccaguauaccccgauacacucugaguacacuuccacauagaguauuuaucacccuuuauuguugcuguuugauuaaugguuagacuauuagacucuuagugccccuaggccaaggccugaauauuauuuaucucuacauauugggcaucucuuauaguuucuggcauggauaggugcucagaauauuuguugcaugaauucauuuguguucuuuagguucuaaggaaagcuucaguucagcuuucagucuucagcauuucucuuuucacuagccaguugcccucuucccugccuggaggguuugaauuuagaaacugguucuacccacugcaguaagcacccacggucacugcccacugcuugcauggggagaagggccagaugggcauuugcucaucuggaaaccuggaaucuuggggccugaucuauguuuuuucagcuuuucuuuauauucuucucuguccuuuuuuucuucuucccucaacuccucuccccaaagaugguacuuggcaacggauaauuuuugcuuacuuagaaacuugaauaccguggaaaucuaacaaauaaaaaugacccugaaaagucucuagaaugcauugggaggauugccuaaaacaauuuugcauguggaauuagcaguuggggcucugaaauuacaccuguuauuuuagaaacaagaggcuagaaggggcaaauacuaaggcuucuuccuuugccauccccuaccuuuauuauuuuauuuauuuauuuauuuauuuauuuauuuauuuauuuauuuauuuagagagguaguuucacucuaucacccaggcuggagugcaguggcacgaucucagcucacugcaaccuccaccucccggguucaagcgguucuccugccucggccucccgaguaucugggauuacaagugcgcaccaccaugccuggcuaauuuuuuuuuauauuuuuagcagagaugggguuucagcacguuggucaggcuggucucgaacuccugaccucaaguggucugccugccuuggccccccaaagugcugggauuacaggcgugagccacggcgccuggccccauccccuaccuuuaaaugaucaucuuaggcggcugauuuccagccuucauaucaacucacagagaagaguaccaauauuucuauugccacuguuuuuuaacgucuaauccauagaaaaccugaccaacauaacaauacuuuguuccuucaagcugcaguuuaaaaucuuuuauuuuugcaccuuauauguguagaaaggagacuaucuggcuaacacuauugucaaagccgcuaauggacaguuaggaagaaggaauucaggaaaugaaacagugcugaaaacugggcaguguuuaagaugcagucaccuguaucugugcuuugacacuaaagaagauggaaaaggaauauauuuacuaguuucuucuaucauugguauuggaauccauuuggaugaaagacuuucugaagcucacauugucaguaguaugcugccuagauuuuugugggcacaugaguagcagaguagaucaauugaggggauuauaugauagcucaucuaucaaauuacccaggauaauugaggaaaaggauuguucuuuuuuuuuuuuuuuuuugaggcagagucucacuuuguugccuaggcuggagugaaguggcacgaucucagcucacugcaaccuccgccugccagguucaagcgguucuucugccucagccucccaaguagcugggauuacaggcaugugcuaacacacccagcuaauuuuuguauuuuuaguagagacuagguuucgccauguuggccaggcuggucuugaacuccugaccucaggugaucugccugccucagccuucccaaagugcugggauuguagcuaccacguccggccaggauuguucccuuuaaaaagauauaauggaaaaaacauuaaagaucuaaauugucauacaaacuugacaauauauauucauaauuaugcauuaugacauacucuaccaaagccuuuuuguaccucucuguucauuucuauuuaaaaaagaaaugaccauuuaaaauuaggaauuucucauuguuagaaugaacuagacuggcucauuauacccaaauuuacucaccagcugcuuugcaccuacacuaaugcugaggcuaacaagagugaaaaggauuaaaguauguuagucaaaggagauaccuaagaaauucuccuaggccacuuuguagcauauuuaccacauuacuugucuuuucaaauggaggaagauagccauaguauguuauguuuuguuggcauuuuaaacaaacaaacuagaaauaccaaauaaaucuauuuugaguguugauaaacucauuuuuuauaugaauguugaaaaucaccccaauccuauugggaugcauaucuuuagaugucacuuuaacucucuccuuuaaagugagacugggcgcgguggcucaugccuguaaucccagcacuuugggaguccaaggcgggcagaucacaugaggccaggauuucaagaccagacuggccaacauggcaaaacccugucucuacuaaacauacaaaaauuagccaggcgugguggcaugcaccuguaauccuagcuauucgggaggcugaggcacaagaaucacuugaacccgggaggcagagguuauagugagccgagaucacaucacugcacuccagccugggugacagagcaauacccugucucaaaaaaaaaaaaaaaaaaaaaaaaaagucacaggacaacauuggucuuaaccauacuugcuaauuuucuccauuuucuuaaccccucucaacuucaugggaaauuguaguuucguugucagaaagaaguuugcauauauagauuacccuuuuaggcaacuauuaugaauugaccaauccacguuuuaacuguaagaacucagucuauuugggcugcuaaugaacaauagaaauuuauuuuucacaguuguggagacucagaguccgagaccagggugccaacauggucagcuucuggugagggcccucuuucagguuacagacugcgggcuugucaucguauucucauguggcugagauggugaagaaucauucugcagucucuuuuauaaaaaagauuuccacccucaugaccuaaucacuucccaaaagcuccacaucaucaucccaucgguauuuggguuaggauuucaacauaugaaauuugugggagacacacauucagaccauagcaaauacuaacacucuuucucuuuaacuucucccuaacccuugaagaaaauuuagaaucuauuuauuauguaaaaaucccaucuuggcuuccucaacccuaaacuggacaugcauuucuuucuuuuuuuuuuuuuuuucucugcuucaguauucgcuuuaauauguguuuggagaucuuugaaagugauugaauaguagaaaaauuuacauuauagaaauaagauaccaaaacacauuguauaauauugccauuucuuucuuuuccauuuugugaauaaucaaaauaauaauuugucuugaauaaaagauaaauaacaaaaucagcuuugcuuuaaugcugcacaauuagcagcuauccaaacauauuaucagaaacauauuaaaauccacauuccauauuuuuagguaacaacacacugugcauugagauacucuucauuuuguaaauuagguaaucccccuaacauuugauaguguuauucugaguucuuaucuguagcuauacagucauugagcuggauaaauuguugcaauguagcaauuaagaacauccuuuuuuuuuuuaauccacaaguucaguaaauuacaacuugauugucugaguaaacaauguuaccugcuguggcugcuuucuugaagaacagaguucugcaugcaaauuaauagcaguuaguaauucccaguaugauagagcauacucuucccauagcuuaaacuucccuucauccacccuaggaaaacagacuaagugaaauauguaucaucaucuuauuuuuucuuucccucccucccucccucccuuccuuuuccuuuucuuucuuuugaaacagggucucacucuguugcccaggcugcaguguaguggugugauauagcucacugcagccucuaucuacugagcuacugagcccaagagauccuuccaccucagccucccaaguagcugggacuacagguacacgccaccccaugcagcuaauuauuauuuuuuuuauuuuuagcagagacaaggucucgcuauguugccuaggcuggucucaaacuccuggacuccagugaucgucuugccucagccucccacggugcuaggauuacagccaugagccacugagcuggcuuauuuuuucuccaauuccuuggccccaggcaaccgugcccaccccagcccuacccuaggggauacuguggaagcaguuuuagaagacaagccucagagugccugaugaccccucugucucaccagugcauuuagcaguaccuuacugaagcacacacaaccuaaccugaccaugguaacucauuuucucauuagggaauagaagugcuuguggaccagagcccaccuagccguucuugcauugggguaacuugugguauuucagugaggucccgcucuuguguacuguauaugguucagugucagauaauuuaacacccaagaaaaucugccuugcauacauuagaauauauuugcaaauuaauugguuaauuagauuuuagauaucucuaggggacugagcugaaacagaugugugcaaaagccccucacggggaugaggauaaagucuucuuacaggcuuucugaacgaagaguucuaucauuugauccuauuguuggugccagaguauuccaguacaugcauuuauguugaaagaaacaguacugcauuuuugucuugaaguuauaggaacaugcucagaagguuccaugcucucaaaauaauuguacuguaaaauaaugaaaacacuauuaggguugauuuuuuccuugauuauaucagaaaaccaugggagaauacagcuaaaacuaaacaagggcagauuagggaaggcuuuuaaauacuucuguaagaugcaggcaaugcauaggaaaauucuauacaacagccaaagauugugcucaggacuuggaguuagagaucagcccuuuuuacauuuuuuucccaguuacaucggcuagagauuugcucuuuuaaccuuuuuucucucuauugcuuuacccuucugcagaauagaaacucaguugguauuccccugaaugcuguuuauaauacuaaggugauguuuuaaauuggaucauuaaaaaauauguuuuuuauuccuucaaucuuuugugugugugugugugugugugugugacaaagcauuuaugguauacccacugaguccugauguggauacgggacaccaaguagagugauacugucccugcuuucaacaggcucccaaucccuuuauccuuuguggaaugguaaaguucaucuguauuuucuaacacuuggaguaggaagaggccuccuacucuggagcaaguugcaugacaguaaaauaaauguggauggagcuaaggacugauuaugaaugagccauguguccacaauucacucuaggguaaauaguacagacugauggacaacuugcuagaauuuggaaacaaauggugcacccaagaucaacaucagaccccuccuugcuccuucuacuuaaugcccguugauacacugauuuuuagcucagaggaucaccuuuguauccccugugccuaggaaagucccuagcaaauaacagacuagcaucaaauguugaaugugagcagaugcucagacauaacaauucucagauguuugaauaagagagaccuacaccuuggcaaucacagaggaaaguuauuggugggagauguguuuuaaugccacugagcauccaauuuuaccaugagauuugagagauaugucauuaucacaucuaauuccuucaguuuuaguuuuguuuauguguuaagagaaaugagccaucacggaaauaauugaauaguuuggucaucuuuagaugaaguuuuuucauuuuccuaauuuuuuuuuuaaaguaaggagcaaagucuuaaaacuacagaaacaacauuuucauuugaaaucaauagugcuucaagguugggggacauugauucucgcaacagggguagcaacaucaccucauuguuuucuuccuuugucucucauagaaaaaugaguauuuuucugaaucuuacaaaguaauucaugauccaaaggacuauuugauuugauuuuuuggaacuacauuuauuaaaaguacuacucaccuaacauuaccuuauuucaaggagauauauaugugugaguguguguguguauguaaauauaaauaugagggaaaaugaauguuuauggcuaaggaauuugaacuccacccuuccuuuucaaguagaauccauuaaaauguagcuuaaugaaauaggauuauuuuaaaaucaggaauagcauuuauaugcuagagauuauugcguuugacauuaagauguagauaguauaaagugauaaguuauauugagaaugaacuuuguuccugcuacaucauccuucaauaaaagccaguauugccagaaaaagaaggaaauuuacuaaguguguuuuauuugaauuuccagucauaguuuaggacaaggagguagauacuuuggaggauuuaaaaaacuucugguaauugacuucaucaugcacuugagaccagaacauuccugugcauccuggacucagagaguugaccugucugccagccccuuagccagcucugaguugaagcugagcuuacaguuuguccuuccaauccucugcgccaaacaaauaaaucacuauuuaugggcaagauugagcuucaccaccuauuggaacuucuguuccaguauuagagauuggcacauugguuuucuuucauuaaauucuuccucaugguggauauggaggcaggcuugggcaggcucacugggguucacagagcaaacuggaggacaugggucuggagagaagccucauccgccaaaguggggcagacacugggugggggccugugggcgcuggcgggaaguccagcccgccaggcagaacacacacagcagggaacauagaguugugcaaaaagugagauuuuuggcaggcacuuggcuccggggagguccugggggccccaggccagguuaguggaggaaguccaggaggcagccuguugagggcuggcuacuccacaucagcauuaauguggccuggcaguggguaucaggcccugcucuaugggcuggaauuuuggcaggacuucaacauuuguuccgugacauauuuucauaguaacauaccccuuggucgugaggauguguggaagaauauauauagccucuaccuaccucuacugcagauacuaccggcacugacuugucucaugccucuaaucccagcacuuugggaggccgaggugagaggauugcuugagcccaggaccucaagaccauccugggcaacauagugggaccucgucucuacaaaaaauaaaaaaguagccaggcaugguggcauguacugaggucccagcuacucaggaggcugaggugggaggauuucuugagccugguagguugaggcugugguaagcuaugauugugccacuccacucuggcuugggugacagaaugagacccugucucaaaaacaaacaaacaaaacauuuuuaaauuaaaauuaaagaagcugaccagccauauuggcuucaaugauucccaacaccaucccugaaaaacuguggccugggaaauaugaugaugugcuuguggcuuauacuuagaucacaugcugcacccuaggaguggugaucagucccaccuaagccaaagggacugaguggcuccccauaagggaauaggugagggaaaggaggauagcaauuaucuaaggugggaagccacagggaugccacauacagaggguugcagcugaaaucgccuuagccucucuugaugagguuguuaacccugguguagggaucauuugcuuggagaaaagaaugaaugaacaugcugguggcugguggugaucccuggagccaaguuccugagccuggaauauaaaguuaaggacuuugugucuggaacaagggaaauuccagcuguaagaagcugagacagauaauuaaaagugcuuauggcauuagucgugugcugaagcccucaauauugagcccaaguuucucagggcuucucuauuagaaguaaacugguuucuagaaccggggguugaauuaaacuuauagaugaggcagucaugcaagcucauaugaugaaacacauaaauggugguguucauacacauugaccauuaccaggcugguugguugauagguauguuuauguucagaaaaacaaacagccuccgaacugcaaaagagcuuuuuaaggaauaaaagcaaagaaugaagagggcagggagaaaaagguauuuagaaguggguagaucugaaggagucacagucucuuuguagauugguaggagguuaucaaggcuuucaucuccaaguuuccaauccagccagguuguuggugacuaaaaaucauuuuccugugaccauuugcuguuugguggaguguuuggaaugagcuaguuaaucccaguccaauucauaaugggcagguagccaguucacacaaaccaccuugaaaauccacacuaauugguuugucuccauggaauagccaaaaauggaauugcccauggacggacauuuucuucuacccaccccauucuuucaucucuccccacucccaccacuaccucuagcaggagugauuuuacauuuaaauagcaucucuuccccacucauuuuccugggcuauaaauuuccucaagcuuuuuuuuuuuuucugagguggagucucacucugucgcccaggcuggaguacaguggugcaaucucggcccacugcaccuucugccuccuggguucaagcaguucuucugccucagccucccaaguagcuagaacuacaggcacgcaccaucauguccagcgaauuuuuguauuuuuaguagagacgagguuucacuacuuuggccaggcuggucuugaacuccugaccucgcgauccacccaccuuggccucccaaagugcugggauuacaggcgugagccacuguacccagccuccucaagcuuucuuuuuuaaaagaaggaguggcuuagaggcaaggaaaguaaacugaauguccuugagacauuuucagggucaccaauguuuuuagaguuggucuuauggccaagaguagcaagaaagaaagcuaucugugaacagaacaaaaugcacuucauuuuuuuuuuuuuuuuuuuuuuggguaggccagggaagcaaauuccuagacaaagauucauacaaccugaaaauaguuucagacagaucuacuuagacacacaaaaacuucuaacagcucacagaaucaucgucaagaauggcuaaucaugcacuacugggagauacccaacaauggauaaaauucuagguuuccguaacuuugauagcuaguuccugcauaaaucaucacacuuuacaccuguacagucaguucugugccauccccacuguccuugagcuugguuaauucucugggcauuucuaagggcaagugggauugauaguauuugcuccauuuuauaaacaaccuguucagucggcuggcugggcagccaguagcucauuacagcacguuugugauguggagcugguuagaguccuggcuguguccuucaccagcugugucaccuuggucagccacuuaacuucucugugccucaguuuuuaucaguuaucucugaggugaagucucugcuuaauugaaaauuauauuuugaauuaaaaauauuuuuaguauuuuucagauuuuaauaguuuaacuucuuuguuugagacugagucucacugugucgcccaggcuggagugcagugccgcaaucucagcucacugcaaccucugccucccggguucaagcgauucuccugccucagcuuccugaguagcugggauuacaggcacgugccaccaugcccagcuaauuuuuguaguuuuaguagagaugggguuucaccauguuggccaggcuggucucaaacuccugaccugaagugaucuacucaccuugaccucccaaaguacugagauuacaggugugagccacugcuccuggcuuaacuucuuguauguugagaauauacacaagaaagacaagccuccaugaaaugauaagcucuaauacccucuuccuuuauuaaugugauauugcucacccccuucucccuucaacugaugguaaauuaaagcaauauaacucgguguaaauauuugucaaccuagaugcauuucuagacuuucagucugugaagacaccugguuauuuacacgauuuauacgauuagugccaucaucuccagacaggaugaauauuguaauacaagcaaguuuugcuaugagucuugacagucagaaauaaauaaucuuaucuauaacuacauuugucuguagaaugaggaagauagggaacaaugagugugaaauucuccaggccccccagguuacaagaaggaugaaggaaauaaaucucucaguaaguauaagacaaaaggaagucauuucuaaguaaguccacuggauguuuuucucgcucuauaaucacaaagucuagauaccacugaauggaagaugaccucauaggcuccucuuuaccacugguuaaaaguaagggagaccagccugggcaacauagugauaccucaucucuucaaaaaaccuuuaaaaaauuaggcagauuugguggugcagaccuguagucccagcuacucaggaggcugaggugccaggauugcuugagaccgggaggucaaggcugcagugagccauaauugcaccacuguacaccagccugagcgacaaagcaagacccugucucaaaaaaguaaagaagauuuuauuugggucuucuggccucugugaaaaucuaauaagugggaagugaaauuuacagaggauucaagcaaaaucaacaaguguuuguauggagucagucagcucaucucaaacacaccuggcucugagauguucauuuggguuucugucaugguaauuaauuucugaugcaaauaaaugaauacuaguguuaugaacucuauuuuuuuaaaaaaaaacagcuucuacuuuuuugaaaaaucuguguaucuuuggagaagaggaaggaaguagggauuaucuagaccaagcuuguccaucccacagcccuugugccacaugcagaccagaacaacuuugaauguggcccaacacaaauucauaacuuuccugaagcauuaugagauuuuuuuuuuuuuuugcgauuuuuuuuuuuuuuuugaggcagagucucgcucugucgcccaggcuggagugcaguggcgcuaucugcgcucaccgcaagcuccgccuccuggguucacgccauucuccugccucagccucccaaguagcugggacugcaggcacaccccaccaugccccgcuaauuuuuuguauuuuuaguagagacgggguuucaccguguuagccaggauggucucgaucuccugaccucgugauccgcccgccucggccucccaaagugcugggauuacaggcgugagccacugcuccugaucgcgauuuuuuuuuaaagcucaucagcuaucauuaguguuaguguauuuuauguguggcccaagacaauucuucuuccauccuggcccaggaaagccaaaagauuggacacccuggucuagacuguucccaaaaaaggcaagcaaaacuuagugacagugcuguguguguaaaucacuggauaaggucaaggauacuuuuaauuuagggagaaagaaaaguguguaaaccuguuccuuagucugggaaagaaugaagucuuuuuaaaaauuuuucugauuuuuguguuuuuguuguugauuugcaauauacgcuuuaagaauuuuuucuuaacaucuuuuugcugggaccuauuucucagcguuguucucucccuuuugagaggacggaguagguauagaauugucuugcuaauaugucagugcaggaaaauuccauacaaccuguugccuauggaagagauuggaaugaauuguagcaggugacagguuaacugguagcagaaaccuuuucugcaacauguaaacaacuucauccuuuugaaaaucggguccagguaguaaaagcuggcagugauuuaugcugaccgggcuuagagcuccucauaugcauauauaaaauaccucugggcucugcggggcuucuuaaagaacuacguuaguucugcuccuuccaccuucuuccucacccugcguugcugacauaucugaagugcccgcgagaggaaggagcaggauguggagccaucuggagccgggcaggguaagcacaggacaagcaucugcuggaaacuuugcagagauaucuagugcgcugauuuacuguccuuuggggaguccauguacagaacccagauucaugaggaagccggcaucuggcaaagguugggguacacaauugugcuugauuaucaggacauaugauaaaucugucuaggcguguacucugugccagauuguggauuucuuauuuggcccgcaucagccgucugccagcaaagcaauacaaaagugucacaacaacaaacaaacaacaaacaugccaaaaaaaaaaaaaaaccuagacuuagcauagugauaucaaaauauacagagucaccuugaaauaaaacagugcuucugagaauauagaagugaagagcaugcacuuuggaaucagaccacuaccguuccagucuggguucuagugcauaguagcugugugucugggggcaagucacuucaccucucuguacuuguuuucugcucuguaaaaagaggaugauacuaauaguacuugccuuuuagaguuauugugagaaauaagugaagguuauauaaguaaaaaguuuaaaauagcaucuggaaaauuaagcaccauauaauuuuguguuuguguuuucuguggaguacaugaguaugcaucaaagcuaacaacgcccacugcccuguuagucaaauaccuuugaccauaucacuucccuuccuuccucugccaacaccuccaccacucccacccagacuggcuuaguuuccauuguuccuugaguguguccagaauguugcaaccuggggcucugcauacaugcuuuccacuucccgaauuauucuucccacagcucccuuuagggagcuggcuucuccucuguccucagcccucaguuucaaugucacuucuucagagagggcauuucugagcaccccaucuuuacugagaugccacuguccacccauaagcauucucacgcccaccuguuuaguucccugucaugauuuguagccacaggugacuggcauuugcaggacuucagugucaguaagccacagucuccacggaccacaucccauuccugucuaauuccccuuuguagaucuaacauccaauuccagcagugccuggauggaaugagcacucaguaaacacugguccccaguaagaauaagcgacucacugacuacugaaggaggugcuuuuauagaguggauucaauauauuucucccuucugagguggucaacccugauuccuccuaaucccaccagucuccacccguuuuauuuacauugucauaggaaugaaagagaaguuaaggaaauaaucaaauacuucuuuuagagaugaggugcagccucaccuucugcauuuggcuaucucuguaacucuuugguagggggcuauagagcaggaagcagggccuauucuuucccaccuggcugguucagugaggacgcuugccauguggaugugccccaucuacugguugaauugcguggcugcauucuuaaugauuguaaugcccuguccauucagacucuuuaacagcagcugagacugugcuagaguuuguaucacacuuuauuauccugcuggcaacaaaauuaaccaugaagugugauuugcuuacagagcgcaugauugagcaucucuagugucuaaauuuucaucagugucguacaaauucuuuuguguggguuuugaaaguuugaagcuguaaaguuucacacuaauguccguggcuuaaaauuuauaguuuaacaucaguuuucaccguuugguuuguccccugugugcauuauguucaccagauuugcaucauuuagggauuaccucucugcaagaugucucagagauaugagcaccacaaccauuuuuuggucuucucuugaggaucuggguuuuuaagacaaaaacuucaaggccgggugcaguggcucacaucucuaaucucagcacucugggaggcugagguggguggaucacuuaaggucaggaguucaaggccagccuggccagcaugguaaaaccccaucucuacuaaaaaauacaaaaauuagcugggugugguggcacguaucuguaaucccagcuacucaggaggcugaggugcaagaaaaacuugaaccugggaggcagagguugcagugagccaagaucaugccacugcccuccagccugggugacagagcaagacucuaucucaaaaaaaaaaaaaaaaaaaaaaaagauaaaaacuucagggagcaaauggcauuuccaugcucuccuuucauacauaccccccaaaaucgggacuuaaauugccucauaaagcucaauaaguaaauuggagaagauagacuuuauuggcuuacuuaaacauaauuauuuuaaaauaacaaacuagucccuguguugauaaauguuuuauaucuuagcugcuaugucugaaugccuuguguaaauuaugaauuagcuaguaaauggacuucgcaaaggaugcucaguggggccugucagccaagggcuaaguggauagccuuucugacauucuacugcuuuuuagcuguuguguuggggacguagaugucuguagucucauuguuagggcugaaagauauguuuccaugaggacccagcagaguaauaguuccaguggguagaugaaggccagaugauuuggaaauaagcucaaaauguccugugucgaguuuggauaauuuuauagcccacauaaaacauuucauauuaaagucaaaucguucgucccuauuuggacuaaugacagcugcuuauuucgacuaagaaagcugcuuccagcaucugagaugaguuguaucugaccuuuagccccuuuaccuguagaccagggguuacuaacucagaugccuacaggggccagguaagugauguaauaaaugaaucaagccagcucagcuucugcuaauuugccgugagggaguacagcagguccagugcugccaaaucuucccauuuuucaugagaugccugaaauccggauuuuggcaugaaaucucaugauuugaaaauguuggcaauuaauuuaagaaaaauguuuagauucaacagggacuaaaccaaauauaucugccagaaggauacugcuugugauucuccaauuugcaaccgcagauagucccuggcaaagauuaucuauguaauagauacucuuuccuuuacaaaggacauacugaaucaccaauuauuugaaauagauuuagggggcacaagugcaguugucugacauggacauacugcauaguggcgaaggcugggcuuucaguuugcccaucaucugaauaguggacauuguacccaauagguagauuucuucuucucucaucccccuuccacccucccaccuugaggagucuccaguauguguucuuucacucuguauguccauguguacccauuguugagcucccacuucugagugagaacaugcaguuuuuggcuuucucuuucugagucauuucacuuagaauaauggccuccaguuccacccauguugcuacaaaaggcaugauuucauuuucuuucauuuuuuuuuuuuuuuuuuuuuuuugagauagaaucuugcucuguuacccaggcuggagggcaguagcgugaucucagcucacugcaaccuccgccucccagguccaagcaauucuccugccucagccucccggguagcugggauuacaggugcccaccaccauauccggcuaauuuuuguauuuuuaguagagucaggguugcaccaugugggccaggcuguucccgaacuccugaccucaggugaucugcccaccucggccucccaaagugcugggauuacaggcgugagccacugugcccagccucauuuucauucuaugugugugcauggcugaguuaguaucccaugguauauacauacauaccaccauuuauuuaauccaaucauccauugauggacacuuuucauguugaaaagauguuaaauacuaugcauaugcauauaaucaaaauauauguucaguaaaaccaaaaagcuuccaaaguaacaaaauagacaguaauaucucagaagaauaagguuacuggacacauuucauuguugaguauuuuucuuuuggcucuugcuuuugauagaaaaacccagaagcaauauauguguauacaccaugaauguacauucaguuggguguguuauaccuuuaacuugcacuacccuacaaggauucaccuaacauauccaucuagaagaaucccccucauacccauaccacacuuuccagauuuccaaaucaggaguagugagaagaucaugaaaccaucucucaauuauuguuuucuucuuuuaaaaauacauauauauuguguaguugcugacuuauucuuccucauuuuuauucuacagucuccacuuagccucccaaggggaagguuuugaacuaguggcuggguuuugugccucuguuuuugaacacuaaguucuaagacacacgucagagauauuguguguuugguuccagaccacgaaaauaaaacaaagagcacaauaaagcaaaucacaugauuuuuucugguuuuccaguacauauaaaaguuauauuuacacuauauuguagucuauuagguaugcaauaacaugucuaaaaaaaccucaauauauauaccuuaauuuaaaaauacuuuacugcuaaaaaaguacuugugaucaucugagccuuuggugagccauaaucauuuugcuggugaagggucuugccuuguugauggcugcuggcugaucaaguggugguugcugaaagugaggguagcuguggcaauuucuuucuuucuuucuuucuuucuuucuuucuuucuuucuuucuuucuuucuuucuuucuuucuuuccuuccuuccuuccuuccuuccuuccuuccuuccugccuugccuugccuugccuugccugccugccugccugccugccuuccuuccuuccuuccuuccuuccuuccuuccuuccuuccuuccuuccuuccuucuuucuuuucuuucuuucuuucuucuuuuuuuuuuugagauggaguccugcccugucacccaggcuggagcgcaauggcacaaucucagcucacugcaacuuccgccucccagguucaagccauucuccugccucagccuccaagguagcuggaacuacaggcauaggccaccaugcccagauaauuuucuuuuuuguauuuuuaguagagaugggguuucaccaugcuggccaggcugaucuugaacuccugaccucaaaugaucugccugccucagccucccaaagugcugggauuacaggcgugagccacugugccuggcugacaguuucuuaaaauaacacaacaguggaguuugccgcaacgauugacucuuccuuucaugagagacuucucuguagucuucaugaaagaaucguuuucuccauagagaaugcuguuugauagcauuuuaccuacaguagaucuucuuucaaaguuggagucaauccucucaaccccugccacugcuuugucaacuaaguuuauguaauauucuaaguccuuuguuaucauuccaacaauguucaaagcaucuucaucaggaguagauuccaucucaagaaaccacuuuauuugcucauccauaagaagcaauuccucauccauucaaguuuuauaagauugcugcaauucagucacaucuucaggcugcacuucuaauuauagaucucuugcuaguucuaccauaucugcagugacuucuucugaagucuugaacuccacaaagucaucuaugaagguuggaaucagcuucuuccaaacuccuguuaauguugauauuuugaccuucucccaugaauuaugaauguucuuuauggcaucuagaauggugaauccuuucuaaaagauuuucaauugacuuugcccagauccaucagaggaaucaccaucucugucagcuauagccuuauaaaauguauuuuuaaaauaacaauacuugaaaguuaaaauuacuuuguuuuuuugagucaguuuuguucuguugcucaagcuggcaagcuggagugcaguggugcugucauagcucacuguaaccacaaacuccuggucucaagugacccuccugccucagcuuccugaauaucugggacuacaggggcaugcugccaucugggacuuuuuuuuuuuuuuggcggggggaagucuugccguguugcccaagcuggucucgaacuccuaggcucaagcaauccuccugccauggccuuucaaagugcuaggaugauauaggauuauaggugugagccaccaugccuagucuggcugaauuuuuugauuauagagaugaggucuugcuauguugcccagguuggucuugaacuccuggccucaagcauuccucccacuuuggccucucaaauugccaggauuacaggcaugagccacugugccuggccccaaaauuacuucuugaucuaugggcugcagaguggguguuguguuagcaugcaugaaaacaacauuaaucuuacacaucuccauuagagcucuuggguaacuaggugacuugccaacgaacgcaauauuuuaaaagaaauuuuucuuucuaagccguaggucucaacgguaggcuuaaaauauucaguuaaccaugcuguaaacagaugugcugucaucuaggcuuuauuguuccaucuauuuauagagcacaggcagaguagauuuagcuuuaaagcuaaauauacagcuuuuaaguuaauucuuaaggguccuaggauuuuuggagugguaaaugagcauuggcuucaacuucaagucaccagcugcauuagccucuuaaaagagagucagccuguccuuccaaaccuuuacaccagucauugauuucuguucccuagcuaugaaagucauagaaggcaucuucuuccaaucuaaggcuauuucauuuacguugcaugucuguuguuuuguaaagccaccucaucaaugaucuuauggauaacuugcugcagcuucuagaucaguacuugcugcuucaccuugcgcuauuaugauauggaaauggcuucuuuuuuaaagccucaugagccaaccucugcuagguucaaacuuuucuucuguagcuuccacauuucucucugucaucauaaaauugaaaaagccuuggccaggcgcgguggcucacgccuguaaucccaacacuuugggcggccgaggugggcggaucaugaggucaggagaucgagaccauccuggcuaacacgaugaaaacccgucucuacuaaaaaaaaaaaaaaaaaaaaaaaaauuuagccaggcgugguggcuggcgccuguagucccagcuacucgggaggcugaggcaggagaauggcaugaacccgggaggcggaacuugcagugagcagagaucacgccacugcacuccagccugggcaacagagcgagacuccguccccccacaaaaaaaaaaaaaaagaaaaagccuuacucugcuuuggcuuaaggggaauguuguggaugguuugcucuucuaggcagaccacuaaaacuuuuccaaaucagcaauaaagcuguuucucccucuuaucauucauguguucacuggaguaacacuuuuaacuuccuucaagaacuuuuccuuugcauucaugacuuggcuguuuggcaugagaggcauagcuuucaaccugucaugccuuucaacauuccuucuucacuaagcuuaaucaucucuagccuuggauuuaaagagagaugcggccgggcaugguggcuuacgccuguaaucccagcacuuugggaggccgaggcggguggaucaccugaggucggguguuugagaccagccuggccaacauagugaaacccugucucuacuaaaaauacaaaaaauuagccaggcaugguggugagcaccuguaaucccaacuacucaggaggcugaggcaggagaaucgcuugaaccugggaggcggagguugcagugagccgagaucgcaccauugcccuccagccagggugacagugugagacuccgucucuaaauaaauaaauaaagugagagacgugugacucuuccuuucacuugcacacuuguaggccauuguaggguuauuaauuggccuaauuucaauauuuuugugucucagggaacaaggaggcccaaagagagagggaggggaaauggcugguugguagcauagucagaacacacacauuuuucaaguucaccaucuuaauaugggugaguuuugugacaucccaaaacaauuacaguaguaacauaucaaagagcauugaucacaaaucacccuaacauacaauaacaauaaaaguuuugaaauauuaugagaauuaccaaaaugugauagagacaggaauugagcacguuguuggaaaaauggugccgauagacuugcuuaggguugccauagaccuucaauuuguuaaaaacaaaaacaaaaacucaagaucugcaaagugcaauaaagugaagcuaggcccauauuuacaacuagcugagcagaccugccacuuaguuugguguuuuagguuugagaugauuuccgacaacuuuacaugugcuuagcauccuaucaaagcaguggggagagaggauaugacugcuuuaucuuauccagaaugcagcaaucagaaaaccuauaaacaagccauuuuaaugucagcauagcauacauauaaguucugcauuuuaagguuuaguaguucauuauuugaauuacucauugcaaugggcaccaaaaucuuuucagugcucauugcuuugaaagauuucauuuauaccuauuucuccauauggcaucaaaacugcugguaaaaaaaaugcaagugaaguucagcagcaucuacuucagauucagagggcuauguucagguucuaguuaugcuucucuggcuauauaacucugggcaaauuaucacaucucugucagccuuggugugcagcugugaaaugggaccauaguauuaguguuacagauugugacacuuaggacgcaauacuguauguaauuagcauaguguucagcgaaugagugugcucucaacaguguggcuguuauaucaucauuaucauuguuauuucuacaugcuaagguauuauuuuauaaacauguuuuauauuauuggcaacaagccuuuccuuuaacacuuaccagcagcuuucuuuuucuaugcaggacuuugauuuaaagaugaaaaauguauuugguggucuuuaaauauauauaugguguguguguguauguguguguguguguuuucucccccuacugcccucuccaacuuuuucuuccaguuuuuuucuaagagauuagcagccuuaaaguuagagguggcaaugguuuggccuggucuaccuucacaauaugauccuuacuuugcugcaucggaggucccuggguagguccuguaaucccuaaauuagucuaggaggcagauggaugaaaauagugucuuugcuggaugaagcccaguuguggcuuuuccuuuguucccagcuccaauccaaacuaaugccuuaauaacugaaauucccuucuuuaccucucuuaccuuaacaacuauuagagucaaugggaaggacuugucaccauagcagaaagaugucaucuuagggcuucuccuggccuguaggaccucggcccaggccucauagcagugaguacuugaagaagggcugaggccagcgcuccugggcguucuuccugugagcagcuuccuccccugaguguaccaucccagcagaagcucacugcuacuucaucauaaggcugccucuuucugcaauuaagucauuucaguauuuucuaacaugguuuuccuucuucguagagaugcucaauguuaggacaaaacacaggcauucaaacugcucauagcauuuagggaguuagggaauuuggcuuuuaauuaccaucaaaaugugauuauuuagagacucagccccauuucuacagagccuguagaauuuugcggcaauaggaaaggggcuuauaaauaagugcuaaaaaugugaguugccagguuuccagggaagagcagauaagaugaacuagaacaacuugaaguaucuuucauuaacucuaaucaaguuguuaaggcucuuuucugaugcagcuuuacuaucuguaacgugggucaauguccguugccuuaguuauugcuuagcagguauguggaaucuggaaugcucugauaugaucaacauguuuaacugaaugaaaguguuuauccauccagacacgugauucuccugccucagccuuccgaguagcuggaauuacaggugcacaccaccauaccuggcuaauuuuuauauuuuuaguagagaggggguuucaccauguuggccaggccagucuugaacuccugaccucaaaugaucugcccuccucagccuccccaagugcugggaucacaggcgugagacaccaugcccggccucagacauccagucuuuaaucauuuuuccaggcagcauggaguccuaaccuuuguuuugcaaaccauccgauggauuuagucuacaucacagcaaaauauuuuugacuuuuugagaugacuaauuaugguacacauacuucguuuucccaaaaguacuuuaaauuucuugaugacuuuugcaucuacugucagcacugcucaaagcacugcauucugaaccccaguccugcuggacacuuagcgcuuagguuucagcuucguccccacccccugacuaggucaaguuccucuaccaugugugcucucacagaaccaugagucucuccuuggaacuacuauagcuguugauuuuauuauaugauuaauuauuuacuaucagucucccuacgcaagacagugaauuccauaauucugaaugguaaaggaacaggauuuuuuauuuugcccaccauuguauccugacaauagaaugccuggugcuuaguggguacguaauaagugcuauugguaaauggauggauggaugaaugaauggaaucucauugucuccugcaguauuuguuuuaugucucuucccaauuuuguccauaugggcuuaaagaccugcacacauaguagagacuccacaagcuuauuagggaacuaaaauucauguugugggucuuggcaccaaagccucaugauggauugggaaacuaagagucauauaaagucuuaggaagaggccuugaaguuucuauguuccauuggugguccuggcugagauaaauauagcaaaugaacaggcauuuauuucucaccuguucuaucaaguccccaaaaccuggaaguagugugugagauggggcugacccugggaaagauguuaucucuuauucagagccacauaaaagcucucuccccaugucaggcacaucuuugguuagaagacauaaauuagucccuugcauuucauagugguucucauggugucccucaugacagagcucacuuagcuagccaaugggacaucuccaaaaagcauuauggaaaggaggcaacgugcaauuguguacaauaacuuggguccugaagucacaaugccucaguucaaauuauacccaccugcuuauuaagugaauuuagacaaauuagguguaauccucaauuuccucuucuacaaaaugggagauauaaugcuacuuacuucauaggauuuuuggaagagcaaauggccaaauggacauaaagugcuuugcagagaguugggcauguaauaaguucucaauaaauguuagcuagaguuauuaccaccauuuuuauucauugaaggaguuucauugcaaucccaagccagucccuauggaugcccuuccauuccaacccuuuucagacuauacuggggcccauguuguccccugcccuuucagcccacaugacuuuggcccaggcuuuuacuaccagggcccaaacacaguguccaagaauggcaccaauuauacugcauauugcuguauauuauuuuauccagcacugugaaggccaaccugaacugccugaaaaaucuuugucauuuagugguuuaggguaugugcacccuccauacaaaugcauuaaauaaauuaaauaaugguguguguguguguguguguguguguguguguguccagcuaaauugcacugcuuucuuagaucauuuaagcacacuuaaucuaauggaacaugguaggauuucagcagcuucugaauagaaguuggagagaaaaaaaaaaauccgaaacguggcaccaacuaaaacccccauguaguuauuuaaggcagcuuaagcacuucuguggaaacugggcuccguugaagaaauagccacuccucuuacagaaugaaaccucacuuuuuuuuuuuuugucuuuuuaaaaauucuuccuuguauuuuuagauuuugggugagaaugggacucuaaaucuauuuucaagcuuucuuuuccuuucucugcucacucagaauuauucuuuuuaucuugguucugccccuggugauaucuuggguaaguuacuugaccucuccuggcugcuuuuuuucaucuggauauuuggacuggaugaucuuuguggugccuuccagcuguuaacauuuguuugauuuuaugauucccucccuuguuauuacagaaagcacaaguguugugccuuaagcauaagauaggaaaguaucccuugaucaaguugaaacaucuccacuuucuaaguuccaggacucuuaguuugagcuuagagaguuacaguuguuuccaggcaguuuuuugugcuaagggugguuuggguuuuauuucuguuuuucuguagaccuuauuggauauaugaccauuuggucuugguagauaauauuguguccugacacacaccaauggucuacccuugggguguuuuggaagccugcaggcaggguccugaggcugccugagucacuguuaaugaaccaaacugccugaaaugcuccaaugguugacuuuuggcacuuggcagaaaaauccuuuucauguuaguuucaagguugucagauaucauuauccccaaguauuaaaaauuucaaagaaaggaggcaguguguuugauuuauagaauaguuaucuagcuuuagcucugacuuggcuuuggaaaugguuuugcaagcacuagaaaauuaaauccauuuuuuauggcacuacaagguauuaucucacagcaaaugauaauuaaacaccugugaaaucaauuagcccuuuaagcagggaaaaaaaguuuuccaauuauguuuucacaccuccaaaacuuuuauaauuccaaaaccaacacuuguggagagggauauggucgacuggccguugcuggguuaacuuuccauaaagauuaucccuaaauuuugcuuagccuuaauccugaggaaggcaguuugugauaccagcauccuuccaaagagacugcaaucgccuuuagagcugacucuuagcagcuaucuaucugacacacagcggagcugucaacgacucaacaaaggaaguuacucacuuuguguuuugaugccaaguuuuacuugacaguuuauuuaaaagccaagauaccuuaauggaaaccaagcaacaagaauuccaugugacagaaaugcugucccauuaagggccccguagccaagaguucugagccaucuacauuacaaauucauacucuaaaaacagacugauugguuaauagcugaaacccaauacaauggaaaacugggacucauggccagccauucagccccacaguaucauguguguuuaaucaccggcuuugguaacaaauuagcuauuccagaugcuucuuuuggaaaaugaucuauacuucugaagcaguagauggauuuuggguauaugccauaauaauuugggacgcaaagaaaaggcaaaagaaacauaacaaugccaggccuuugacaucuucugcauuuuaccucauauguacaaaaacuguuccaagaaaauuuuuggccucauccuuucuaauauucauaaaugcuuuaguuauuaauuugugcaggguuucauuguaucacuuuacauaaacaucucuaaagauguucuuuaagaaauuucuucugcagacauuuuuauugggcucuugcuuucauagcagauggcauuuggagaacuugacgaaucauaccauuaacuagagagagaaagcuagcgucguauaaaacaaagaugaaagaaaacuucucuauauccuuuuagaaacuugucauaugaauuaucccugcaaacauugccagcaguucagacacuuuaugaccuaggcuuuauaaacccaugaggaauggggugaguguugaauaaucugacauagguucaacaaauauuuccuaaaagauuacugugggccaggcauaguacagggucuggggucacaguggugaauaagaacaggaacacucccuucucucaugcaguauacauuacauuuggggagaaagaagguaagccaguaaaacaaauacaugugugaauucugaccuugguaaaugccaggauggagaugaaacagggcaacagaaagagagugccaggagcacagguuggucugugcuggccucucugagaaggggcuauuugaaugcuuauaggcagcuugagagacauccuggagaagaauuccaggcagagggcacagcaagugcaagugcaagagauagaaguuagcauucucugucaagaaauugagagccggacuuuguagcuguagauggugacugaggauggggcagucagagaugugggcagaggccaguucucaugggacccagucggccaagguguagggcaugauuauuauucuaagugccaggaggagccacuggaggguguucagacugggggggugacauuugaaaguugucuuuggcugcucuauagacuauggacugcaggaagauacgauugaacucauucuguuuaaaacuaguaagaaccagaguaugguuucuguugcucuguucaugcacgcuugagcugaaggaggaaugggauuaaggagguauaggaagaagggugugaggagacucuggcugucacugaauugcaaaauccaugaaugggcagcuccuggaguacucuugcuucauggcgucccagugcucagagugcuaccugacauguagggccugcucaauacuccuuuguccagugaguaaauaucagggcaugaaggcauccuuugggccaucugguccaccucuccucaauccagugcuuaaauuuucuuucugucccacagccucuuuccagaaugagagugccagggagcuagcuggcucugucugcuucucaaaggaacugugggaagcauggccagcuggaggaggaggagggagaggugauucagcuccacagaccaucuuccccaggguacuguuguacuucugccuaaggaaauggcagaaucuagacuugugggccucucuaaucccuaaggacucaaccuucaugcaaagauauuccuguaaaucaauaauauguggcaucaaaucuucaaccauaacccaaauguuaugucccauggauacacccauguaucucuacauuuaugcauucacauacccagacgggaaagauuaaacuuuccauagacaacuagcuucaugcagcguucauaguaaguuggguguucuagaauuuuuugugaaugugcuauaucagccuacacagaguucugaggucuuguuuguguauucgguaccaaaggcucaggagugagguggcagcccugacugucaaagucacaaggcagaggcuagugaugcaacagugggagagaaaaugggaaggugagguugguggcaucagcugacauuccacaaacugucauuggauucucaagauauuuuauaaccacuuaagugcaggggccagacaaaaggauuaaacacugacaagaaugcaggucacgggacagacucugcacagugccugcccugggggugagaacaguaggaaugccaaacauccuccuaauccgaggccugauccaggcuggccuugcuggaaaggauaucuuggaucaagaagggaaguggucagacauugguucgagcucaguuuucugugcagagggagggagucauugcuuuuuggacuggugcaggguuugucauugcagaagccaugaggagguucuacagcuuuuuauucuucaguucagacauggaggaaggccaggagaagguucaguuugaaccgcacugugcaugcauuuaacuugauuuacaaauaaugcuauuugucagggcuggugaaacacaaauuuucuacccucaucagcgugcagggagaaaaugacauuuuuaacaagcugccagaccuguagaaauaaaaacagagaagggauuuuaaaauguacaaaaggaagacuaaauaaauaacacgauuuuucauuccccaaguaaauugggcuugguguaagcauaggaaugaacucauucuuggaagaacccagcauaaaucaagaguugggcauguguuuguuaaaguggacauuguuguaaugaagggcuugcaucuuaucuuuguuaucuucuugcuuccauagccccuguacacuuuaaugcaaauugguggacacugagcaccuuacauucauuuaacaacucuuuuuuugaguaguuacaguaggccggcccuuaagguaguuguugggucaacagaaaguaggaccaagguccugugucccggaauccaggggaaggaaaugagaaaaaugggcaacuuaauacagagugagcaauagagaguuagcacaggguucccaaacuccagggaucagggaagccuuccucuaggcagcaggaguggaaguuaagaaaaagaaggaaagaggggcauguagggaagaagugcucccuccacagccagccuccugggacucagauuguccuagguggggagcugacacccuuagaacagacacacugcgcugcccaccccuauccuggucuucucgggcugcuguccauacuuccuggcuccauuccacuuaaccagucccauuggcuuagagccuggcgaaagguaguuaaugguaagauaaugaccucaggcuuccccaucaccauugggccugugugugacucuucuggacccauuuauccaucugaguucacuguugcugcuggcucuuuuauuguuaauccccucuuuucccccugcacccccucccugccacuguacucagguagcccuuuauuuagcauuuucaaaaacguuuuguuuugaaccagagaauuuaggcccaugugucuuggaauugcauuucucugagaagaguuuuggaaguggguauugcuguguauaaaagcuggugcuggccaggcacgauggcucacgccuauaaucccaacacuuugggaggccgaggcagguguaucacuugaggccaggaguucaagaccagccugaccaacaugaugaaaccccaucucuacuaaaaauacaaaaauuaacugagcaugguggcacacaccuguagucccaccuacuugggagucugaggcacaagaaucacuugaacccaggaggcagagguuuuagugagcugagaucaugccacugcacuccagccugagcaacagagcaagaagacucugcucaaaggggggaaaaaagaaaaagcuggugcugcaaaaccucuccucuuucagaaagcuuccugagauuaaugucaugggcacgauguauuaaaugucucuuauuuucaccuuugcuggcaccucguuacucuuuccuccuagguagguugagagaugacagagcuggucguggaucccauccuccuugcacaaaccgaacaaaaccugugacacuuuacuucaucaucuguaaacuggggucaguagcaccuauucuccaugauggugguaaagauaaggcacaguaaagauuacagauugugcagcucagugccccacccacaggaaaugcuuaaaaaguggagguauuguuguuauuauaauuuauaucuggccaggcaugguggcucaugccugucaucucaauacuuuggggacugggaaggaugugggaggaucacuugaggccaggaguucaagaccagccugggcaacauagcaagacucgucucuauaaaaaauuaaaauuuaaaaaaaguuuuuaaaaaguuguuauuaauagcuaucuuuuauuuauuuuuuuuuuuuacuuacuuuuauauauuagccauugagcuguuauuuaaugagcaggaauucagauggucaucuuuuaccccucuugaaguaugagcuacaccugguacauguuguguucauuaauauacacagguagcaauuaccacuugggcuaaguuuaagguucugaacugucaguagacauuuaaccuaaggaugggggguggaguuuagaguugauaagagauuaugaccuggcguguucagucaagauguuugaguccaaggacucuucugacucccucaucccugugaaagacagguguaucuuuccccacguccccagugguugugaggcugucaugagaucauggauaugagagugaaugccucccauagggguuucaugccucagccccagcccacaaaauguuaucugccucccuucccuaugcugaaauggauuuuaagaggacaugaaaaggagacucucuucuguggaaagccaagaagugugaaagggugaauauaaauuccuggcccugguuuuagccacgcacugcucucugcgguggacagcuugggaucagcagccucagacugaggagcgucacaaggaaauaaauucuuaauccuuggcaugacuggggagguggggagugguguggcaguucuaacagcaggcaaugcucaaggcaaaaaacugucuugaguaaggaauuguaccaccuccaaauagcgagugccuuccugcuuggggacgccaagcaucccugaagcugcagccaaccuggucagccagucccagagccuagcacugcacauuugcauagcucauuuguacuauagcagcucauuugugugcacagagacucugugugaguaggugucauggagaaacuguggcuccuuaaguccagagaauucucaaagacaccagggaccuauacuuuuccauauucuauguuuucaagucuccuaauugagauggaacaguggccaguuggacccauuuuccagcuaaaagauugguucccacuuauauauguuucucaguucaaaucuuugccuugggcaauuccguacgacugcaugcuguaaacuucaguuuucucaaaaauaacugaaauuuuaggccagguaugguggcucacuccuguaaucccaccacuuugagaggcugagguaggaggaucacuugagcccaggaguucaagaccagccugggcaacaaagugagaccccaucucuacaaaaaguuuaaaaauuagcuugacauggugguacaugccuguagucccaccuacucaggaggcugagacaggaggauugccugagcccaggaggucggggcugcagugaacugugaucucaccacugcacugcagccugggugacagagcaagaucuugucucaaaauaauaauaauaauaauaauaauaauaauaguaauugaaauuuuaaacuguuaaaccuuuaaaggccaaggaagggucuaaggcaacaugguuaguaaauagaugacagaguaccuucuuaaacugagcuccugguagugaucuggggugaaguuuugaaugggagagaaacagcccuuuuaaauuggcaacgaauagcccaugcuugaaacuaggugaacugcuuaggaccuggcuucauaagacaugucaguuuuagacacugcauguuguaugggcugaccaaggaggcaaugugauguaauggaaagaaaaugggauuuagaaugagaaauccaggaguuggaacacaggcugguugguccuagcugugaccugcauuggaaggguuuuugaggucuccaaacuuaauugcuucucuaugaaauuggguuauaugaaguccugagaacaccauugguaccaugucauucuucugcucaagcccuucagugacaccccagucaccugcaagggaucaucucugagcucuaggagaugucauagaaagccuuccuaguggcaacccaccaguaacagcagcccacacccccauaccuuccccuccccaaacugggugguuucucucaccuuggugccuuuguuccugcuaugcuaucucuacccccaggaauucccaucaccuccucuuaccccugugccugguugcuucuuguacauccuuuaagauuuagcucagggucucacuuccuccaggaggccucccugccuacauguggccauugcuucucuucucuguauaacacccaccucuaccucauguccaauccuagcacuccucucgcugacuaaucaucauuugauaacacauguuguuuauucuggacagugagcucccugaagagugccugacacaugguagacauucaacuaaugcuuggugaaugaaugaaaaaggcgcaaggaggugcucaaaggauguuaauuucauuucucucauccccaugcacuuuagagaacuacaacagucauaaauuauuuuuauuuucuuucuuucuuuuuuucuuaagggauauuauucaaacuuguguauaaggaaagauuaauuacuuaugaggauggggacuggagggaguagaucagcuguagauguuaaguuacuuuaugaauaaauacuugagacaaacugugacaacaucauggggaggcuagaauugugugaguacagagaugagaggcuggaucacuuguuucuucccuaucgucuuugguuagcaaaaagcagguucacuuggcaaauaugcgugcuacagagggauugugggagccacaggaggaccugugagcacagugcaccagcaacauccuugucuauguagcuuuugauaauaaggcaaaagccuucaauuagaagcugcuguucuguugugauucacagcuucuguuuccauuuuacuuuaaagggucuguuccacauuugucucuuggcucugucuuugggauacugguguaguuuucauucuuuuuaauuguuacuagggguuuuaaaaauguuuauaucccucuuauucugauauaauuuaccauaauaacuugcaauugcauagugcuuugccauuuauauucaauguacaugauuucauuugaucuucaaaacuuugagguuuggagaaguugaaugauuugcugggguuacacaggaagugguagaucaagaacccaaauuccuuagcccagauuuucuaacuugaagcuggcuguguuuuccauuauguucuguuaucuuccuucagucauaaugauaauagcuaccuuuuaugguuugcuuauaauaugcucgugcuuugguuaaaauguaucacuuaauccucacaguauaaguauuauccccauuuugccaaccaagaaacuaggauuaaacaaauuaaauaacuuucucaagauuacucaguuuauaaauugaaaagcuggaauucgaacccagguuuugcugugucugaagcugccuaaccacuaagcuuuuaauuacuaagcucuuaacuauggugccagugguucugaaaauuuagggugcaucauaauuauccagagggcuuguuaaaacacagaauucugggcucuucccccagaguuucugauucagcagguuugggugaggcugagaauuugcauuucuaccaaguucccagaugaugcagauguugccacugauuggaagaacacacuuugagaaccccugcucuaugcuacacucccccaucuuucccaguugcacagaauggcugccagcaaaaauguguuuccuacagaggggcaggacuucaauugugcauuauugcauaguccauuuuaaauggggugcaucccauacauuguucaauacaacuuuaaguauaaaaugauuauggccauagagugguacuagugucuagguuaaauucaaggucaugucauuuuuauugcauuuuucuuuguagucguuugugaaaauucuucuaccuuuuguccuucuuuaccuacacguggggaacuuaaugcccaucugaaaaggguagcaaaaccauuuauuagaguggcaaauuaucugggguuaguugucucccucaccuacuuaccuucuugcuuaggauaucauauguuucuuuuaaguagugugugauuaugugauucacauuucuaaacauaagaaacgagggagaauuaguccaucuuaaaacacuguguccccccauuugaccucucaagucucccugucuuuccuccuccccccaaccaauggcaaccucuaaguguucuuuaucccuguaacuaugugauuucaugaaugucauauagaaaggauucaacaguauguacacuuucgagggugacuuuuuaaugcagcauaauuuccuugaaguugucguguguaucaauaguuugucccacuuuauugcugagaaggauuguaggcuauggauguaccacaauuuguugaaucauucacacauugaaggacauuuggguaguuuccaguuuaagguuauuacagacaaacugcugugaacauuuguggacaaguuucugcgugaaaauaaguuuccauuucucugggauacaugcccaagagugcaauuacugggucauaugguaaguccauuuuuaguuugaaaaggaacugccaaacuauuuuucgaaguggcugcaccguuuuaccuuccugcuagaaauguaugaaggguucuaaucucuuuacauccucaucagcacuugcucucaucugucauuuugcuuauagccaucccaguggguguaaagugguaucucauucauuguaguuaugauuugcuuuucccuagugacuauugauguugaauauauuuucauguguuuagcagcacuuugugugucuucuuuggaaaaauguuuauucaaauccuuagccucuuuuaaaguuugauuauuuaucuuuuuauuguugagucagaagaguucuuuauguauucuagaugaaagucccuuaucauauaugauuggcaaauacguucucucuuucuuuuuuuuuuuuuucuuuuugagauagaguuucgcucuuguugcccaggcuggaguacaauggcacuaucuuggcucacugcaaccuccaccucccaguuucaagugauucuucuuccucagccucccaaguagcugagauuacaggcaugugcuaccaugcccagcuaauuuuguauuuuuaguagaguugagguuacaccauguuggccagacugguuucaaucuccugacaucaggugaucugccugccugggccucccaaagugcugggauuacaggugugaaccaccaugcccggugguucucucuuucuguaggcucuuuuucacuuucuugaugggaccuggggggauggagagcccagccuuccugacugcacugccccagaguaaagcuccuguaaggcagagcuaguagggguuggucauggaacaggucagggaccagaugccacagacucucaugguucuugccaagauuugguagauuuucuugggugacuguuucucuauuugucauuauccccuuaggacaauucucagagacuuaaaauguuuuuaugauuguuacuaaauugcuguuuugcuggggagaguggccacagacuucuuuguguaucuucugaaaggucggccuucuauaaucuccucuuauaaugcaaauacucccaggagauguuuauaucuuaaauucucaucucaucagcauuuucucauugucaggugcuucuuugguagcuccagcaacuagagaagaccuucucuggacucuaucuguugaaaugggacagugucugaaacauaguauuucuugaaagaaugaaugaauaaaugaguggauuuaagcaucuacaaggagguugaugugcagugugaaagagcaucacaaugggcugaguaggagaggaucaagcacguggucaaacuagaauaguugucugcccacuuguggggcaucauucuuccuucagguagaacauguuaguaauucauagauugacuguccagagaguagaauagagaggcugguucacaggcugagcaugcauagaaaucugaaugaaaaucauuguucuaagguaugaguguacauguucuguaugagccucuaugugaauacacacauauguuagacaugcacugcauacauaugaacagauacguauguauauacauauacacacauauauggguauggaauugugcacauauacacauacauauaaugguauggacaccuaagcagugggauauucucaaaggacauuccucuuucuuacccaaaaaugauaagauaaagaguaaucaaguauuaaaacugaaucuauagucaucuagcccaaguaguucauuuugcagaugaggaaacagauagaaaauucauggguuuuuuaagucucacagcuaccuagugguuuccuaacuccugcaaggguauucuucccacagcuccuauuaccuauuaugugaaggaauacaagcuucgaucaugucaaucuuacuugcuauaucagcaaauaguccuucuauguaaccauuuaagcaacccacuauaacugucauuugaauuuuuccuauaaguuuucugcccuuccucuuccuccacacauucccuaaaguaaauucugcaacuaggaacuuugaaacuuguuacaaugcagaacauuaauaggauuuuacauuuuuaguaggcuaaugaugagaaugugggaccuucugugcuagucccucagggguuucuauucuggguacuuauuaaaccuugcuguagucugaaguauauucgaccuuucuguauuaaaaaaaaaucagcuuaaacuuuaugcauauauuuuugugagugugugugugugugcauauuucucucugcuccaucuauuaggcagagauuaaaacauuaucaacauuugaacuugaagauauuugucaaccauuuuccuguguuuggugaggaugaagaaaucacuaccaucuaauuuauuuuuuuuuuauauuuaacuaaauucaagccuucuuaaaaaucuuuuuuacuuugaagucuauuuugcaauuuaauuaaugcagcaaggguuuuagaaaauuuuuacucucaauggagauaaucuuaauccauucacggugaccuuuucuugugcaaauuaguuguacacgcuuguuuaagcaaaugguccuuugcaugaugucucuucuuaauggcggguuuauaauugaaaauuggcuuacucccguaugccuaguuuguaugagaauauaaaaauagauguggacuuuaaaaauauaaauguauauaccaauauacccaaaaagaagagggaagaauucagugccuuuaggcuaugauuaaauuagacuauuagagucagaaagugguggugacauaugcuacugucaaagucacaccugucugcucagcauuggaagcucuugaaaaaugagagugauuucaucuuggcucuaagaaucggggccuuuacaggacaugagccaucucuacuuucccaaguuuucuuaaacucauaauguacuugaaacugccuguguaggaauguguuugugguaaucacuuuaaaagugacaguccuaaacaaaaugaaaugcuuuuuaucuuucuuaaacuucacuggcauaaagaaacagguaacacucauauuuuguauguuuuuucgaaaagcaaaagcaauguaauaucauuaaaugguauuugaguaaaauaaauucaucucuucuguagaccaguuuccuguacccccuccuaguucagguuuuuuuuuuuucuuuucuuuucucguuauucuuucuuucccuuucuuaggcuagcauccuucucucucaccuccucuuucuccugugaguuaugucagccauucuuaaacaggaauauuuuuccuggguaacugaacguucuugguuaaguguagaaacuccaucuugaaagagaagacaaauguuguuuugugccugugauugagguuuucugaauaguuuuuaauagcaugguuuugaagggguggggaacaagaacagucuuaguuuugcugaaugccguauuguuaaaggagaaggagaagcaccaguaauuuucucuucuucuuuuuaagacuauggggcaacauauuuuaucaagacuuaaaaaucugauuuuggaagcaaagacugggcaaaccaaauuguugccagaacgaucagacuugucuuuauauauacugcuugcaaaagggauccuaauugcuuuguccaacaugaugauucauguuuacucuucaugcagcaacccaaccuccuuccucaaaauggaaaagugagagcugccugcugguggcuuucccgaguugcuuugcguaaauucaugcacaugggcgcccaccuauggucaauauccccacauucgcaaugagucuucauuugcuguuuacuccucuucucuuucuagguaugauuaucgggaaaugcugcacaaugccacuuucugucugguuccucguggucgcaggcuuggguccuucagauuccuggaggcuuugcagguaagaggcccuggagccuucccagaauagggcugaggaccgaagccagauuaaguggguuuaacauuaucaccucuccugggauagcuaaagagaaggugugguuucccuugaggaucugaaaauauuuucaagaaaaucuaaaacauuuuugacaagugagggguggagggaggauuuacucaguaauuuuagauguaagaaauuaaaugguggauucuucugggucauguuuagaaacagaaggcaaaucuaauugccagcuuggccuaccaggcagccuagcuggacucuaaaaagcagcccuacacuuucccuuuauucgugguacucucuaaaagcaaaauugucuuuucugccugcaucuucauugucucucaguuccuuucaauuuugagaaugauccccagcauggugguacuacucagaugauccagcucuuccaaggcucugcaguucagagguccuggcuccagcccuggagccuuuguggugggaguuucucagcucaucaaccucacucugcagaaauguccucuugagacagucauccacauuucccaccuggaaguugcaaccagccuucuuugauugcagagagaaagcaugcccucaaccucucucauccuccauuccuugacccuuugcuacuauguucuuuccuccucuugcccugcaccaugccuaaaucugugcuuuugcugcagugccucauaacuucuuaucucugccaucuuaacugcaaaucauucugucaugcccuccaacagaagagcuuccuucucuggaaugucuuuuccaaguugcucucuguguguguucugcauagcaugccaucacuaauguucuuguagccuccugggaugcugcauaaagaaaaauuguucucugauuuggauuaugaguuauuuggaaucaguauuuugucauuaaccuaguguuucuuggcuguuuauuucccggcacagaccauaaauugguaugacugugguuuagaucacuccacacugaaaggaacaaaguucugguuuggguguuugcagagcaagggaaaugugaacacucuauacugguuaaguccacgaacugcugccuaggaaugcugagcuucauucugcucuuuguugcucaugacauugggguaaaccacuuugcacguggacuugugggaguuacguugaccagacuguuuauauucaagguugguucuauacucagauuuuguuggugcgagcuuuuguuacgucaauaaaaacuucuccagcaaggccagucgucucuauggaaguaaggucagccaaaccauguacuagaauagaaaugggguuuuagcauucuagggcaagacuugcaaauauuaaaaucuagucuggauacguacaaccuucgugugacuugauaacucauaaaagcuuccuuuccuucuggccuaggcaguccaggauucaugcagugucaaaaaugccagucauugaguuuguacugauuucaccucugauuggaacagcuucugcugucgcuuuccucacauucacgaaguccccuuuuuugcucaggcugccugcgucccugugaugcucagcaauggaugggaguugccauucucugaagugauuaauuggaaccaagcugccgucauaggcgaugagagauuguuauuacagguaaggaaggggcuguggccuucaacacaucagcagauuauugcugcccccguccaaacuuucaaagaagaugaauccaaaaggucagcucuauaaaagaaaucuuaucaggagaaaauuaccugugucauggugaauaugaagucauuuaauaugacauuguucacuuuccaacaaaaucuccccagguccccagaauauauucugaaaagaaguugcagguaaagaaugggagcuuugauuuucaagaagaaguggaucuccaccccuuucaauaaccagaauuuuuagaaauauuaccagagaguuuuuauucuacccuacuguuucauauucuuuuccucuguuucugcacuugccuucagauuaauuuucagaaagagagaggucucuagggcuuguucuuguaauuaguguuaucguuccucaaaugauccagucugggugucugagcgaguguuaucuuuaggauuuauauuuaaaugagcagccccuaauaaaaguuugaauugcucaagagcugccuagggagggggauacgauacucagaaaaaucugagggcaggaaugaucauguauuauuuuuuuuuaaauuacuaaggauuucuaaagcccuuuguauauucauauuuuaggaucaacacaaguugccgugcucuuuucuccuaaaauucuagaacuuuaauguuuuucuuuuguuguaccauacacuuuaucuuugaauuaccacaaauauuuguagaauuuuuuuuaaugucuuugcccuuuuaguuuuuggauauucauuaaauugaguuucuaagucuguguguguguauguguguguguuuguguuuuuugagauggagucucacucugucgcccaggcuggagugcaguggugugaucucugcucacugcaaccucugccucccagguucaagcgauucuccugccucagccucccgaggagcugggaauacaggugcacaccaccacgccuggcuaauuuuuguauuuguaguagagaugggauuucaccauguuggucaugcuguucucgaacuucuaaccucaggugauucacccaucucagccucccaaagugcuggaauuacaggugugagccaccgcgccuggccucuuaagucuguuguugauucuccuucugugcugcugcccagucugcuagcugacugcugaaguaauacagcacuuucccuaaaauaacaaaugaacuaacuguaacugagagacccauggguuaagcaaacuaaagugaccacagcuccugaaacauuacuucugucuggcacucaguuugugaucuccauagucccuauuaucucagaaacaaaggaggaaugugacagaaucuguuuuugggggaauaaguuauucugcccugaauacaacuuaauuucuuagguguucauugagaaaggggucuggaguuuuugugaaagggccacuuuuaugccaaugauuucccacugugauuccuuaaggaaaagaaguccuugcagaaacacugaggaagaguuuuccccaugcagagauaguguaugcuaaaaucauuuauucaugaaaagccaaacaagagugaugcauguugugcuuguccauguagccuuuuuucuuccuuuuucaaauguuauuuuaaaaauaauacaugaucauuaaaagaaauuugagaaauaaagggaauaaaaaacaccacccauaauuuuccuuuuauauaccaaugcucccaugaauuugaugugaacaaauugaaaguuugucuuugguauggagcgcauuuuaggauacuuaauugugguugugcaguuucuuucuuuuuuuuuuuugagauggagucucgcucugucacucaagcuggagugccauggcaugaucucagcucacugcaaccuccaccucccggguuuaagcgauucuucugccucagccucccgaguagcugggauuacaagugccugccaccacacucagcuaauuuuuguauuuuuaguagagaugguguuucaccauguuggccaggcuggucuugaacuccugaccucgugauccaccugccucagccucccaaagugcugggauuacaggcgugagccagcgcgcccagccacuuguccaguuucuaccauuucaccaaacuugaugggcauuucaccuucugaagcaacuuuuuggcuugacucuaaagauuuugauuuuugucacccccacccacccagacuugcugguguuuuuccccucucauauucagucugucuuugcacagcugccuccauauugagcagcaacuguguacuaucauuaacaaugguuuuaaagaguuggcacccagcccaaaugucugcucugggaaauguuuuuuuguuauguuacaauuuuuuauuuccuguuuuagaacagcugggauguuuuuauuugcauauauucuugucaucaugucaccaagagagcuuaaugugacuuucuuguaucuauucuggugcauuccauuuguuuugcuaccauacaugaccuuuuauuaagacuucauugagcucggcaacuuccaaaacaauccagccaaauuggaauuaauuuaucacuuucccauaccugucucucaggacaagcagauuaauaaccaauagccaagugccauuaaaacuuggaacucugucuuuucaaucaauuggaguugucuuccagagcacuuugcagagugcugucagacacuuguaucauaucacaagccgguagaauacauugcacuugauguaguaagaugaagaugcauguuauuuaagagaggggaacagcauugguaggugagucugugauauuccuuuucuccuuucauaaccacagcagacucaauuuucuggagacuauauagcaaugacagcuuuaggcauuuuucuuuucuuuucuuuucuuuuuuuuuuuuaagacagucuugcucugucacccaggcuggagugcagcggugcaaucucagcucacugcaacuucugccucccaguucaagcaauucuucugccucagccuuccgaguagcugggccuauaggugcacaccaccaugcccagcuaauuuuuguauuuuuaguagagaugggguuucaccauauuggccaggccggucuugaacuccugaacucgugauccgccugccucggccucccaaagugcugggauuacaggcugagccaccgcgcccggccuuaggcauuuuucuaauagacuguuuccuuguggcuacgauaaaacagugaugccaaccuauauaacucuuagcaguuaccucuugacauuuagaagaggguaugauuaugaaaauugaacaggauaguuuuuuucuaaucuuucuuuggccaucuagguaacuuucucagugaguaacuaaaaauaaguuuccuugcacugauaaagguucuaugauauaaaugauuugucuaccuucucaaagaauguuuuauuuccauuugaccuugggcucugauuacaggcuaauguuugccugccaguauuucuccuuuacauguugccucuguuuuuucaguguugcaaauccagguauacacuuugggacacagauuuaguaucugguuuuggacauugucaaaccaagugagcuuuuccuucuguucuuacugugaagcuauuuuauugcuccuccuaaggggagugcugaauuaaaaaaugugcuaccacuuccuuccccuccaauggaaacucuguuacagucuuagucaaaugccaugggugacuuuccuauuaaagcagcuaacggagcauuucuccuucuugcucagacucccauaucugucggauuagucauauguuauggaggcaagcaugcagaaagaggugagcacaaaagggcaauugcaaaucacaaggaaucuucccuaaagacuauagacuccguaaaugaaauagaccuugaacuguaggugaaaauagggaacaagcccagaaaacuuaccagacucaggaaguacauuucagagcuccagacccaaguagguucccuugcaaacauuaagcaauugauccagcuuuuaauagcaucacccugauaccaauaaugauaauaguagugauguuacauuaauuaaguuuuccauguuuuaggcacugugcuaagcacuuauauaaucaucauuaaaaccuuaguacuuuauccccacuuuauaaguaaagaaguggagucuuugagaaaucagcuaacucauucaagaaagcacagguaguaaaugcugcuagaggcaacacuccuuccuugaucuuucugacuucugugccccugugccugaccauucaguuauacuaccauuaaaaauaaugacgucccugugguggcuucagaugguuauauucaccuccuauuucuuaauaacuacuauauaaaauccacucugcuaaccugaaaauguguagcaggauaacaagauauagguccuuccuuuaaaauuguauacccuggaagagagcagugauggcuaaucauauaugaacaauugagagauccaguuagacuuggguaaaggcugaaggcagaaagagagauauagggagcagaaaggcucaaaggugagguagaagguaugugcacauaaaagugacugacccuagcuucagauuggaugggaaggcucauagacauucucuaaaaaguccuuuuauagauauuuuauaguuccuggggugaccaaucauagaagugcuugggagauaaagucuucuggccuuuccccaagaccuauaguuaccccucuauaaaauuugguuguucaugugcaaggucaaggauuucuggaaacagcaauugugacuauagacuaaccuaagcaacugauaaggugcuacugaaucuuagaggugaacuguaacuuucauacaucaaaggccauugggguggauucccaguaagugcucuuugcagcugacacuucuuaaggucauuucaacuuaggaauugaugauuuuuaguagaucuauaugcuagaagccaaaugcuaugaagaauaaaagccuaacccaguuggguuauuuugaucaagugcaucucuuuguuuuacaguuauaauuccuauguguucaccuuguguuacagauuccuucuacaaucaggucuauucaucaggauaaaauccuagcacuuagacagcagacacaauucuugugggaggcuuauuuuucuucaguugagaagauuguauuaacuacacuagagguaagugagaccacuuggcucuugggcuugaauaaugguccuuuauacacuucucucagccuucuguuuugcuauuagggaugugugauugguccaguggggcaaaaccagauuccuguacuuggauauauugguuaaccucuuuuaccugcuuugccauggccaagaaaauacucucauuccugacaaacuccacaaaggaaaaccuacauggggagaaauuauacuuauugacacagagauugacucugucuuacaucauuucagggauaugugggucaugacugucuugucauuuacacucaauggcauccuucgaagacauauuucuggaguucauuuagaaaaaaauauuuaauggcuuggcacagcggcucacuccuguaaucucagcacuuugagaagcugaggcaggugcaucaccugaguucaggaguucaagaccuggccaacauggugaaaccucgucucuacuaaaaauacaaaaaauuagccaggcaugguggcacacgcuuguaaucccagcuacucgggaggcugaggcaggagaauaucuugaaccugggagguggagguugcagucagcugagauugcaccauuauacuccagccugggcaacaagagcaaaacuccaccucaaaaaaaaaaaaaaaaaaaaagaaaaauauauauaauggccaaguaagggcaaauccucuaccauuccaaaaauaugaguaguuuucugggcaccacaguccaauggcauugcgggacagcagaauucucaagacuuaggcaagccagccaaccagcgucaauguggcaaaguuguguuaagaggagaaucaggaucauacccauguggcacagaaaguguuaaauuugugaaagcagaaaaucuuuuaggcagaugggcgcccguccucaaguugcuuuuuuuuuaaggcaggacggaaaaagaaaaaggaagcauggagaugauuaaaaccuuuggaaauagagcagauagcauuggccugaggcuacaccgaaguagcacaaagagcuaggaaaagauucaggaaacugcacacgcaugcauuacaagcuugaagaaaggagagcagagaucuucguugaggugauucugaggugucccaaaaugaggugggggcauuguggccuuccuuuuggagaauucacucuggaagagugaugacugcucuaaaagcuaauguaauauggaaccuacacugagaaaucugaguaauaccaagaaacugaagucacccuacuugguccacaucgcuguuuucuugccauccugacuaucagagccagugcuggucaugcuccaggcacaccagggcauuuauccaccccaugcugagcuugggcuccugcucccacccuagggcgagcucuggucaguguucucuuaggcauaguguguauuuuuuucauccuggaacuggguaaaaggggcuguuuaagacccaggcccauucccaugaaggggacaggaucauaaugacuuccaagggcuuccuuccugcaagcaaacuuuuaucccuccaaaagcaaucuccucaauuaaaaucaauugaguuguuaccucuguucacaguagcuaauagaguuacccuuugcuuuuuuaauccuguccuccaucuaagauccuuccuaggcccuucuuaaagaauguugaauguuauuguuucucccuuuuuggagugcagagugccuuucuuuuuuuuuuuuagacaggaucucacucugucaccaggcuggaaugaccuuaagcaauccucccaccucagucuucugaguagcugggaccaugggcgcgagcuacugugccuggcuaauuuuucauuuuuuguggagacaaggucucguuauguugcccagaguggucuugaacuccuggcucaggcaguccuccugccucgacuacccaaauuggugggauuaaaggaguuauuauuaaagaaguauacauucauuuuagaaacuaauagaaaacacuuaaagcauaaaauauaaaauaauucauucauguaaaaccacuauugauauauauauccccacaaacauauauauucauuuuuauauguaaauuuaaaauuuguuguacuuuuaauuuuaaaaaggagucuuuauauacuugcauuguaaccuguuuuucugcuuaauaauguuaauauuuucucauguuauuacauuuuuucuccauuuaaugacuauaugauauuccauuuaugauaucaucuaauuauuaaauuaauccccaauuuggguagauuccaguuguuucuggcuuuuuuccuuuauguacaucauugcaguaaaucaucucaaggucaaauuauugugcagauucaauauuacuuccuuaggauaaauuccuugaauuugaaguccguuucaaauaauaugccaaauguuaagauuuuuuuuuuuuuuuuuuuuuuuuuuuuuuugagacagagucucacccugucccccaggcuggaguacaguggcaccaucucagcucaugcaaccuccaccucccagguucaagcauuucugaggccucagccucccaaguagcuaggauuacaagcaugcgccauggagaugggguuucaccauguuggccaggcugcucuccaaccccugaccucaagugaucugccugccucggccucccaaagugcugggauuacaggcaugagccaccaugcccagccccaauacauuucuuucuucaguguuuucucaugacguuuuuauguaucuuuggguuguuucuggccuuucaauucuauccuauuaguuguuuaccucuaauacauccagagcacauuccaguguuuuaauuuuuuuuacucuauuaugcauccuauugugaacuucuauuuacuuaaaccaauaugccauuauuuacuauuaauguucuuuuuauuuuuuauagauaacuauaucuuuaucuaagcaaugacuuucuacauguaucuuaaacuacaucucuauuucuuuaggauggaaucccugaagugauuuuaaugagccaaagagccuaggcauuucuaaggcuuauaauauauuuugccaaauuauuauccaaaaacauuauauccaccuagaaucucacaagcugucugggcgugacucucuuuugcugugcucuugucagucuuacagauccauaauuaaaacacacacaucuaucacuuugcugauuugccagaugaaagaugguaucucauuaauuacaugucuuuugcauaugguuuauugcaugaauauggucucucaccuauuaaguuagcaguucucaauuuuucuauuguaacaguugaaugucuuacauucaucagaauaggaucaaaauaagaucaagcuguuuucaucucugaaccugaaaaggccuuuucccuuuguauuuaaaccauguauuauuauuauuuuuuuuuagcaacacaguuuugggguuuuuuuaaacacuaaaaaccauacacuucauucgaauuuauagcaacugucaaaucucuuuauauaguuccaagauuggauuguaacaguuugaccucucaaccaaguugcaugacagguacuacccaguuucccaaaauacuucauaacucagauuaccccagaauucaacauaaucaaaaaaucaggggaaauagaagaaaaugccauccacagauacaaauaacacagcaaauguguuuauaagaacaauuuaaguaucacguaucaaagaugugaacuuggcuuagaacuuagauaauauacuucauuuagucacugcuggagcuacuaaggcacgagaauaauucauaguuacucacaguuacagcauagaguugaagauccugggcuaaggauguucuguacucagacucuaggucuuucuccuugcuugguauauucuaagccaugggaaugggauuauggggucuucagcaauuaugagcccuagaguuguagguagagugcuuagacucaguugaaaacaggacaucucauuuucucuucaaugccagggucagguuguuaguacguuucauuguacagaacucugucuaggauucuuuuaguuuuuccaguuugauugaaauucucuaaugcugcaucuugguaauaaggagcuauuuaaucaaacuaggcucuguagagcucaguacuuuugugaaaauugagaacuaacaaugaggacaaugaaaaaacacugcaaaaacagugcuccuucauggauuccauuauuugucagaauauugcacaauaaccugcacuaaggauugaaucauuggagcuuagucauaaucaagaugagugaaagaaagugccugagauuaugauaauaugugaaaagagccagugguagcuaggaagguauauaguuaguggaguuuuaaugaaguaugcuucauuuuccuccucaguuaucuaaucaugcacauacgaaccauaguauugcugaugcuaucauacaaugauauuuaaaaaucaaugggguaauggaaauagacaauugaucuggcuucaagugagguggcauaugguggcaucguguaucuuaggcuacagugcucugguuaaaagaugaagggcuacauagaaugacuuuaaccuauaaccaauuguccauuauuuggaaaacagaggauacauaaaaguaaaauaaggagccugucauucuucccuuugaauucacaucaauuagaaauauuguccuuaucgagggggccaucuaggaccauaacaaaaaaagucuuguauuaucuguuuguguauguguguguguguauugauuuuguuuauagccaaagaagcauccaaccucuaaugugaugucuucuuccaccacaauaaagacuaagcacuaagugccaugaaaagauucugggagcuauccaggguagugauaggaagaauugcagagggaaaaaaaugaucuuucuauauggugaaaugaauuccauauuucuuuaugcuuuuagaaggcaaguugauauaaaccuuuuagaaagacacuuggcaauacuaaugaauagccuuaaaaguauuuauacccuuugacaagguccuacagaaucaauucuggucuggagcgguggcucacaccuguagucccaacacuuugggaggccggggagaaaggauugcuugagcucaggaguuugaguccagccugagcaacauaaugagaccuuaucucuacaaaaaauaaaaauaaaaaauuagcuggguguggugacccucuccuguggucccagcuacucaggaggcugaggcgggaguauccuuugagcccaggaguuugaggcugcacagagccaugaccacaccacugcacuccagccugcguaacugaaugagacccugucucaaaaacaaaaacaaaaacaaaaacaaaaaaagaaaaagaagaagaagaauaaucaauccuaaauguggaaaauuuuauucguaaauauguucauugcuuugcauggaaaaaauugcuaaacuggucauuaagaauaaugaaucaugaauacuauuaauauguaaaaauagcuguauuauguaauaucuauacuauuaccacuauguaauaaauggaaaaaccaaugccuagaaaacgaacacaggagugaguuucuuuuuaaaggcaaaaaucaagccuuaaguauaacaacuuaggcagcuauucuuaaauucugagacguuguuauaauuaaugugguauuuuauuguuuuauuacaaaugaggaaaauaauacacaaagguggcaaauugcuugacccacguuaaauucaacauuugcuacugcuuucguaccuguccuaugucuuucugucaagauccguuggaagacaguauaaaaugcuuguuguuauuucagaagagugcuauaucuuauuaucauaucuuugaauuuuaaaagauaacaauguugugaugccgaaccaaaaagauagucuaugacaaugacaagcauaccauccaaagaccugaugggaaugaugacccauuuugugacagcugugaguuccaugauauuugucuguagguucgauuuauaaugcugucuauugucaauuuauuuucuaucuugauauccaaacuuauuuaagugaccacauccuaaaagguacauaaauuugaaaagaaaaaaacaaaaaaaggaggaucuaaagagaaacuauaaaaaggaaauaaauagacaguacguuuggaaaguacaaauaauaaaaagcaggaauaaauguuguacaaagugaaauugcuaaccauguaaaaaguccuucacaacuaugacaauuuucucauaauuaaugccaagacaacagcauuuuaacauaucccuguuguaccacaaaaaguaaaaauaaauauuuucacuagguuccuaaagucuccaccaaauuagaaaccucuauccagccauauaaaauuagcaguuuugaucugggugaaagauaagaugcagaaaucauugaacuaagauauuugaguucuuuugaauuuccuccuugcuuccuucucugucauuaggaaaauaaacauaagauuugcaaagauaaauguagcccacuuuauuacuuaucuagucaccauguggaaugagaugaggguguuaauaaccuuagcaaauaauaaaacuccauuuaaaauagucuguacuuaaaaucacauugcauuaaauggagaccuggaaaauggugauuugggucuuaaaugucuuaaaacuuacggcaggauuuuuuucuuuuuuuuuuuuaauguaaaaaaaauugcugaaaacauaaaauucuguaccaaguuaauuauuugccaaaucauauucuaaugaguggaugguauaauuguaagaguuugaaagucacagagagaaagcuauaaaguggacuaaucacauucaacugacaaaugauucgggaugggaggauguuugacucuaaauguagaauuuaaugaucugcaaggucccaaaguccaaagaaacuaaugaacuagcuuggcuauuauuagucuucauaugccaugguucuuguccuauuauguaggauguuuuaagcaauuguuaacucacuacuuuucaagaugaaauauagaaaaacuucaguaaccagcacccaaaguccuccaauugacuuugaaaggaaaaugaaauaugacaaguauacacaucuaccucuugaauuaaaggaacagcugaaaaccucaauagcuucuagaaugugucaugucuugaauaugcuuuccguuuagcaucuacaggucuacauugaccucucuuguucucugagaacagaucuucuugauaggggccuggaaccuaucuuaguucuuagaaguuuaaccaucagggaaagacuaacugcuccacacagucuauuuuggaaugagcauggacucauuauuauacaaagacaagauagaacuuaugguuuaacugaaguuuaauuaggaaauuugauuggcuauaauucauauguuucucucacucuuuuucauugcuccauuacucucucugucuugcagacauuuuuauccggagaauuaaagugggagggaggguagagucacuacucugacugccaccaucuuucgaauuuggauugagcaucauccuuuccaaauaucaucaggaucucauccucacugugugcuauguuuuauuuucuagauuauucaggacagaauauucaagcacauaucacguaacaguuuaauauggaacaaacauccuggaggauuguucguacuaccacaguauucaucuuaucugggagauuuuccuuacuacuaugcuaauuuagguaagugaauuuccuccagggaguugcccuuguuuacccugaagaugucauacagaacuaaaggccuuuauucuucuacucuaaugggguccaucuaacacccugcauugaagauugcuuuuucuagagccuuguuauaagugacauaucaaguucaaaaacagagcagagcauugcaaaauggaaaaaaagaaaaacuucuuaucugugcagcucuacuucauauuuaguagaguuauuucuuuuugagaaauaggcuccccaaauuauggaucauuuugaacauggcaauggguuagcuaucauuuuaagccucaucauauauaaaauggagagcucuccccaauuuuuuuuuucacaaucccaauaucucuauuccuuaccaaagaaaaacugaauaagaggaaaggagaaauaacuaagaaugugugacaagcacaaauuuauucauuuuuccaagguuuauuaugcuccuucuaugugcuaugcuaauguauugcuggguacuagaaauaaaaagucaaauaagauacaaucucugcuuucaagcgguuuucagucuaaucacaguagggaaaagggaauggcggagggauaaaucucuaccaccggcuacuguuauugccuuagacauuuauguauuuggacccccaguugcucucauguuagaaacaucaugaacauuucccaucaguuacaguucuaaacuugagaaagccuaggacaggaaagcaucuuccaagcugauacagcaaaaagacaagauuuuccauucagugccguuguucuccguaacacccucacccuuuuaaguuguacauguuuaguuugaaacugaugagaugaaaccuaaagaaaugcauggccugaagcaucaaccagugacaaagcaccuuuuaauccaaaccaaaccuguuaugggaaccaucucuaauucaguauauuguugacauuuggguaacagaauuuagaaauugucagauuaaggcacugguugacaagaauuucuguauauuucuuguacaauauuuagaucuuccuuuggaguuagcacauuagagguguauaaaugaugcuucuuaaacuauugcaggaaaauuuaaagacaaugacuugucguuccuguuuaaaaggcaaucccucaaucacgcuuauucuucuuacucggcaaaacuuugaauauguaucuagauauugggaagguuaacuucuuucuaacauacaauuaaagugcugcuggaugauauaauuuucucuacaaaaccuuuguauaauccuguaauacacauauagucugauucuagccuuuaucccaucaguaucaaagcguaacuugaaugucccugcacuguguugcucgcaguuaagccacuaaagugccaaauuagugggucuaaacuaaugaaguuuuaaaaggcucuuaaccugucucuaauuucuuagugaguucuuaugggaaaacuccuuggggggaagccaucucacuucugucucuuuggugacagugguuguuuugcauaucuaugauccuuuuuaaccuagggcuucagagcucacaacuggcaaaagucugccucacauacuuuuuuucucagcuauaucacugcuacacgaagaagagauucugggaauauggaggcuucuucuccaaaauaauaauguuggugagggugaugauaaugguagcugcugacauauauugaguacuugucauuuguuaaguccuguucuaagugcuuuguaugcauuaaguuuuuuuuuuuuuucuaagacggagucuugcuauguugcccaggcuggaguauaguggcaccaucggcaccaucuuggcucacugcaaccucugucuucagaguucaagcaauucuccugcuucagccucccgauaacugggacuacaggcaaaugccaccaugcccagcuaauuuuuguauuuuuaguagugacggaauuucaccauguuggccaggccggucuugaacugcuggucucaagugaucugcccgccucagccucccaaauugcugggaucacacgugugagccaccgugcccagacaaacuuacugaauuuucaagauaaccccauauuuggcacuguuacuaucaggucuguuucccagcuguggaaacacagaggguuaaguaaucuuuccaaggucccccgaccaguaagugguagaucugggauucagaccuagacagucaggcccuggaugcucuuccuuucaccuuuuuucccacuagcuaguuauuugaaauacgauuagucagguagaacccuuucauuacauaauuaaaaaucagacacaugcaaauaccaugggagagacagcacaugaaggguggugaguguuguguguauuuggacacuggguaccuaaaaagccaaagggacaucacagaaacaucaccaagaggggcaaaggaugucaaagcaagaaccuagaaguggacauugaucuggaauuuauugaggucucuagacucaggcaguagcuaaccagcagcuuuucaucuuguuucuguccugucaggacauaagaagcaaaggagaaaucauccaggagggaacauuugcuccagcaugaggcagcggagcaaggaggaguaauuuucuaagucuugcuuuccagcgcuucauuaggcucuacucuccuuuuuauuucagguuuaaagccccccuccaaauucacugcagucauccaugcggugaccccccuggucucucagucccagccaguguugaagcuucucguggcugcagccaagucccaguacugugcccaggugagcgggaaguugacagagaagccccugccugcuccagcuccagaccagagacuccgcccuccuuaccuguuaucccccgggcuccccaggcuccccgggacuucucuaacaucauacccugcuacucccuuucauucauccugccucguuacacccuuuucauccacuuagaaauucuuggaagugaaaucugcacagggaagggauggguuacagagagaccuuagcacugguauagaguuaaaaaguauauauacauacaccaacauagucucuaaagaagauacaagcacaugauuuuguuuuuaaaugucaaaaugauaaaguaacauccaaaaagccucugggaggacccagacaacuaagcuucaauagaagaagcagacuuguuggugucaugaagugucaacuuuucuuuucauagcaacuaugacuaauuauaaaauugggagcagacgauuaugccuaugguaacaauauuuuccaaaucaguguuccucccauauugaacggugguuuuucugauuugugaauuaguuuauacaagaagguuuacaaacaaggaaagaauucaauaaggaaguaugcauuuuugaacuaaaugccuuuauuggaaauuauaaagucacauaaaaucagcaaccauucuagagcaugcaaaacaugagcucaucuuaguucuagcuugaauuuuuuuauuucucccacauugccugguguagugcaaguucagagcagauguucagaugcucaguauacauuuuuauuuaauuugaucagaguuguuaucucacacaccaucauaagauaucagaauuuaggaaaccacuuuauuaagcuccagccaccguaauucuuuuuccugcagcuuuccccuauucccggacacaguugguuuuguuuguuuguuuguuuguuuauuuguuugcucuuucuguccucucuccaguuguuggggugauaauguucugagguugugugggaauggacucacuuuaaaacucaguuuugaugucugccguuuugucuugcugagauuuccagcuccucuuucucuuucugucucugagaagaggcuuuggguuggaggcauacauaaauacauccuaccccagccaucuaaugagccccaucccuuucagaucauaguucuauggaauugugacaagccccuaccagccaaacaccgcuggccugccacugcugugccugucgucgucauugaaggagagagcaagguaagacucgaaggggaccuauauguggaaccacuguggagccuugguuucuccauggggcacuuugggucuuggcccuagauaucuucucccuguuccuggauuauuuuuucuaaaacuguacuuuucucagaauauucucagauuugaccacaauaggcuuucaaaucagggaaaucugggucuugauaccaacucuuuuauagcuuugugaccuuguguguauacuuaaccucuaugagccucaguuuccucaucuacaaaguggaaacaauaauauauaccuuguaggguugcuguuaggauuaaauaaagucaggagcuggcaauaguuaucuuucuguaaaugacaaagaugaagauaaagcugauggugguggugaugguuugcuuggcugauuaaucugaaugagcuaugucuaucagaaugguguuucuuucucccauucacuuuaaaaaggacauuuucaccuuaauuuuguuuggcaucugccuguaaagauucucaugagugcuacauagccggccucucuucuguucuccaguucacuuugccuagagcugaacuaucuuucugaucaucucccggccuuuuucuccauuugcuagugcuuccaauuaacauuugaggccauguguaaccuggcccuagccagccuuccaaucuuuucucucauugcuuuccccuacagacccugcccccuacuacauuugaucauuuauaauuagcugaauugcgcugugucucuuccuaccucuaauuuugacuuugccauuuguaagucuugaccaccccucaacucaucaucucugcuugucaacauucccauauauucuuuaagcccccguuugcaugcuaccuccuccuugaaauuucuucuacuaaagagcagcuagcucuuuuuucucuagcuucugcuuguuacuuauagaucuuacgcauugugaaggaaauagucacuacuaaaugaaauugagauuggugaagcagugccaucuaaaaaacuuuccuugucaguccccaaggggucaggucauaagagaguggcucacaccuuugcgccagaaugacaaaaucaguuuauuaggcugaaccauuugauaucaucaucgacucaccaaaaguggcaauuucauaugguuugacauaaugcaauuguaacugucacaaggacaagaugaucagugcauuaucuauucaguuccauuuaugagugccuacugugugcugagcuccuuguaacaggcuuggaacacaguggggaaugugacaaauauagccauggcucucauaaggcuggagucaaacaaccuguuuguuagagagcugcuugguaagcauuuaaugagaaaagguggauguuggaauaaucacaugccucucucacaaaucaaucucaccauaagcacaguuucaugcaggcccuuauauccaucccccccauagaauagcccaucauaggaauggcaguguuccaauuccaaugccugaagccaugaacaguacucagaggcaggcaguuaauguugaacuuugggauucuuuguuuuguaugcuuccaugggucaaggagaccagcucugcuucugguggauaaugucuuucuuuggauaugucaggauauucagacacaauccagucugucugggagccauucugauuucuuuagguaguauagcauuuucaugcucugacucacugauugauuuuauauuuucauucucagugaaaagaaacuccccguuucuuucuuuauaaaaugguggugauaauaauaguaccuuucucgugggcuuuaucagaugucucuuacaagaugccucagauccucccagcugcaucuauauucaggccccuggcauuuguucaguccuugccuccaccuugggcacugaauccagugggcuggguucuuccuaugucuuuucccugacucucagugcccugggauugcaccucagagugaagcguuugcacuuaagucuugcuucaggcucaguauucuagaaaaccugggcuaugacaugggcccauuuugaggguuaaauaagaccauuccauaucaggugcuuaguccuaugcauauuauacaugcaccaaggguucaauaaauguuagcuccucuucugggaggcaucauaaucuuaugauuuguauuaugggcucuaaagucaaaauuacuuuugugugacuuaaagcaaguugcuaauccucugugucucgaugcccccuuucaauaaauggaaagagucauaauauguaacuaauaagguagccaaaaagaucagauuauaugagauacauaaauaaauguacugagaagugugggcgcacuguggauacucaauaaaucuuaacuauuauuguguuuuauauaauuauuuguguacauuucuuauguaccucccuccccaccccacacacacacacuacaagacaguaaacuucuugagucuuggucauuuccuaggcauguuuguuaauuuuuuuuuuuuuuuugaggcagaguuucgcucuuguugccuguccaggcuggagugcaauggcaugauaucggcucacugcaaucuccgccuccuggguucaagcgauucuccugccucagccuccucaguagcuggaacuacaggcaugcgccaccaagccuggcuaauuuuguguuuuuaguagagaggggguuucuccauguuagucaggcuggucucgaacucccaaacucaggugauccaccgccuaggccucccaaagugcugggguuacaggcgggagccacuguaccuggccaacauguuuguucguuuuaaaggaguugggcuuucacaugguagcuaaaccuuucuuaaaugaacuaacaaggaaaacccaguucacucagguuuaacuuuguaaauacauugguuucucucaugcuaauccauuuaagaaggucgcugaggcaauguguuugaaaaaagccucucauuucugcaugagaauucgaaaauggauggcuuaugggcuuuuuacuucuguugaugaaacagguucagaaaaaaaggaaacagauccuuuuaagaccugugguugggcagaugaugaggaagaagcccuacaucuuccucauucuccauuuuaaaaucucuaucuccaugaauuuagaagcaauauauuugcugcuuuggcugaaaaauucuguuuugaauuuauaggcguugucuuugcaguuuuccccugugggcuuaacaagggaaaggucagggcagugcuaagcuggcagcuaaugguuucugcguuagucaguggacauguaaacaguaucaggaggauugcuucaggcugagaauucugagcacugugucuaugagguugcugaucacuuuguguuuuauuucaaaagccugagaaagaaaacaacaacaacaaaaaacuugacccaguugacagauguguaggagcaaccccugaagccaugugugcuacagcuaugucccuugagcucuuggagaugaguuagaguggccacuguccaugcauuaaaguccuaggugcucugguagcuucgccggcaaagaaaccgaguuugagaugaggccugcagaugagcuggcuccuagggguacucagauuuggggagacugcagcucuggcagcuggcuagguaccucccuuuuccucuuucccuuugucugcaguguuaaguugcuucuuucccuggccuuugucucuucaaaguugauggcaggugugaauucagagaggaugucaucauccuuacuauaacuucuggaagaaggugaugagcauaugauuggcauauguguuccuaaauucacuuuugagguccuuuccauucagauacagcccgguggccaaggugcucuauagagucacaccaucugggggaaaauccuggguccguuuugggcaagauacuuaaccuguguaucucaguuucccucccuguaaaaugggguuguuauaaagaugaaacacgaugauauauaugaaggacuugcaacauauccuggcacacaguaaauguucaaaaaauguuauucuuauggugucagcauucuuaugguuaguuccucuaugguacauucaacacaaagguuuaaguugugacuaucacaggguaaccucuccacccucaauuuuuccagcugaugccauaaucuccaaagcccccaccacacacacacacacacacacacacacaccacugugugugcacacguaguccaccuuuccuuauuccagaacugcccaaacuuuaugcauacaccaccuucacaauuuuucuaaauccauggaucauaugugcuauuauuuaauauuuuuucuucuucuucuccuucuccuucuccuucuccuucuucuccuccuccuccuucuccuccuucuccuccuucuucuuucuucuucuucuucuucucuuuuuuuguuuuugagacagagucucacucugucacccaggcuggagugcuguggcaccaucucagcucacuguaaccucugccucccggguucaagugauucuccugccucagccucccaaguagcuaggaccacaggcaugcaccaccacaccuggcuaauuuuuguauuuuuaguagagucaggguuucaccauguuggucaggcuggucuugaacuccuggccucaagugauccacccaccucagccucccaaaaugcugggauuacagucaugagccaccacgccuggccuaauauauuucuuuaaaucaguauacuucucauuuuaaugaaguuauuuguaacuuuaauauuaccuuugauugcuguagcugcuaauauauguguauauauuuuuucuaaucugugcuaauacauauuuuaauuuguaaauguuuguaauuuguaaaagcagcacuuucuacagugaucugcucuccccgugguuuguguccacacuuggaaucacuucuccauccauucacucuuucgguugggaagagugggugucaggaugcagguucucugcucagugccucugcaucugccaagucuugucuuuaauacuucauuacuaucuauaccuggugaauucuuucugcccaucaggguccugcuuaaaugucacuucuaugaggccuucaccugcucuuccagacagcuaguugcuccauccuguggucuccuggcauuuuuuguaucaagcaaagacuggucaucugcuucuuggucuccucuacagaccaugaacucuucaaagacagggaacaugucugauuuaucuuuguacccucuuugacaagcaagaugucugcuacacaguaggugcccaauaauuguugaacaaauacaucugcauugaugggaaaugagauuccuucgguguugaggggugacaugauaguagcgcauucuuuaugcaggugaggaugggagaauuguccugaaaacaagacucugaaguuaccucuuucccucauucccuccccacugccuacuucuacuuccucccagguuaugagcagccguuuucugcccuacgacaacaucaucacagacgccgugcucagccuugacgaggacacggugcuuucaacaacagagguaagaacccaugccugaggagcagcaggugggcuguucaggcagucaccucauguugcacgaugcuaaugcuucuuuuagccgugccuuggcagaaguugaaaacauuuuucaaaacuuccuacagcgcugguuuuaaucagcccgauuccuguuagcaccuugcugccaccuggcacucugaggcgggcaucuccccuuuguugucucugcuaauuggcuccucauuugcauaacugggccucaccccuccucccaggccugcccuccuuuuuuguuuuuaaacagcacaguugugagcaguugcgcagaacugaggggaagggggagggugcguguucugcauuagguugaaaccaugcuuuccggaggagauaaucccauuccucuccacguauccuauugccucaguuaggagacucuauguggagcucuaaaggcagcuuuucugucuugguuuaaagagcucauuuucuuucaccuauacaagagcaaacgguuucacuucaagguugugauggagauuccuauuucagauguucagguaguugugccaaaaauaagauugccuaaagaaugcgcguggaggagagagagaggaggaaagauagauaugguagaaaaccaauuuuuacaacucgaaugaguauugaucucugaaaccuuccuuuaaaccaugcagaggaccaaagacagcuauauaaaaauggaguauaugagaaauacauuauuaauggcaacuacuaaaaagcauggagacguaacuacuuacaccuuuccccucccucucccugucuuuuuuccuuuuuguucacaaucauuuuccuuuuaauguaaacaucaguguaaccugcauuuuccuggacaccaaucuaguucuaauggccugcugcccacagagccaagacucaauguuggccuaggugaacucagugucuccuugaaauuccacagauguggccugacgcgguggcucacgccuguaaucccagcacuuugggaggcugaggcgggcagaccacaaggucaggaguucgagaccagccuggccaauauggugaaaccuuaucucuacuaaaaauacaaaaauuagccaggcgugguccaggugccuguauucucagcuacucgggaagcugaggcaggagaaucgcuugaaccuaagaggcagagguuacagugagcggacaucguaccauugcacuccagccugggugacagagcgagacuccaucucaaaaaaaaaaaaaaaauuccauagaugcuuucaaggugccaucagauagaguugcauagauguuaugucaaagggcaaccuaaauaaucccaggacaaaauguccuggaccucaccuuguuaaaaugcuuucuaugcagccgaagcucuauaaauacuuguugaaugagugguugggccaggguggggggaugcaugcuuuggggauuaaagguggacacaccgccaauugugucauguguagguuggcaggaggaagggauguugauaagcuuaacauucauagggaaagacagcuauggaauacaggguacaggucacucuggcuugcauuuuucugccacuuucugcaagggaagcuggaacacauucauucaacaaguauuuauugagagauuucuuuguccuggucuccaugccagguacuucaguuacacaguuccaggcuauauccaucugaguccuggcaacaaacugaauucaaaucagaugauucaaaugaaggaacuuuggauuccuuagggagguguagaugggguuaaaagaccccauaagagagaaugaggcaccuggugaguaaugacagcaggaagcagcuccucccuuuggccugaaggaguuagagaaggaacuccuucuuucaaaggcccugagagauggcacuaggauggagaggcugcucuacaagugcuaugaucauggaaggacguggcuacugccagaacucuaauggcaaaggagagagggagcagagaagagauacacugaccucucucucuauccugccucgauuuuccugccggugacucccauugaccuaacccaaccaggugaugcaguccauagggguccauuaucugagggcacagggcaggacaagaagaguggauaguggauuuuggagggcaaacacaggcaaagcagcacaccgccauggugcaacaaauggucaagacaacuacagcauguaccuuaaucaucauccuaugaccugaaguauugauucauccucuaucuuucccugggcacaaggcaauuagucucacucuaggauuguuuuucccuauccuauggugaaauaacuuucaacugcugugaugcauccucaugcuggugaauuucuuuucaaagaauagcaauuccaaccacucaaugcaugcugggaggaacauguguuguaugugaaguaauuagaagucaacguggguugaaaaugauauguaaaucuaagaggcuggcagucugguuugcuuuugccugcugaucaguggagugguuguguugccuaaaaugguccugggcaaggauuucucuuuucucuuuuuuuaggugaauagauguugguucacuuuucuuuuccucucuaaggaucucagauuguuuaaaugucucucugcagcauuaaggauggauuuuuaaacagcauccuauaaagggcauuauaguugguuuauaguuauuuacauuuaucuggauugcugcagacgcugcucaaaagaaaacagauguugguuuuugagagaaagggccuuaaacugaccuuugccuucuuugauguguuaauaaucugcaugaaauuagagcuaucacaagaaucauaguuuuaucugaauuuacuuuugaguuccuuugaaaugacuugaaacagccuuaagauaguaagaaauucaugcgaugagaacaccccauuggguucuguaguaguugcuagugcauguguuuccuuuucaaagaaugauagaaaaccccaaagagugcugacggccaggcugauccuuugacaacaggcugcauaauauacugucccaucaguugucuccauuaguauugaccacuagugaaaagguguagguaaucacaaccuaauuucaauuuucuagcagaugcucaccauccccugcuaccuuuuaacuuugagauaacgugcucccuaccaagcuuucuuaaugucgguuccaccacccggguuuuuuccccgcucuggauuuuuuuuuuuuuuuugacggagucucacucugccgcccacgauagggggcaguggcaccaucucggcucaccgcaaccuccgccuccuggguucaagcaauucucgugccucagccuccccaguagcuggaauuacaggcgugcaacaccacgcccagccaauuucuauauuuuuaguagagacaggguuucaccguguuggccaagcuggucucaaacuccugaccucaagugauccgcccaccucagccucccaaagugcugggauuauaggcgugagacacugugccuggccccguguggauguuauaguuuuggggaacaagccauauuuuuaagucuuccuuaucuuaagauagggcaguguauuaggauuuuucaggcaaacagaaucaauagaacauaauauauauauauauauauauauauauuuauacacacacacacauauauauaccuacacacaugcacauacauacauacauacauacauacacugagagagagauuuauuaugaguaauuggcucacauaauccugggggcugagaaaucccaugaucugccgucugcaggcuacagacccaggaaggcuacugguguaauucuagacagaguccuacagccugagaaccagggagccaaugauguaaaucccaguccaagggcaauagaaguucgaugucccagcucagccggcaggcaaaaagaaaaaggggaggaauuccuccuuccuucaccuuuguuuuguauucaggcccugaacugacuggauauugcccaucugcacuggcgagggcagucugcuuuacugaacccguggauuccaauguuagucucauccagaaacacccucacagacacacccagaaaucaucuuuaaucugggcacuucaugguauacucacauugacacauacaauuaaccaucacagguccugcuuuggaaccucugagagggcaggaccuggaccuagcagcaucccuccgucccccagcuaccaucacagugccaggacucaaaauauuugcgaaacagaugaaauuuccauuuguauugcuuauccagaagagauacggcaaagauaacgaggugaaucauagcguguauaagagacaaauugcuuuuaacacuggaguaacagagccaaaagagaaguuuugauaaaguacguagcacauuugaaaccagacugccugaguuugaaucuuggcucugccacuuauuagcucagcaaauuacuugaacuuauaucuuaguuucccuuucuguaaacugaagaauguaaaagccccugccuuacagggguauugugaggauggaaugaguuaaaauggauaagcaccuauagcugcaccuguuguauuauaacauuucacaauuaugagcauuauaugauuguuugcugucacuauuuuuguuauuuuuauuuucuguuuauuauuuugauuuaccauucaucaaaugaucauagaaaucagaagugaguuuaugcauuugaaaacagaucacuugcuaacuauaagugcugguuuauagcagguucagaagcaccugcuuugggcuacuauaagcaccggagagacauuuagcugcauuuccuuuaaaauaauucuguggcuucaguuguucuuguccccacuuauucuuagugauuuucacuguugaugcuuucuucuagugucucuuaaacugugcaucuucaaaccuaagaagccugaauuauguuuucuuuaugauaccugcucuguauuccuguuagaacuugugguguuuuuuuuuuaaaguuauuucucuuacucuuaagagggugcuuuuauuuuaggcacuuuggcuuugauauaugcuggguaugauauauguuguauauucauucuuuggauauacaugggaaauuucucauuuauaaaacagauguguuugugucucacgugaaucaaggcacgugcaccuuugaggaagggggaaaagaagcuuuuucaacuuauguuuuagcuugaacagacuggauuuuuaaagggcauaucagcaaauuuuuuucuuccuuucauuuccauacuacucugaaguuucuuuaacagaaaacauuaaaaugugcauaauuauggggcaaaaugucaagcagucaguuuaauuugcugaugaauacauagaauuaauguuucgccacaguccccggauuuugcauuaugaauuaguggggagaagguaauguuuuguugacauuuguuaacacuguugauugcuuguuuggcuuguguucugccugcagguggauuucgccuucacaguguggcagagcuucccugagaggauugugggguaccccgcgcgcagccacuucugggauaacucuaaggagcgguggggauacacaucaaaguggacgaacgacuacuccaugguguugacaggagcugcuauuuaccacaagugaggaaucuggacaugucucuuacagacuuuacauagcuuuuuauauuggcugcugcauaaauaggaacuaaggccaaaucuuguuaacagcauugaggaaaauuagucuguauccccgcuuaaguuuugcugaugugucaaauguguguuuuugaaaccagugaaaccucuuggcauguuucauuuccagaaauuaugguagaguaacauuuucaguuggucugaagugugaaaauacucucagggcauauuagguaacugaauauuuagaauaacaacaacaaaaguaaauaccuaagucagcacccaagggcacuguucuaggugcuugggauucaucacugaguaaagcagaaaaaauuccuugccaaugcaggucuuauauucuaacaaagaaagacugucuacauaauaauuccauaguuuauuaaggagauaagugauauaacagacaaaguguagaaaaggaucaagggugcugaagguggagauggggcagauuggggguguccagggugauucugauugcacaggugagauuugagcagagacuugaaggacaggaagucaagaggacaugugcaccaagaguguuguggcaggagaacagcgagaauaaaugcccugaggcagaauacuggagaaccaucgaggagaccacugugacuggguggaaugggugacaggaagucagaaaagucagggggcauggaugcacgaccuugauguccaucaugaggacuugacuuuuucucuaagugauaugggaggagggcaggguuugaacagggugugacauguacagcaugucacuguaccgaauacuguaggcaguuuuaacacagugauaaauccugcaggaccuugauguccaucaugaagacuugacuuuuucucuaagugacaggggaggaggacaggguuugaacagggaggagaaauccggcuuuucuuuuaugcauccacuguggauucuauguugagaagaggcuauaacagacccagaguugaagcagaagcccuauuaggaagugauugacauuaucuaggcaagagauggugggauccugggaccaggaagugaaugguggccaugguaaguagugaucagauuauuuugaagaugcuuuagcaugaugccuagagagucuggauguagaguuugaugacuccaagucuuuugaccugaaacacuggaagauuagagggcugaucaacagagaugaggaaaacuacagauggaacaaguaugagggaaaauauauagguucagucuuggacauguuaagacauccaaaaggauauauggaaaaagcucagggguggagauacaaauuuggcaguuguuugcauauauuuggucuuuaaagccaggggacuggaguaagauugccaaacuagugaggguagauagcuaacauuccccacucaaccaguaacaaaauaccugcucuucuaucauuagugaacacaccaaucuugccuuagucuuuuuaguaaagaauagggaauuuugcuaucucagggauagcuuggaaaugcucaaggcauaaacauuuaggcugacugauucuuggucucaagauuucacuucuugaaaguucauuguuccuauugcuucugccaccaccacucuaagaauuugauucacucaaaugauuuuuccuauaaauauaugcuauauguauauaaauacauuuuaaaaacaguaggaugagaaauaauucaaauuaauuauggguuuucuguuacgauugaccaccccauuaauucagauuuugcucuaacaggauugaaauauauaugguuuauagggcacaaauauagaacagucuauuguuggacucagagucaagggauaauauuaaauacaguucugauuaagccaaugauuaaaauuguuaagcagcuuuauaauauauagaucauguguaaauaacuuaucuugccaucuaauuauuuaguucuucuuucuaacucaccugucugauguuagaguuagacuggacaagcaaugucuguaugucuguaucucugugccuuguuuccucaucuguaaaaugggaguaauaauagaaccugccuuguaggcuccuuaugaagacuaaaugaagcauuucuuguaaaacacuuuagaacaauaucugguauauaacaaguaccauagaagugauaguuaucgucaucaucaucaucauuaucauuaccauucaugacauguuuagggauucaaagaauggguauguguuuucugucucagaaguccacuugucaucaugugauaauggcccccugugaaacccaucuuugauuuuuacagauauuaucacuaccuauacucccauuaccugccagccagccugaagaacaugguggaccaauuggccaauugugaggacauucucaugaacuuccuggugucugcugugacaaaauugccuccaaucaaagugacccagaagaagcaguauaaggagacaaugaugggacagguaaguauagaagagcccucuucccuugcuucacucacuggugguucagccccagguaaugaggacucacguuccucuagcuguuccacccaggagcauauaaugaggagaaaccaggaaugaacuacaucugaaagcuagaaaagaguguaugauuggugcagggauaauuaggaagacacaaguuaagaguaucuuuaugccaaggauguaaagcucuccuauaaucuuuaaggugacaugagaaagauaugucuuuagaguuugucuuaguccauuugggcugcuaugacaaaaauaccauugacugggugacuuaaauaacagacauuuauuuuucauaguucuagaggcuggagagucccagaucaaggcaccagcagauuuggugccugacaagagacuguuuccugauucauagauagcccucugcucauugugucuucacauggcagaaagaagggcaagagaguucucuaggguccuuuuuauaagagcacugcucccauuugugaggacuccacccucaugaccuaaucaucccacagagaccucaccugcaaauaucaucacauuaagaauuaagcuucaacauauaaauauuagggggcacaaacauucagcccucagcagaauuaaagcccuacaaauaacuuaugaaaguugauuguagguaccuuauuuaaugucuagcaaaccauacucucuuuaacacaguuuucuggugcuugcaguugaguugaauugugucuuggugacauaacaggaaucacaauauuuaauuuucaguucuagaaucaggauuuaaaauacaggcaagucaguaaccuucugaaacucaguuggcucaucuuuaacauggaaauggugaaaucuaccuuacaggguugaaauaauauguuugaaagcuuuuauaaaagugaaguaaaauauuguguugaguuauacaauuuuaguauuaaagguauuuucaaggaaauagaauccaacauuuucuuuuuauaaguaagaaaacuaggaccuagugaauuuaagcauauugccacaaguugcccaguaaguuagagacagaauugggaauugaaucccagggucuguggacuucacugcuuguccuuguacaccccaccaucuugguaucagguccaccuggauaugccgaauuucaucuaucuuuauucaucuugagcagagccccuacuauauguaagaaaucaaaaaucuuagccaggcacaguggcucauacugauaaucccagcauuuugggaggccgaggcaggcagaucacuugaggccaggaguuugagaccagccuugccaacaugucgaaaccccaucucuacuaaaaauacaaaaaauuagcuggucauaguggugcacgcuuguaaucccagcuuacucggguggcugaggcacgagaauugcuugaaacuggaaggcagagguugcaguggguugagaucaugccacugcacuucaggcugggugacagaacaaggcucugucucaaaaaaaaagaaaaagaaaaaagaaacaaaaaaccuuaagaaagagcauuaagauucacucacguuaaaucauggagcauccaacaggauugagguuaaucugaaugaacauacuuuaacaugguuauauuaguucaauuuugaggggcuuugcaugugccuuguucucacaggcauuggaaaacauauacaaaucuagcuuuugcaaaggaaaucuuagcuaggccucauguuaagcugauaguuuuucauucacuaaauuuaguaagcaaaaauuuaaaguuuauaaagaauuuaaaguuuauaaaaaguuauuuaguacuuagugagcauguuaccaggcacuguucuagguauugguuaugaugaaagagcuguccuuagcaaagagucuggcagaaaauucuguuuccuucuaauuacagaaagaacagauaagaggauuuguaaaaauuuuuaaggcugagagaauauucgaauucaagcaagauguauugucuauuaugugcccaaacauuuuuauuuauauuuuuuauuuaucucuuaagaaugaggauacauucugagaaaugcaucauuuggugaucuugucauuauccaaacauuaucaaguguacuuacacagcccuauaugguacagccuacuauagccuauugcuccuaggcuauaacauauauagcaugucacuguacugaauacuguaggcaguuguaacacagugauaaauauuuguguaucuaaacauuucuaaauacagaaaagguacaauaaaaauaugguauuacaguauaugggacaauagucaucuaugugauccaacauugauugaaaugucauuauguggugcaugacuguauauuaucucauuuaaggacaugacauuuuaaaaauauuuuuuuacucagaguucuucagaacacucacuaaguggggaauucuagucauacaaggccucuuaggggguggauuugugcuauuuucauagauuagccuaauucuaccaaacaguauuucuaguaauucauacaucuuuaacaaaaaaaucuaaauuuaaccuuaggucuaacuagguguauucagguacuauauuugcccccuucuuuccaucauacacauuaauuuauugaauguuuguaugaccgguaaaguaaauagauaucauccucuaggauuaggcuuuuauuacauaagaaaggcaucuuuucuaauagauguugguugacucagaauaaauguuaacaucuagaagcaaaacgauaccugaaugauucaacugaacuuuaaaaaaaauuuuuugaauaggaaugaguguaaacucuagacaguauuucuaguugcauauaugaguauuuugccuggguacagcacccuuugggaaugagugggccaaucaaaaauggcccacaggccgggcacaguggcucaugccuauaaucccagcauuuugggaggccagagcagguggauugcuugagcucaggaguucaggaccagccugggcaaaauggcaaaaccccaucucuacuaaaaauacaaaaauuagccaugcaugguggugugcaccuguaaucccagauacuugggaggcugagacacaagaaucacuugaacccaugugguggagguugcagugagccaagaucaugccaccgcacuccagccugcgugacagagugagacucugccuuuaaaaaaaagaaaaaaaaauggcccacaaacucauauccauuuagggucaaaacaaguuacauuugggauugucuacucugauaugaacucaaccagucagcuccauuugauaucuuucucugauuuaucaaguagaguuccccucauauaaaggcugaagaaugaagcuugaguucugccccucucuagccuugaacaaauaacucuaacuuucuuaaacuugcuuccucagcuauaaaauggggauguuauuaccuggguagauacuucaccagauuguggugagauucaaaugaacuccaugaaaacacuuuacaaauaguguuuuguuuguuauucugcuguucagagguaacuugacauuuguguuuaucuucaauguuauuuucgagcauguugacacuaugauucugaagugacucuuacugcuucucacacuaaaauguaucuucccaugaaaguauuuuucuaaaacugugaguacaacaaauacacagaacacacgugcauacauauacaucauuaaagacuugccuauugacauaaaugggcuuguggggguucccccauaauugggcagcccaucuuuuccauguuucauaaaaacagggauugaaagacaaugugcuuagucauucuauuuaaauuucagcacuccagucauuaaggcauucuuuuuaaaucaaugccaaucauuugcaugaucuaaaaauauuuaaccaacuuuaggggcaacacagagagcuaaaaacaugguagccaucuuuucuauuugucgagaguuaaucuuuauucugggugagcagugauucuuuggagggcugauugcccuuuaaaaaguaaccuuuggggguuuuagucaagcaggaaagccaacaauucuuggguuaagagaagaacagaauuuugagauuuuaguauaaaguuagucauacagcaacaugcucuauauaccacugaaucucaccuucucauccucauggagucacgucaauggggaggcuacagaagagaaaacggaguuuuagaugcugcguaacacuagccuugagugacauguaaaaggcacuauuuuguucuucuucaacuauauaugugaauuuuuaacaaaggauuuaguaggacccuuauaaagguaaagagauaguagaaggaaggaagugauggauagagagaaagauagacuucuaaaaguugguggguauuucuaaaucaacuacauaaacaggaaggauuuagaaaacucuuugaaagcagaaacacaucuuuaaucuuaguacuuggucccaagugcaaagagagguuuuagauugagucacuguaguagucgaguuucaguugcuaagucguggacugaccagagaauuagucaauaaauuuuagagaauuaaagucaacaugaaucuuuguuuuuguguuuuuaacacugaggaacguagcauaccuugggaaaaaccaauaucagcgauugcauuuucagcaggugcauagauggugagacuugguggccgggccagaccccaagcuuugcugcuugcucauuugccugacuccauuuucugcaauguuuccaucucaccuugcacuucucucaucauuauccuuguuucucuccuucucccuagacuucucgggcuucccguugggcugacccugaccacuuugcccagcgacagagcugcaugaauacguuugccagcugguuuggcuacaugccgcugauccacucucagaugaggcucgaccccguccucuuuaaagaccaggucucuauuuugaggaagaaauaccgagacauugagcgacuuugaggaauccggcugagugggggaggggaagcaagaagggaugggggucaagcugcucucucuucccagugcagauccacucaucagcagagccagauugugccaacuauccaaaaacuuagaugagcagaaugacaaaaaaaaaaaggccaaugagaacucaacuccuggcuccugggacugcaccagacugcuccaaacucaccucacuggcuucugugucccaagacuagguuguguacaguuuaauuauggaacauuaaauaauuauuuuugaaaugauugcuaugcagguuuaaacuuuuuuaaugaucaaaacuauuaaaaaccagaguucuuuguuuaaucaaa

SEQ ID NO: 21527 - RNA, 13316 nt, Homo sapiens
aucuuaguuuaaaacaauuuaaaaaaaacuauuuuuguuuuguaauaucuucaaaagaaugaaaggacaauuuuaugacaauacugcagacacagaauggcuaacaaauauacaauuuuacauaaaaaacauuuagcacauucugguuuauaucaaaguuuaguugauacaguuuauuugucaacccucagucucucucugaaucaggacuuucaaacucagcucaauuacacugcuacucaaguuucaaaaaagguccucaguugcuucuggcagcuaauuuuuucuuuaguuuuaaaauacucucucauguccuuuauccucuggucaaauuauuuuauuuccuugacuuuaaugugguuuccugauuugcauuuucauucucccacccauuucuaaagaaaaacugagguccaaaguuacauuauauaauuucauugaagaauauuuggcacaggugacgcaccauaugaucauuacaucuauuaaaaagcuauuuguucaaauuuugucauaaaaaugugaaaacauuuuauucuauguacaauaauguacacaaauuuaaacaggucaccaaagagaccagaaguaauuaaagagguauauuuacaguagcacaucacaguaaacggaaaaccauucacagauucaacauugauacuguuuuugugcuugguuacacacugaaggugaaggauauuacuccauuuuggaugaacugaauuuuaaacaaauaccucaaucauuaauaaaugcuauuuucaucagucaguaucaucauuaaauucuucagcugcugcgccugugugcugaaucacuccauuucuuucucuuugaacaucaucaucacaaucuguacugucaucuucguucaauucccugucagauucagcagcagcuucucuuacagcuuccucuggaguuucauuggguggaauaaauccauuguuguuagauacauuugaauuauccuugauaucaucuucgauguauacuuucugauggcacauuggacaaguaucuugaauguacagccauuuccgaaggcaaagugcauggaaauaaugauuacacgguguaauacgagcagauguuguaaacucaugauagcagauugcacauacaucauuuauuucuuguaagcggcucccuuuuauuucaggaagugaauuaauuuucuucacagcaguccuacgauucauaaaugucuuccagccauuuuuggcuuguaaguagauguuaaaauaugcauguaggcacaucauaaaagcccgaauuuuacuucccgacucaaacaucauaguguaagccccauuuccaaacauuacaacuccaaauauaaauucaauaauacugccuguugaacgaacguaguagacauaaucgucaagcuuuucccagaggacauuauaguagccaucaaucaugaauaacguauaaacagugagagaaacaauuacuuuuaagcacaguuccacacaaaaugcuguaacugcaaacaaccauguauuuagugcauagugaugccaaagaacauaacugaguaagacaggaagaauaaacaggcaagcagagacaaacagcacaggaaaaugucuacgaaaagaugacacaugagaggcacugagagacauuaauacagggucugucauuccauggauaaaaugcaggacugcaguuaauaaaaggcacauguuucuacuuaagcgaauaagucucucuucuggucuuagcccacuuaacccagucugaagagccaaaauaaaaaauaaaacaggugcaacaaagccaagacgccugucaucuuccucaguugauccaauaaaggccaauauuccaagccccaaauaaugggcuacugaggaaauuacagcacucaugcccaguacaguuaguguagaaucgcacccacuaauuauaagauugcaaaugaggucccaaaaaucaucccaagaaauaaagaaggaaucaguuucauuugccauccuuaagauguacauuaacacuguagccugagcuguaacucuuguuagccaaaagacucguaguaugucugggaaacgaauccucuuccauguguccuccaucaauaacuguaauccguaaauucgauacaugugccucaccaaaagauaaacauaucguguggaauaauaaaaccacuucaguuucacugccaggacaaacacuguauuuaaugugagaaucaaggaagaaguaaacaguaaagucucucugauguguaaugguagcucugugauuaagccuauuacaggaaccaagagauccaaaauaauuaauugugaauagauggaaugaaucuggaguaguguaacguauccaauuccaaauguuagcuguagaacgauaagugccauccacagcgagggaccuuuucgaggaagcagcucaauuccaaaagcugacguguuguaggcaccauagaagucaaugugcaaagaagcauaauaauucaccaacacugaaguugcagcuaacagaaaggcugagcuguacguguaaaacuugaaaagugaucguugugacaagaucagaacaauacuggaugcaaauacaccuaaaagaaagaaagaaaaagucauuugaaugaaguauuuguaagaauguuuccccacuaagaguuaugauauucuuccuuuaauuaggaaauaugaauauuuucaguuaugaacauuaagccucaagacaacuaaggcuuaaaggguaauaaagguuuuguaaagucagaguucaggagaacagaccaaacauacuaaauuauucuuuaaaauuucauuccuuacuuucuaauuuccaaaguauuucaaguaacacuguagcuguccaaggcaccaaauuacuaaauuauuuucaagaugaauuuguagugguacauacauuuuaacaaguuuuaaaacucaaaagaauaugucuuuuaucauuucauaaucauuaaaauuaauuuuaaaaauuggguuaaaaauaacccaaauggaaaacauuuauuccuauuaaguuuuagauucauuuauuauugacugacugagacaagagucucacucuguugcccaggauggagugcacuggugcaaucucagcucacugcaaauucugccucccaggcucaagcaauucuccugccccagccucccaaguaacugggauuacaggcaccugccaccaugcccagcuaauuuuuguauuuuuaguagagacgggguuucaccauguuggccagacuggucucuaacuccugacgucaagugauccgcccgccuugccucccaaagugcugggauuacaggcgugagccaccgcacccagccaaguuuuagauuuuuuuuuaaaggauucuuuaggaaaucaaguucaaguuuuauacuuccacuuaauuccuccuuuucuucaaacugugaacucaugccagcucuuauuuccuacuccuuaacucugagcauucuccaaaggguccaaaauuccauuuuuuuuccuccuaguuuccuucggacuuagaaacaucuuccaaguucccuuuuuccuguauaaugcugaaucuguuucuuaaaauagucaacucuuuuuauuguucuucacauuacaaaaguaacacucagaaaaccaagacauguuuuuagaaaaugguaauucuccuucccccacuccauagacaccaucuuucuuuguacucugacagaaaugcauauuuuaaguaggauuacaauaaacacauuauuauccaagguuucaacaaugggaaugacaucugaauacucaccuacuuucacuccuacaacugcaaaucuccaaaguucugaaacucgacuugccuuaaacuagaaucagcuuuuccuugugauuugcuauuucaguugaagguaccauuauuguucuuuuagagauacucccaacccagccccacaugcucaaacuuugccaauuaguugccaaauucuucuaacaccucuaucucccuuuucugugacaccaaucaaucagucugucucaaaaaacccucaucuuguccaaauccauuuacaagccaucaccaaauugccuuucuucauucccugcucaaaauacuucagcggcucugaaauuacuaucaacuaaaaucuacauucuugcuccuggcauucaagaacccaauuugcuuuacaguaauauuccuccuaacacacacacaucagugcuccagacuuggauuccccaaacacauuccuuucuccacuauagcuacagcaguguuuacauucuuuuugcuuggaaugauguccccaaccucccaaucccugacuauucaaauccuaccuauccuagaaaccuacuuucuuugauagaaacuguucuuucagcauaccugcagaacuuagugaaacauuuaacacucauauaucaccugauauuguagucugcaguuaucuaaguauaaucuacccuauuacacauguaucuauaacagaaagcaaagauccuacccuguccaucuauggauucuacaauauuuuguacaaaauaaguacaauuaguauucauuaggaaaugucugucacaucuggauguuuuuaaaggcaaccacaaaauauagccugcuugaaaaauaaaaucuauguuucagacaaugagaaaccauacccuggaguacagaaaaagugacaaacuccaaauuaaaaauccaucuuggcugggugugguggcucacaaugguaaucccagcacuuugggaggcugaggcggguggaucacuugaggccaggaguucaagaccaugucaacauggugaaacccugucucuaccaaaaauauaaaaauaugccagggugguagcacgugccuguacucccagcuacucaggggguugaggugggagaaucgcuugaacccgggaggcauugcaguuagcugagaucgcaccacugcaugccagccugggugacagugagacccugucucaaaauacauaaauaaauaaauauuaaauaaaauaaaaauccaucuauccaccuuauuucagcagguaaucaagacauugcauauuauuacaguagacgcauuucacaauccacugcacauauaagcaagggcuaguucauuuaagugaugacucuguccagggauuuaaaauguauucugugccaaaaugucaagucaucugugaaaaggaaaacaaaaggacacaauaaaguagaagacauauaaaccucuaaauacaaaccaccugauuccccaagaaaaugggccacuaauaaucccccaaagaguugugagcucagaacaggcucuuuuaaauauauauauuuuuaauauauauauuuuuaaauauauauauauuuaaauaauauauauauauuuuuaauagauauauuuuuaaauauauauauauuuaaauauauauauauauuuuuaauauauauauuuuuaaauauauauauauuuaaauaauauauauauauuauauauauauauauuuuuuuuuauauuuuuuuuaauggaguuucgcuccuguugcccaggcuggagugcaauggcgugaucuuggcucacugcaaccucugccucccagguucaagcgauucuucugcuucagccucccaagaagcugggauuacagguauguaccaccacucccagcuaauuuugcauuuucaguagagacaggguuuuuccacguuggucaggcuggucucaaacuccugaccucaggugauccacccgcuucggccucccaaacuacugcgauuauaggcgugagccacugcgcucggcccugaaaagauuuuuuuauuagaaacuucuuccauggaagguaacaagaaaauggaauuaauucagccuaccagaugccauauguaaucuuacauucucuacauggaaaaccaccuuauuuuccugagacaaaacuucagaaacuuuaaaacaaaucuucuaaguugggucaaaaccaaaacaaaauaacucuaguucuacuuuaugccacuuagaggggagaaagucaagcaggaacuguaaauuauuuuugucaacuugcuauucacaaaguaguaaauuaaucuucaguaacuauucaugagcuuugccauaauuuuauaacuaauuuuuaaaauucuaauaacuuuuuuccugaagcuuguuuuuacuacacacaaaugaagaaauuauuuggguuuuagaaacauuucuagugaaaaagugccauuuugcuuuaugcaaauguaucaaagaaaaaaaggggaaggcaucagauagacaaauaauguaguaagacuacaaccucaaaauuuggauguaucccagcaaguaacaaucugacaauacucuauccugauuaaaaucacaccccccaagauguaauagugaguuaacauuucaagaauaguauauguuuguuuuaauuccuacccaaaguuuguagguauaugggguucauagauuuuccuuuuauagucacguuccuaccuauggaauuugggaagaaucugcucucauuuuaaaaaccaauauccuaaguaacaagucuccaaaguaaucaucuuucucauggccuuugcagaauaauaucaaaguuucacugcauuuuuacauuagacaugaaagccuuucuugguauuuaaacuguaggucuaagaaaauauaaaaguccagagacaguuucucauuaggauuuggaagugacuugcacaaguaaucaagacuguauauaaaugcugcuuuauaaaaaauuuugagaacagaauuuacugaaaucacaacucagagaucucaguccaauucuccagugauuaagagaguucacuagaguuuucaagguagccaaaaagaggcagguauccaaaucaauucaggaacuuugaaacuauauaugaacucaacucaugaaagaguucaggccuuuucaauuuggauuaccaaaaacaggcaaauaaaaacaaaagaaaaaauaaaaacuuacuauacauguuacauaacaaaguguuucacucuuuuauguguaaagucuauucauacccuuacccucuuuuggaaacuuaugacuaaaaaucaggguacaaaacauaauauuuacaauucuccaaguacccgaaauaccucuaaaacaaaaagcaaccuguggaaaaacauuucaauaccugacagaauaaauauggaaaagcacagaaauaaauguuacuacuaccuuacucccaagggagccuuccgcaaugaaguuuacaacaaagugucuugaaauguuguuaaucuguugguauacuugauaaauuauaaagaaaacauuucuauuggauucucauuuuagguugaaaaaaaaccugguauucuaaguauuaacacaaaauuaaacuuuugcuuuuaaacuaaacuuauaauaaguaugcuuuuaucaaaaauauaugaacauggauuuuaaaaagccaaacccuacagagagguguuaaaugaagaguuaaagcaaguuuuucuaguuugucuuucccaucugugauaucauaaaaaaaauauuaauauuuggucuuugucccauuuucugacauagcuucuaaaauccuuggaaucucuggagugaugacuguuuuguacaauaaucagaugacuggugccugggggccccuagauagcuucaggaugggggcuagguagccaggggaaucagcccagugauuaaggguuauaacuuugauuccuacccccagccgccacuucugggaagaaagaagcugaaacuugaguccauaaaccaaugacuagugaucuaaucaaucuugccuauuuaaugaacuuccauagaagcccaaaaggacugaguucugugagcucucagauagcugaacacugaagcuccacgccccuucuccucuucucuccuucuuugucucaccuuguacaucuccuuccaucggguuaauucaucuguguccuuuguaauugccuuuauaauaaauggguaaauguaaguacaguaguucccccuuacccaagauuugacuuccuuuuuuuuuuuuuuuuuuuuuuagugauggagucucgcucuguugcccaggcuggagugcaguggugcgaucuuuugauuaacauagguuuuuaaccucaauaucauucgguuuaucaaucuucauuauguauuugcuuuuauauauuuuuaaggauuucuuccuuaaucuaagauuggaaaaauaaaauauuccauauuuuuuucuaaaaauuuaaaguucugcauuucauauuuacauauacaucuagguaagaauacacuuagaaaugacuauuuuuuuuuuuuaagagacagggucuugcucugucacccagccaggcuggagugcaguuaugcaaucauagcucacuugcagccuugaacuccuaggcccaagcgaucuucucaccccagccuccugaguaagauaggacuacaggcacccaccaccaaguauggcuauuauuuuaaauauuuauuuuugcagagacagggucucacuacacugcucaaccuagaagugacugucuauauauugacauaagguagacaucuaguauaauuuauuuccaaagguguaacaaaaugaucauuaauucaacaguccauauuuaccucaauguacuucaauucuaucucugaaacacauuauuucuauauauacauuggugucuguuucugggcuauguaauuauaaauaaggcuaaguacuaaucuauuugucuaucccaaugguucucaaccaugauuuggcaauauccagggacaguuuuggcugucacacuggggugugggggugcaaggugcuacuggcaucuaaugggcaggggauagugaugcugcuaaaaaucuuacagugcacaggagagcucccauccgcaaacaaagaauuauccuguccaaaaugucaauacugccacuguugagaaaucucugucuauuccucugccagugauaauuacuucggcuuuguuuuuucacuucagagguuuucugaagucuuuuucggcaccaaaaauagcuaucucauuucuuucaagaacuuuauugcauggcuagaccuaauacaaugaacagauuuguaucaauacauauuuagauuaaguuuguugcuuuguuauuuccaguaaugcuugcccauaguccuuaagcaaacuaucucucuaggccaauucccuagaauugaaauugugagucaaaaguuguacgagccaggcaucccagcuacuugggaggcugaggcaggagaaucgcuugaaccugggagguggagguugcagugugcugagaucacgccacugcacuccagccuuggugacagagugagacugucucaaaaacaaaacaaaacacugagaagucaguuguaaaugacaguugauacugccaaaugguuuuacacugaaauuaagagucuuccgggccaggcacgguggcucacgccuguaaucccagcacucugggaggacgaugugggcagaucaccugaggucgggaguuggagaacagccugaccaacauggagaaaaccugucucuacuaaaaauagaaaaaaauuugccgggggugguggcgcuugccuguaaucauccuagcuacucgggaggcugaggccggagaaucgcccgaaccugggagguggaaguuguggugagccgagaucacgccauugcacuccggccugggcaacaagagcaaacuccgucucaaaaaaaaaaaaaagucuuccaaaauuguauaaauuuaccuauuucaaaaagguaaauaccuuugcaaaacuaauaaaacuuugaacucuucaccaaucugauaaauuuuuuuugacuuuuuuuuuuuuuuugagacagucucgcucuaucgcccaggcuggagugcaguggcgcgaucuuggcucacugcaaccuccaccuccccgauucgagagauucucgugccucagccuccacaguagcugggacuaugggcaggagucacugcacccggcuaauuuuuugguagacacggguugugccauuuggccaagcuggugucaaacuccuggccucaagcaaucugccugccucagccucccaaagugcugggauuauaggcgugagccaccguaagcggucuugacaguauuuaauuauaaacaaggcuagguacuuuuuuuuuucccccauaaaaucaagcuacugcaggaagggcuaaauacuuuuucucuugcuuauugaacaucugcauuuuguuuauugugaauugcuugucuuaggcauuuuccuaagggaguauaaguuuuuucuuguuuuguuuuguuuuuuuuuuuagacagagucucacucuauccccaggcuggagugcaguggagcgaucucggcucacugcaaccugcaacucccugguucaagcgauucuccugccucagcuucccuggcaggguaaaacucuuacuggaacgugaaucacuuaugauagaaguauuuuaucucaguuugucauuuaaggauucuuuuuuaagcuuugccauaaaaaagcuuuuuauuuuuauguacugaaauuuuucagauuuuuccuuggaacuucugggucuucuguuauguuuaaagccuuuucccaccucaaugaauuaucaccauauuaguaauacuauuaaaacaaacuccuaggcuugcauuuucugccuuggauuuaaauuugcuaacucagcauuaugcugcucuggguugaguuucguuuaguauuuaacaucccuuaaaacacagcuuuauguucuucaauauuccauauauugucauagaauuuuauuuggaucuccaaaaugaguugcuuuauuuucuaaccgguugaaaucucaaauuaguuugauaucaaaugaagguacaguuguagcaccauuuuguagguagaggggaguaaauacuucuaccaccacacauaaaacugguaaugcuuuuuacuuagagauuuccauuuuuacacauuaauuuuaaagaaaaaagugagguugacaagugguaagacuuauacacaguaguacugagaagucuacaacuacaaaaaaacuaacaaggcagaacgauuaauuucaacuauccauuggcauauuuacacacaaaccugugucuuuuaguaacauaauuuuuuagcaccgaaaucaguuuuuuucauucuuaucauccuuacaaaugugaaaaauuagcauaauuacaugacacaguaagaagagucggaugauagauuugaagaguauuucguauuucucaaagucugauccagagauuccagggaucaaaauuuucaaauaaacaacaccaauauuuugccgaugauuucaaaagaccaaaauaucuaacaaaauaugguauuaaaugaagcauuaaaauagauuuauugucuuuaacacccuaugaaacagauaaccucacucuccaucuuuuaaaagguaaaaauaagaaaccaaagcacugagcaguugccuuaagucauguuguucuuugucaaacacaaacuuccaagauuuauuacaaaagaaacaugccuaguacaaggaaaauaucagauugcuuuguucaauguucuuacacuacaaauuauuuaauuaaagaaaauacuucuuuuccuugaagcugccuaaccugaagcucaacagacuacugcauuaaagcaccaggucccaaagggauucucacagaaucugcaguuaucaugcuguaagaauauucaaagcagucacuacacuguuucugggaugaacaugcagaauccucucaaacagagcccaguuuuuaacacaaauuaugguggugguauacguuagcaguggcaaguaggaaaggcuggaauuagguagcagguggguuacugaagcagcuugggcugaacaucacguuuacaucuuuaguuuuaagaucuagcauaugaucauuacuacugcauucuguaucuggauugcagcuguuagggaggaaaguaaaccauauuuaaugucaaaagauuuuuaagcucaggcucuggcaaccacuuagcggcagccuaccaagagcaaaacacuuaaccucuaugacccuguuuccugguuuguaaaaugacaauaccaccacccaccucugggggauguuugaagguuagguuagauaauaccuaccagugaaaaugcuuugcaaaaggaaaauaccagauaaauguaaaauauggcuauuuauugcuaagaacaaaauucggccuuuauugccacuccucuuuugaaggaauaaagcaacagauggcuuguaauucagaaaggcuugguaaagaccucaccaucagucugcccucagcaacacuucaaaagcacuagccuacuuaagaccgaucaccagaauuaccucaucaacaaaauuugccaaguuacaauuacuuaaaaaauuauuuuacgcauaaaugcaucucccucugaugauguaagugaagauggaaaggaagaaaugaaauauaagauacuuuuaacacuccauccauacgaaacaaagacaaugauuuucagaagucucuuuggcaaaugucucaucacuuuuuacagucacuuucaauaccuucucguuuauucauggaaaauuuuaggacucgauuuaagcaucgccgcuuucaugagaauuuuugguaaugguuucaaggucugacauucaaaacccugucuccuucgcuuggaugucauuuacugcagacacuucacgauccuguggacccucgggugcagcagaagugacaacauacaaguacucggcauuugguaauaaagggaaacugaggcccacgccuuggcagaaguccaaggucacacacgacgagacugggauagcagaguuguuuuucgaaggcugucgcauaggacgcgguaagccaguacucauuucccaaggcaaacgggcaaagagcugcaugcucacacauccuuacuuucuccccaccucacucagguacaacacugaauccucgcuagggggacugcuccgcugucaacucagacaaguaucaucuccuucccccucccaacccguaaagacgacccuuugagggaugaaacuguaguucccaaagacacauacucgacccauggccucugcgcgccugcccgcuccccggggaacgucucggcccgcauagccgucccgggacguacgguacccuguucccuuaccaaagagccggaggaagaucuggagcacgaugcagaaccggcuuuggcuggaauccggguaggaguugaagauggcgucgaugauguaaaggcagggcacccggagcgccacuucgagcgccgcccagaccugcugaugggccauccgcaccugcugcugcgggggccccacggccgccaugagccgcugccacacca

SEQ ID NO: 21528 - RNA, 60088 nt, Homo sapiens
guaaacaaaccucgccuggcucccagcuggugcugaagcucgucaguucaccauccgcccucggcuuccgcggggcgcugggccgccagccucggcaccguccuuuccuuucucccucgcguuagguaagcccgcgcccucuucucccaggcgcgacgcggagcagaaaggggccgcccgugcggugccgcuggagcgccaggaccgcccuuuguagccccgcguacuccaggaguaagcgccccggagcugcaagugcgcggucaccccggggcgcgggcgcgagggggcuuugggugcagacaccgcugaagugggggguucaauuacggaaagggaggaaaaaaagacagggucccauucaucuccccccuagcuggggauugggguucuggaggucgggaagggggcgaugagacgguccgaaaaaauaccaggauagcguuuccuggcgucgucuccgaaucccagcuggcgccgcuggcaggggugcgcgcuggacgugggugcagaagggacuaggugagugugugugugugugugugugugugugugugugugugucugugucugggaacggagagauugcgcgcgaguguguagaugagggguugguagaggugaguggcgcuggcaaggaggcuggagaggggggcgugggugugucuggcuugcagacugggucgggaacggguguggauccgagaggcugguggcgcuucagucccguagcacacacagggcggugugcaugugugaguguaagcguguguguggggggaggguccagggugugucacagugcaacacgcgagccggagcaagugucugcgagcgccacugggcagggugcgcccccggaggaacccgggauuggcgcaucggcggcgugggagaagugaccugggcgagaggggucucgcggacauuuggcggccccuugagcuggcuggagcuaggaguggcgucauuuucgccuccgcccacccucccccgcuuuccuccccuccccugccucuggugcuggccgcuccugcccuccacgggggaaaacagcuggaauuacuucgacguuccugggggauccgccgcggucucugauucagccucgggaggagauuucgggcugggcuuggggaaugcggcugguucugggggaaacacgcugucacgccucugucaaauuaguagcuggagcugggauuuagugggucgguuccuuacccaccccucccccauaucccccgccuguugucccugcugucccuggggguccugaacagcacgccucuguggcuuggaagugggagaugccuggcagugggugggggaggcagggcccuugguuaucuuaugcccauccaagaacaccccuuccucacggacgcugggggcacuucaguuuguuugguuucuuuaagcuacugggaaauaucuaauauucagaagucagccaguggccaggcaggagggcgguagacauccuuauaauacccaucagcugcacgggaccuucuccuaagcugccucaaaagaacauaucuaaauacaaacccccuguucuugcugcagaaauguaguuucaaggcgaauuuuucagucuagacucuuccuguugagaaauucuggcguucuuauugaguuucacaaaugugauugaaauaagcaagguacagagggggcaaaccccagcgccuuucuuggaagggcugccuucugguggggaagacacacggcuggagacgcagaccgguucugugugguguguguggcggcagagccagccccaggcugggguggcacagugucggggaugaaggaagguguaagggagagagaggguuuugguguggauggaaaacuggguguuccccugaccugugacuucuuagcuuugugggaccgugucucccacugcaucugggcaaggaggaggauuugccugcccugcccuguaaccuggccccuggcccagcgccuggcaggugggaggaguugaaauaugcacaugggaugaaguggauggcucugggucuucugccccauucuccugugaaccagcagguugaguuucgggcgagguaauagacugugcauggguggagguguuggcuuuugcuuuugagggauccuggagugucuguuugggucucuugugaggaaguucuuuuggagcaacaaaguuugaucauuuggaauggaauaaaaaacucacacaggaccuaccuaguccaacuucuuuccauuuuacagauggaaaaugaggcacagggauggggagggaugugcccaggccgaacugagcuggagcucagcuuugugagaggcuccugggugggacugaaggcaguggaaaggguuccuggcaggauuuugccugccugcuauggaggggcgaaaggaaauugcaucuucauugaauuucuggugaggaaacuuuugaggccaaaggggcagagcggaaugauuuuuuuuaaguguaaaucagguguucuugagagauuagcaaagccagccugaagggcaggggcuuagaggcugcagcccccugaguuggccuuugacugaauggggcugccccccccccaugacagaagacagaucucaacugagcugagggccccccuggguuacguugaaauccgcuggccugaacuugccuccucauggaccugaaagaaagauagcauuguguuuuucggguggcccaaagcugcaguucuuccuugggacccaaccccagagaaucccauuccagaugugacucagaggccuuguccugggagagaaagcgugaugacucagcaucugagacucaagcaggguucagguuugacucagccuggaaggaaggccagggagggacacgacaucucucucccuccagagcagccacugucucccuccaucugccuucauccucgcaagaacguugccuggaucguauugcuccauugaauggaugaggcaacugaggccaggagaguuucaggauuugccuguugccauauggcucaggugggagagccagacuuugaacccggacaguuggacuucagagccuuuguuuuuuuuccaugacaacauguuggggcgccugaagaaaucaggcucaaaugaaaaggcagucaggagcuccaugccucaguuugcuuuucuguaaaaugagaguaacagacaugaugccaucagaauguguaaauauuaaucuguguaaccugagaacagcacugagcauguggaaaacagcguguagguguuugccgucaguagcacccgcagaagacauucucaaggcaucuucuuggcaggcagagucugggacccuuuguccuaaaccuacccaaggcugugaaagugccugcaaaugcuugaccuagguauugcuuuuugcuaagcuuauguagguugcauaauagugucaugaaaaucuugucugaaaugcacauuuccaggcccggucuccugcgauucucucuccaucaggggauaugcuguuguuucaaagcuccuuuggcuggguugggaaugggguauccugcaggcagacagaguugagaaccucugcucuggaaugacaggggagagaagaaggaagguguagucauacaugccgcuguaccuucaggccacccuguguccacagugccagggaauuagugagugcucaguaaauagcucuuguuugcuauagugccuuggagguucaaugcaucacaucagcuaacugagguagaagacauucuuuccaccucucaggucagaaaauugaggcucaggcuggugacucuucuguccagaguccagugagugggguucugcccaaggugagccuccugagcccuuuccacccuccaacauugcgcuuggaggccacccacacccucugggcccaccuuuugagaaggagcuuguuuccuggauccaccccaggcuguuguuccugccucccuugauggcugugugauggaaguaccgcguguccacuugcuuuuuaucuuucaacuuggagauagaggcaggcuagauagcggucuuggcugagaacuuagcccaggcagguaggcagaagggcuggggacacugaggccccacaggaaggcggcugcagagguagagggccaugaguaggugccaaccuggagccguguucucggggugggggccaugugaaaagaaaccugggcucccucggguggggcguaagccccagcacuacagaaugggaauggauuacacaaucggggccauaagcaggucucuuugacccagaucuuugacuuucccaccuaacauuguuugcagaccugccuaugcccuaccugccugggcuccaucucugaccuuuugaguccagcggguuuucuugcaacugagcugguagaaagugaggcuccuuaacagucugggggccuugagugcccuccccagcaguuuaaucuuuccuuucuuuaaaucuguggggagacuuucugcagcuauacauuuuaaaucugcauagaguucuguuugaagagaggugggugggggcccaggucuccaccuuguucuccugccuucacccucugccccacccccacggaaccuaagaagauuccaaguaacccucuucaaauauggaugugagagggccauuuaagaggugggucuauggccucucucagcugggaaugcuuaccaucucuccuuccuccuuuuuaaucauggaacucuccuccuuucuccagaaaggccuccuuggcuguccucugcuggaggggaggcuggguuggguccuuccugggaccuguccaugucucccaugaaaccugagagccuguccuuaguagguguuguguuaguggugguggaaaggacaucuccacugauuaaggaaguaacuuggaccaucuugcauagacaagaucggaggcccauuccggaggguggaaacugcaagaccauucuggggaaggauccuguuagcguggcuagcaucccaucucgggacaaaggguucuguaugaggaagccauuuccucguccucugcuaacacuggcuccguuugugugauuuccacaaauuaucucagaccauccagcgcagcucaugccugucuugcaauuucacaaaauaauccucuaaggagaccaguguccuccuuuggacuuccaguuauucaccucguccccucagacggucgucuucugucugccaaacaaauuacucgugcugccaaaacuccacugagaaucuccaggaagaucucgguuguauugcagaaaagaggugggcccugacgagauuccugacaccucccucuuccugcuguuguguuugggacacucuugcugaccucccuggugcugugcucaaguugaacacacagcaguucaguuucagcuccagccccucuggacccacacccagggagugaaugcggcuuuggcuuguuugagagggagacagugggguucaccuucuuagugaucccuuuuucauuccuugaauaucaaacaucacugaugccuccuggguuucaggcuccacugcaaaguacaggggcccucgaggaguuccuacugugguuuuguucucugacauuuguacuguuuccuugauucugauugcucugauacaguucccuaaccucuaaacuagggaacuuucuugaagguccagugaauccacccauauuguuugcugaguugauuaguuaagaaagacaguucgugaagacugccaacuuccucacccuccccagggccuugaguuucagaagggccagaaaacaccaagagagcccaugaacugcuuuguagcuugacuucaaaaucucuuugggcaaagaaaugacaaaggauuguauccacaguaaggcagggcuauccagggccuaucucaaggugguuuuccuugagguucaggcagaaauggugcuguucucggcaauuuucuggggaaguugcuacagcaaacagccacagcacauguugauuuuuucccuccuuuuaaaaaucuguucuauaaagagcacaaugugcuggagagaacacuggcuuucauguggccuuaaaaccaggcauguuacagaggguggaaucugggccaguugcuguuggugacaaucgaugcuacccuugucagcaauucccgccugcucucccuuuaucugcuucacugaaggccuccaggggacuguuguccgcccucccccgagggaaugagugccacaccugcacccacaacaaaccagugaguuuuucaccuuucccucaguagggaggaaucuagacauguggccuuuggaagucaagugggccuuuguguuuguuuuugagccucagguuacccauuugugaacuggguauaauacccagccucucccggggcaaccuccuugaggagcaagugaaacagugugcugagugaaugcuuuuccaaagcauugaguuggccgucuuaggaagguacuaugggggagcugaaaacagagaaccuucuggguguugugaagggagaaaaguucaagaugcugguuuugccaaaagcucaagccugcucaugauggcucaguggugacugcaggguggaggagaggcaugugacugucccagcugaccuccacacgcugaaagccucauggucacgugcagcccaccuuacaacguuguaucugggccacgggugguggugaggacuguggauauauuuagggcaaugugagaucauugucaacauucccuuuaagguugcuuuaaccuuaaagcagccagcuugaugcuugcugacuuggggcacacaucuuaaccucuugaugccucaguuuccccgucuguuaaauggugacaugcuggcaccucccuccuaggguuucugugaggcuuaaaggaaguaccggguuuagaguccaguuagugccacagauacuguuccuggugcuguuuuuguggugugucuguguaggguuacauuguugccuuccuguggcugcucuuccuggugggcggaaccuggaacuucuagaacagaucauggauguuucucugcuggauaccccuucagccucacccugugggaguuguggcggggcccaggagaguuugcucaagagggugugcagguggguggcagagcuggagcaaggcacuagucuuaacagacaggagucugaggcuggcagaagugggggccuugguccaaggugcggggcuaaucuggccagagcugagccuggcagggccuugguaagacccuguggcccuuuugucuuggugaagcaccuuccugccuggguuuccauuugccuguaaguuuguuguggacagcgugaucuccauagacguacacugugccuacuuuacagauggagaaaccaaggcccagagaggaagugacuugcucagagucauggaauaggaaaguggcaggguccccaugcccugauuccuaggccagcguuccugcugccccacugagguuuuugggaaucacaggcucugugugucccccucagucccccaggggcuguugaacaguucucaaguggugucggauuacugaagaugccucugcccacugcccucccaggucccagggucacgggucacguucuuuucuuccucgggcagauccuggccuuggcuuugccuggcaccugugauccagcucuccucugacucuccugggucugcuggacuggaaggguauuuguguagccccucuugggcccucauuacucauugacagacagugcugguggagagaagggccccaguggugacgcacugggccugauaaucagaaaccuugguggcauuugcugagcauuuuccaugugucccucuccucgcugggacucuaggacugaaacccaggccacauccucacagauguccuggcaucuccaaggcaacccugaaaggaaaguauguugaugaauuaagcaacuguuugcuuaauucuccaugccauucuugaauuuaagccccacugcugaucauugggagcaggaguuagcaugcccauugacagacaagcaaacugaggcaaagagguuagauagccaggcaugguggcauaugccuguaaucucagcuacucaggaggccggaguaggaggaucacuugaacccaggaguuugagaccagucugggcaacauagcaagacccugucucucuaaaaaacaagaugaauaauacauuuuuaaaaagagauucgauaaauuaugcaggaucacagagcuaauaaauggugacaccauggccugcaagccuucccccagcuccuggcuaccuuucgcuucucuggcauuggucuucucggaauuccucccaggcagguggaugggaaaagaagugaagauacaggcuggcagcuggugcugugaccuggagcccuguuuuuggugcuaagcuggguuuuagcugaaggagaccugcuggagggguuucuucugugcuucuuggggagcaaagauggccuuggagauggagacacgguuugucagucccaagccacuccaaagguggggcuggugggcuaggagucagcccugguucccccgccaugcuguguguggcccugccuugccaccccaccugcuggaggaccucuuugaugcuuucuagugggucccaacauucugugauuaggacuuugcaugaggcagagggagggcaggagcuggaguccagcaaggaccucaagcccagggacaggcuccaccugccacacuugcuaagccgugagggccucaggugcccgggaggagggagcaggaguggaagcaccagcucgagccgccaaaccaggucacguaucaccugccauuuccugcuggcagaaggagaucacagacaccagaagacagcagcuucugccagaacuggguccuuccaugauucucagguggugacuuugaaucccagaaaaaguguuuuggggagaguggagugaaggaagagugugaacauuggaucugacuccacuccagccccugugcugcagccagcagggugagcucaggacagcuggcagccgcuugggcccagcccccuccuccgugaaugaaggugguggggagugcacgugugcgugugagugcgugugaguauaaaugacuguggaugugagaguccaugaaagugagaauguaucaguguguaagaaagugugaguaugugagaaugaguguguuugugagaauguauguaugugugaguauaagugugugaaugugagaaugucugagugugagaaugaaaguuugcaagugugucagugugagggaaugugugagugcauuugagagugugugugugugugugugcgugugugcacgcaugcacuagauuaaauaagaaugcauccaacugacauuuucuggauacuguuaccuacuaggaauuacuaaaaucagcuauuccagaggaggguggaugucgcaccaggggacauuuggcaacguuugcagauucuuuugcuggucgcagcgugggguguaugcugugggcauguggugggcagaggccagggaugcugcugagccuccucccgugcucagggcagccccuaaggcagaggcugcuuguggggcccaaaugucagcagugcugagcugaggaucucuguccaggaggcacagacgcuguccuggaugcuguccagacagcaucugcucugcccuccagggggacagacagacaguggacacagcccagaugcagccugaugagugagcccaagggagugccuguccccucgggacugugagcuccgugggggcaggaacugggucuguuugcucaugauccccagaugagucccauagccagucucaucaccauagcugguguuauuuuuguucugagcucuguguugggcacauagaaccuaguggguagaaaccucugaauaaauccugaguuuuccauccugcuuccgugaacucagauguucuuugagggccagccugguggcgugggggcugggagugggcagauuguagggagccaaguccugggguggagugggguucaggccccuuucccuggcuugagccgaagcaccuuggcuuuuuaaauuuuaaaauuuuuauuuuuuaacauuuuuauauguugaacuuccuuacaugauuuccuuuggauaaaagcuccugcaaaaaaaguuugaaaaguuuuuugguugaggcaucagggacaagguaagggcugcuugaugggcccaacucgggagaacugaggugagggagccgcucuccucccacccuacaggcuggccagaugguggaccgccagcagcuggcugggucaaccugcagagagcaccuucugcaguccuugguucaugcggccuuaguauugcaggacgcgaccaacaugcaggcuaccccgaggccugcagcccccacaguccccccagacuagugcaaagcuuuauccagucucccggcagacuucagagucuaggacacuuccuaaaugguucaaaaucaauggaaucauuugggggacaauaaauaaugucacuagacauugccaaauguccccugggagagaaaauccccccuaguuuagauauaccccgugaucauccucagcaguuuuaucucuggacuucccaaaggccuuuagcagugagggggcugggucagagaaggccccaccagcucccaaaagcagaugcucaagaacuugauauuucuaggacacacagcgauuuuuuuaacccauugccucauguggucugggaagcuaagcuguaggaauaaaaaaggugccggguaggguaaagagguuucaccagauagaggaaacggggaagguggacauuucugucuuuucuguucuggagaacgagagagcugguggagacugacagacacuauguccuaaugugaucacgguuucuggaagccaaagagaacugaccaaacugggcugaaccacagcauuucucgaguccuuuuaaauguagaauuuguuuuccagacauugcacucuugggguuuagcaaugauuuaaaagugaauuuuacugaaagcaugcuguugagcuacauugcucauuuauucagagagggaguugcagccugacuuucugccuaggagagucucucgugcugggagcuagagguagagaaaagaacaagcuaccugcuugaugaagcucacagauaggacugcuugaacccaccuggugggacagugagagcccccugacuucacccuggcgcgcuuugcugagcaggguaugcuaagaagcuccugugaaaugagaaguccuuucacucccagaaugagggguggcguuggcagggcccuggguuucuggaaggcucccuaggccauguaggcgaggugucccacaggccagggucuugggaccacgaaccugcugaauuagcaaggcuaacagacgcgggccuuucaugccuccugccuccaagcuggcagcugcccaggaaugcucacaaauauaaaaccgacuuuguuuucagaauguucuggagcauagacuccaaagucuguauaaagccauucuuguggggcugguuaucuacuggggaaaaucaugcuggggccccagaccagagcaccccaguggagagcaggaucugcccacggaaugccauguguuggcacaagggauggacccgggguggauucgggguggcccgcacuugccggcugaccucuaagagguguuucaccagguucuugggaguuccugggucuucagaggagcccuaggcaggaauuucagaggcuugcauucucucgaccauugcauccgaggggccuugggcagugcggggcccagguucccacucugaagcuggcugugugagggcuuuggucaggcguuuuccauucagaaagucuggaucugugaacuggguggguggccugggcucuucccucuugucacuuacuucuucuccgccgguccucugcugcugucuguaagacuugaccuuauucugcauuuuuuaugcuucaccccagggauugaugggcauuuaguuuuucuaacuugacuacugaucuagaagaauacaugcuuauacuucugguuucuagauucagcucuuggaggcaugcuuaauagauagcaccaccugcccaagccuugcaccccagggagucaguggcagcauuccaagucuuccugggcugugcuucagucugguuuugcagcccacacuucugcaccugcccuguguuagagcacagguaaccccucugguccauccccugcuuugauccaggaagugcuuucugccuuggaggucuuuuuucuuacaaaauuguacugugcguucaaaugccugccaaacuccuugacuuaagguuuuccucugccccucuucccuuuuagcaggcagccgagaguccugcaccgugggguguguauguguguucacgcgcaugcgugugccugugugucugugcgucugcaucaccaaccuucuguuagggcuaacugugaggcugaagcuugcacuaugccuauacgugguaagcaucgugugagcuuguguuccccuuucauugucacacgggggcugccugacuuugggaucagcaaugcagguccccuucuagaaugcagugagcugcauccuggguauggugggugggccugaacuugguauggggaccuguuugugaggcugaucuauccauuucauugggaggguggugucugugagccucaguauccucucccaggaaauccacugcgcuggccccaaugggaagacuggguuggguccaugggcuguguguacaagggaccuccucauccccugcagugcaucacgagggaggugaagcugcugggcagagcgcaggccuggccuucuugccauuggucuuggauuugcuuccuuuaggaaaccucucagcaggaaguguugaccuuuuggccuuugucuccuugcaggcaggugacagcagggacaugucucgggagaugcaggauguagaccucgcugaggugaagccuuugguggagaaaggggaggugaguggagaucuuccuggcuaccccaucacaggcacaugugcacauagacacacacaggcacaccggagcucacacuuguacuuaugggcaugcaaacacugcacaaauacacauguauacagcauacacacggcauacaaacaugcugcacacacauguacauagcauacagacacacaugcguacacacauaacacauuuguccacugcuuccuugaaaugcaaaguugugagaggcucugguucaagucccauaggaucgagggcugggccccuugcccacuucucugggccuuucugcucucauuuguaaagugaagacaucgaaccagagguucucucagcuuucccgucucuaacauucugugguuauagaacaugcaacauggggcccaguugcccauagggacugccugccucagcucucauuaaagccacauacucuggggccgcacugucugggcuuaaaucccagcugugacacuuugcagcuugguguccacuugcuaaccucucaguaucuucauauucuaguucuucaucuguaaaauggugacauuaggacuuaccucauggggccaagugaggauggagugaccuaauucauagggaacaguuagaacuuugccauagaggagaugggcaaugcauagucacuuuuucacuugcuauuauuaucuuuuugggcaaaccucuucugucaacagagcucuuccuguuggaaacagaagccccugucuauaggcugggcuggcagggcccagccugggcugauuguucugaagaugaaugaaccuuuacauuugcacaguugacaccguagcuucaaagcauguuuacaucccaauucucacuuagccucauaacugccucugauaugucuuuuuaaaaauguggaagcuuugguccaaaagugaaguuagucuaaagccaacuaaaugcuuuuaaaagugauaauuaccaugcacuaaccacauccugcaugccugcuucuccgccgaccguauuucaacuuugguucaugcaggucccagguucugugaucguacucauuuuguagaggaggaaguugggucuuagggagguuaauuugucuucuuugcauaguuacaaagugugggacauggaaucaaacccaggccagcggacguuggugaauagacuguucauuuaauuuccuuaugacucuacauguggcugcucuguuuuagguucauaauuucauagacuuuucuuuacaaaugugugaggcaaccaucucuuuuccccuuuugcagauuuaaaaauaaaaacaaacugguccuagacaggaaggggauuggucaaguucauccagauagcugguacaacuagaguuagaaaccaagccuggggaggcuacagaugcuugcuuaucauuccacacuaaggucugcaaaccuuuucugcaaagggucaaauaguaaauaucuuaggcauugaaggccacaugaccucuguugcaacugcucaacuuugccauuauagcaagaaagcaaccauagacaguauacaagugaauguacuuaauguguuccaacaaaaauuuaaaauguggugaggcggauugcagugugccaaccccuacuguauacuaugcaauuucuaaaucuguguccucuaaacucugggucugugacauagucuucugaaauagucaaacagaaacuucuagauagaacaaauacauaucaccauauucuuauuucucccuuuuaaaaaacccugugaaaauaguaucccacacuuugcuuuauucacuugacauuucugggagaucuuuucaacaucaguccauaauccacuugcuuuucucuuuuuagguacauaguauuccacuacauguauuugcccagugcccaguauaugaacacaugugucuuuccagccuuuugcuauuacagacagcacugcaagaaauuugcacccuuguaucuuucaugugugucauuacauacaugugcagguacagcccuagaaaaaaguucucagaaguggcaucgcuggguccaaggguaaaugcauuuaaaacaacauuuuuuauuuauuucgggcagccuacuggaauccuuagaacauuuuauguaugaaacacaugucuaagagcuugcccauucaggguuacaugccagugcaucucucagugaauauuuacccuuucuuucaagguuuagacggaaauaaauuucuuucaauuccuuagauugacucagcaaaguauuuagaguuaggcuugacuauugggaaguucuuccuugugucuguccucaaucuagauugccacuauacucugaugacguuuugaagguugguguuugcuguacagaauggcuuuccccauucuuucccaccaguacacacucacaugcacauauacacacacagggcaaugguauaggugccagccacguuuguuuccacuugaauuuacccaaagucccugauguucuugcccacagcucaggggauguggggcuauuugaauccccagcacgagggccuguguugucaucuagucuuccaaucccugccaucuaaugggagcuccauuccaucauccuguuccccucaucgcuucugcauuucgcucugcugagccgucuuguuuucuggggguuuguggugggugaggcuggggcucaguuuucacaguguugggacuccaucucugggucaguaggaaaacaugccagcaacaucucuuagaaauguuggccagccaagacuccaguugguccuccgagucacacuuucaccaggccagaggggacacaagacuuuucucugucuuccugggccuguccugccauggacagcucugguaaaagauagaauuugggcugaaacucagauuuuuuuuuuuuuuuuuugagacggaguuucacucuuguugcccaggcuggagugccauggugugaucuaggcucacugcaaccucugucuccuggguucaaggaauucuccugccuuagccucccgaguagcugggauuacaggcaugcgccaucaugccuggcuaauuuuguauuuuuaguagagacgggguuucuccaugcuggucaagcuggucuugaacuccugaccucaggugaucccgccugccucagccucccaaagugcugagauuacaggcgugagccacagcacccagccugaaacucagaauuuuuagauugagggaaaugcuuagaggucuccacugccucuucuacucacaagagacugaaauuuaauccagguccagaugacagcagccauggaaaaaauguaaggaggaccaugauguggucagguuugaguuuuaaaaguauagcacauggguggagccggggagaccaguuaauagucagauaucacauuucuguaucucucaagcuugugaucagcuuagaccuucagcuuuuuaucuaucaaggcuauugucagaaaggaguccaguuaaugugucugcuuuucugcuggacuucuauuuugagaugaaaaggaaagucucggcugggcacaguggcucacaccuguaauccccagcacuuugggaggccgaggcagguggaucaugaggucaggaaaucgagaccauccuggcuaacauggugaaaucccgucucuacuaaaaauacaaaaaauaaaaauaaaaauaacugggcgugguggcgggcaccuguagucccagcuacucaggaggcugaggcaggagaauggcgugacccugggaggcggagcuugcagugagcugcgaucacaccacuguacucuaaccugggcgacagagcaagacuccgucucaaaaaaaaaaaaaaaagagaaaaggaaagccugccuuugugaggaauuaaggagaccccacaaaggaggaaguguagguacagauucaggucauagaaaggcccauaugucccaauauuauuucucuuacagagaaaacagaugaaauugacaauuuuuuuugucuuuucacagaccaucaccggccuccugcaagaguuugauguccaggcaaguagaggauguggcuuuccuuccccuuccucaucccgucuucucuuuuuccuuuuucuuuccauugguuuaaguagaucauugugcaaacauugcgggcaaggggagagaaggcaguggucucagcuagguccucacccucagcugcugcucccagacagaagcugacuugagugcuggccaaagaaucaggaaccagucacuucccacgaaagcaggacagagacaccgccuguuucagucccaaagagcuggccagaacgguggggcguguguggggaaaauggugugaugcugggcuggcuugggacccugugaggggagggaacggaagcaaaagcuugauguucuuggcuccacuugggaaacugaaaccagccuucucugugguuuacuggcccagaacugaaguaucuccauucccacucaggauugcagggugggccagggggugcaccucagcuguguccaagaauaggcucucaggagaacgggcugggcucucucagccgagggcugggucagaacuucaggaaaucuaaguccuggacucguuagccccaagcuggggugggucccaugcugugcuggccucuggaggguggggcagaaagccugagcauauggcgagcuuguggucuccuugaaggaggagaggcgcacuccuggaccagccagagagccagagguggcugagguguucucaccugaaccgcuacccauguguugcacagguguccccaguuugggacccauucugcacucugcaucucacuccucuauucuaccuccuuaccucaaaacaacuccgcuuuuccucuugaaucucugauuucaugaaugcucccccauccaucccgaggcgaggaaucuugcacugucuuuggaaggaaaggaaaggaugggagaggggcuggaagcauuggcuaguagaugaucgaggcuuucuauaccaccaccaagguguguauuuucucaucauccugguugugucaggcugucccuagagaucacccugaccucaguguuuaagaagaagggccagaugcaguggcucaugccuguaauccuagcacuuuggaaggccgaggcaggcagaucaccugaggucaggagcucgaggccagccuggccaacaaggagaaacccugucucuacuaaaaauacaaaaauuagccaggcauggugguaagcaccuauaaccccagcuacuugggggcugagacaggagaauugcuugaaccugggaggcagagguugcagugagcugagaccacgucguugcacuccagccugggcaacaagagugaaacucugucucaaaaaaaaaaaaaaaaaaaagaagaagagagacagcacugggaagugacuugccuggggucacucagcagugauuggggaaguggugccagacucugggccucaccucuuccagcccugagugcuccccuugcugcuuguguagguuuuaaugauguuggugagggcuucuuaccugccaggugcugugcugagagcuugccagccaauaucucauguaaugccucaauaucucaugauaacaggagaggcaccauuagcuuuauuuuucagauggguauacugaggccagaguggagggacugggagccacaccuagcucugccugaccaggaaggaagcccauguucuucccgcaccacucaugugcugagguccaggcuucucccaugcccuggccagagcuccaucccguuccucucuauguugcaggacgcugggcaugcgaaggugcuccaggagggugggaggugaauguacuaucuugagguuuaucaaguccaagccuucauuuuacagcuggggaaccugagggacagagaaagggggaagucacucauugaggguggcaugguggggcagcuaagaguuaugguagcaauccucuuuuucacccuccugagaaugggaaaaaaugcacccagggaagucagagcugcaauagaugcaguggcuguggcaccagcaccauggccuugguuauuugacugguucucugagcugagaacagcuggaaguuagccccaggggucaucugcucauucagggaugggccgggccaccccagccucccucagccugaucgaagcugcccuugccaaccuucccuguggcugaaaugucagcuccuuguguuccccaggggagcggcuugcuggcacugagguuguaucuuccugcaguggggaugugauuguccauccuccucaggugaaggccccauuccagagccaggaagagugaagcgcaagccccaugggugcccuuuccuggugauugacccuuagcacaagaugcuucaccucuguuuccccaccugugaaauggagacagugcuccaggcuuguuaaguggugguggagagaggacacugacaagggccaaugauguggugcuucccgcaucagugccgggccaaacaucacacacccuauccacuaacuaucauggaguguuuucccgaauuauuuuugcuguuguggaaacauacacguaacauccaauuuaccaacuuaacuacuuuuaaauguacaguuccgucauauuaaguacauucauauuccugugcaaccaucacuaucguccauuuucagaacuguauuuauuuauuuuuauuucuguuuagacagagucuugcucugucauccaggcuggaguguaguggugcgaucuuggcucacugcaaccuuucuuuaccuccuggguucaagcaauucucaugccccagccuccugaguggcugggauuacaggugcccgccaccacaccgggcuaauuuuuguauuuuuaguagagauggguuuuuccauguuggccagucuggucucgaacuccugacuucaagugaucuaccugccucagccucccaaagugcuggaauuacaggcuugagccacuguaccccuggaacuuuaaaaccugcagaacugaaacucugucccauuaaacaacuccucauucuagcuuuaggcagucauccuucuauuuucugucucugugauuuugauuacucuagauuuugauuccucuaaguaccucauacaagugcagucauacacuauauuauuauuauaaaacuguauuaauuugcauugauuuguucuuugccagugucuggcugguauaaguuagcaucguguccucaggguucaucccuguuguagcaggugucagcauuuccuuccuuuuuaaggcugaaucauauucuguuguauguaugccccacauuuugcuuauccauuuguccguugguggacacuuugggcacuuugggcuauugugaauacugcugcugugaacauguguacagauaucucuuugagauccugcuuucaguuuugggggacauauacccagaaguggaauugcuagagguaucaguccauucucaagcugcuauaaggacauaucagaaacuggguaauuuauaaagaaaaagagguuuaauggacucacaguuucacauggcuggggaggccucacauucauggcagaaggugaaggaggaaccaaggcacgccuuacauggcggcaggcaagagugugugugugcaggggaacugccguuuauaaaaccaugagaucucuugcucuuuauaaaaccaugagaucucuugagacucauucacuaucacgagaacagcacaggcaaaaccugaccccaugauucaauuaccucccacugguucccucccacgacacguggggauuaugggagcuacaauucaagaugagauuuggguggggacacagccaaacccuaucacuggaucauaugguuauuuuggauuuuaaaaucuugguuaccaauucugagaaaccuagaaagcauaguuuaucugcucccugcgaagauaauuccucacauuuuuguuucucuggaaagucugcaaaacacuuuuacauucucccaucucaggacacaggcaacugaccuacucccagggaaggucaaccuauguggcucaggcuggggucggcuaaggcgcugccccuuaggacaucauuaaagugggggccacacagagaagccuuuggaaggauagagcagaggucaggauaagauuucccagcauugugcaccagccugggcugagccgucugaguuaauuccccaagcuguccuaugaggucggagcauuuucccuauugugccuuccuuuauuucuuuaacaaaugcccacuuugugccuggcauuaguuuaggugcuggggaugcagugaugagcaugacaggcagugaccuguguuuucaggaaccuaaauucuggaauaauagcucagcacugccgagcacagaaugugucuggcagcaugccaaaugugccccacgugugcuuacggcgauccuguccccauccuacggagagagaggaccugaagcacagagagguuagggaacuugccugagaucgcagagcuggaaaggggaccucaagccauuugcuuccagggcacauauuugaaaccaaucccgauuccucagaagaaagagucaaacaaacauacaaacaagcaaaugugagcauuccagcuucuguaggugcuuugaagauaacagugaagggugauauggagccaggugaugggauagggcauggcuggggugcugucuuagguugaggcuuuuuuuuaaguggugacauugcacugaagucuaaaagauagauagagccagucacgugacaaagagacuggggauagaucauuccaggcagagguaacagcacaagcaaaggccuuucugaucugaauucugaaauuuccaagggcaaaaauguguuauuccuguaagcuguuaacaggcucaguguucccaguaagucacaauauuugagcugaaaucugaguguugaaugacacuuuucaagguuguuaccaaaagaaaaucuuugucuaaaacuguauucauuuagauuuggcuucuuagauuggaagguguuagggacucaagagauugaugaaagcgucccccagauuuucagcagucuccaaaaucuuggguguaggguugcuguagaauuuccuucagaagaugcagugcagugugacgacggaagcucucuggggccugauggguuccagggccaggaacugagaaggacagagcuuuggucaagggggccuacagggcguaucagcccggggacuggucagcauaaucugaccucagauucacaugggaguugcagcaaagcgacaggacagcaccugucugccaugcacuucaguguccucugaugagccaggccagcacugagggccucccacgcccucuugcugaaucuuuggggaccuguaccaucauccuuccuuuacagauaaggaaacugaggcuuucccaggggcggcagcugugaagugagccacauugagcccagggcugucugacguagacaguucucucaaccgugaugcuugaguauagcccuguuccuggaaaggcugaucaagcccuuauggacuagauugugguucaccuuugacacgucugcuugucaaaaaaucuagccaagcagauaaucuaagcaacacuucauugggcuuauguucagccuacugacaaugaguuguuguaggacucaagaguugcugugccuuaauggcaaaugaauuuuaucuauucauuuaguugguuucuuaccugcuuguuaaaauagggcucccuccugggcaguucuugcccugggcauagcuucccuccugguccagucuaaggagucugagucgcuuuauuuuguguaucugaaagcagccgaugucauuccuugaaaaauaauuacugcuucagcacuuugacuaacucaggcagauuccuacuuccuuuaccaauguagucaauaauuuaggcuuuuauuguuuuuguuuuuuaaaugaaucaaaacacacacacugagcccagagcucggcacugaggagcugcuggcggagucugcauugagcugcuggguggccugucucuggagacagcucgccugccagagcagauggcaucaggccuuaucucuccaucacuggcaucgccuuuaggcggucucuuuguuuuguccugggugauguucgggcaaagugauuggugauuugcauaugagguucugccagcgcugucaggcccccaccuggcucugguuccugaaaagauuccagaacccucagggcacggggugggcgggcugcuggccuagguguccggguugcaggaaggacacggucugaucuggcucggcugagaggccuccagcaucagguuuuaggcaauuguguuugcagauuugaugaguagggagggggggaguauuuuggguuccagcuuauuuucuuuggcuagaauucuagaguccaagacuucugcuccaguuggagagcuuuguggaaggccaccugggggagggaagaggaggaagaaugaauauuugcauacucauugucucagggcuucccugcuaaggugagggguguuggccucuuuugcagaugagagacccauuugaagauguuagggaacuugccaaaggguacuguagagauaguccuagacuuagauccaucugcuuccgaaaaauguuauagucauggaagucguaauggcuggccucucuugagcucugcuguacgucagaaaccgugcugggcuauuuuccugcauccgcucaugugauccucaugaaaccuuguugagggagguauccuugccaucuauccuugccauccuuguuuuauguugaagauacgaggcccagaaaaucuggagggauuugcccagugucacgccauggugagauagauggugaaagcugauucaauccacacgucuggagccaaaguucauuuaacgaguuuuggggaagggacagcagaguugacuucaucaccgauaaauuguaccucgugggccgagugacuuucuguggcuucaaauugcuuuuucuguuggauuugcugcuucuaauucccuccaccuggaucuugaguuauucagaugguuagauuugauuugguuuccaugggaaucuguguuugugugcucaccagggcucugugggaaaugagcugaugugacccacagggccuccguguggagugguggagggggcuggggcagcaccagggccgggcagggcucuggaggucuggcucccguucugcugcaaggccucuuguucagcagagcugagcuggucuuagggauguacaaucccauucggugggggggcuguuuucccuccuuuucuuggaagcggaccagcucacagggaaaauggaaauggugaccuuuugcuaauuucucucuuuccacacaguugcuucuuguuuucaugccccaugacugaaggugggcagaacucagacagaagccuggaaauccuaaacucaccauuucccauucucgcccucccccagcccuacuuccuagcaaagccauugggacuuagagcaaacccuuagagugacagauggcaggaacgcucaucuggaucagcacaaaaugagacuuuggaaaauaaacacagcauacuucugcaauucugcuguggguuuccuaggagcacccuccaauggaacaggagagguggggcucauacccaggccuccgagguguguccaggccaggcucugccaggcugaccucacucaucuccuggugucccagaaagggugcagugagcggcagcgagugcagacccagcccugucauuugcuacucgcguguccuuggccacucgcuugaccucccuggggcuuaguuucguaaucugugaaacaguggggagcaucgcugucccugagcacauugcaaacacugaaugcacacagcagcgggcucagcucacaggucuuugucgcccuccccugcuccauggaugauggggucugcuccaucucuucacccuaauccaaacaaagauguucuuccuaauucuuguuuccuuggagaacugaggucuucagcguggguuccaguugcaugcuguauucccaggcugacaccuucugcccacugcagccuguucccugacccucuguaacuuuguuuaauucucuugaccugaugucaacauaaaagaagacuggggaaugaagcgagaagugacaggcccagcuugaccucuugaaggucuuccauugugugaggcuugcaggggagucuuggcuuuggaagcccaaggaccuaucuaucuugaaucuuaauucuguuaucucauugggcaccuauacuucagccccaaaggcuguucaauggcugucaugauauagcacaggagacaaagcuggcuuuaucagacuugcucaguaaguggguggcugucuuuuuaucguguuccuccuggcuacacacacaccuccccugguuaucucugguacuuuauguguucuuuacuccuuuuuuuuuuuuuuuuuuuuuuuuuuuuagacagggucucccuuuguugcccaugcuggaguguaguagugugaucucggcucacugcaacugugaccuccugggcucaagugauccuccuaccucagccucccuaguaguugggacuauaggcgugagccaccaugccuggcuaauuuuauuuuuuguagaaaggaggucucauuauguugcagaugcuggucucaaacucaaaguuacaggugugagccaucacaccuagccuauguuuguuacuuaauggaauggaucauuaagaugaauggcacugcugugucuccaccuccuccuccaugggcauaggcgaugaaccaggaaaauauagggggaggaguguaucauuuuaugaaaagaugguggggagggggcaggccccugacauucucucuugagccucuguucccaugauuugccuuucuugcugccaugggccuugacuuuaugcugaugagccauagucagcuuccuggacagcuguuccagagggcaccguaacugcucuggccaugcuuggaccccacuugcuagacugagggagggucaccaagcccaccaacugacuuagauccuggguaugcggugauccucuuagagccuagaacggucggcaucugcccagggccugcugggaaggaggggauuaccaggggcagcggggagacagucacagcuggccuccagagccccuccggaucauccagagaguugacuuaagccaguggggcuggcccugggagcuucacacuaaucaucucuggagcgguuguccauaacaacugacauggagggaaaugcugcagcuugcaaaacacauucaggucuguaccaugguuuuagucuugggagcaucuuaauggagcaggaggccuugucauugaccucagcuuacaacugauggcagggauugucagagaaggcugauaacuuggccaagggcacguggugguuauaucauuaggauaaguauugcucaaaaaacagugcugugccaaggaaauguuugcuauucucaccaaccuagaaagcuaacaccccagcuaugaaugucacccagcccagcuggaguuaguccuuacagcuuccuacugucaccugagcaugcggcuuugguccucagauugguaggauagccaccgaacccccaagcaucucauccauguuccaaguaggaugcaggcaggagggugaaaggacaagaaucaaaaggucaaguuugacccuuuuuaaaaaacucuccuugaagcuacaggaauuuucugcuggcauuucauuggccagaacugaaccuccugaccaucuuugguuacaagggaggugaguaaggaaggggaccacuuuaucaggcacuuugcugcuuaguacaucaguuggaauucuauccucaaaaagaagggaacaacagauguuugggaugccaaccaacagagucugccauaguuuuaaagcucccaagccaggguugacagccaaagagaugaaaucuuuaaggcaugcuugguguuagguccuguuuccccacuugacagcuuccaggcgguguagaccauagugguacgugccaugguugcuacuugccagcauauaggcaguguagacuguaaaucucuaaguguacccuccgggccagacucugucaauuggagagccagccuuucccucugggaauuggcggccuggcuggggaggcagcuguuacacauauauuuguaauuguggucgugcugcaaagaagagaacaggguuugcauggcauguguaugguggguagcaggaaggaggaggugacgucucaugucugugcugagguguuuccaguguuggcacacuuccucacaaagacacacaugcgugcaguuugggggcaggugccuguuuuaggaggaugggagcagcagauauuauuucucgauucuguuugguaguggaacagccugugcugcauggauggccaguccuuggagacgcuggggagguacgaguguuuugcagucaaauaagugugggaaaucugacuugcugcauccccuuuagggagucacagugcacguugcagagaaagguuuccuuccccucuucugcccggcacagaaugugaaacaggauguuaaagagaacaggcuuuggaugcagacauucgaauccaagcuugguucagauccugccccauuauuccagcuguguggccuuggaugaaguccuuaaucucucucagccucagcuuucucaucucugcaaugguuguuccguguauuuaaugagaaaacacgugugagaaacucaaagcaggcaugggguaagaugcaguggcuguuuauuacugcccccaucccugccaucaccucuagacuugaaagagcagcuuucuagacucuuccagagcaggugagaggaaagugugugcagccagguuuuugucuuuucauccucuugucuggaucaggcccugugagcagggucuucuguggccugguccugaacuguggaagagcuggguguggggcucuggaugguggaggaguuguguuuguguugccagccuugucccagccagaaguuggggggucccucaugagcuucgagacaggcaauuugcucucucaggcaagaggacgaacagugcaccuugcaguucugauguucuggguuccuugugcuuucucuuugggaaaacauagaagacacgggauggguuccucucuccagaacacugagugauugauccccgcagggacagaaggacagaacauuccuuugggacugaauaggacaaaggccuguguuugugaguguuguaauucucccauucaaucucagacagucuucuugacuggcuuagaaccgcgugcgugcacguguguuuguugguggguguguuuguugugugugugugugugugugugugugacuuaggggaugggacuuggguacagggaagaugacaacacuugcuuuuuuccuccuccuccugugugugcuggggggccaggaacugaguggaggaccgaugggggccagcagacccuggcacaaaggagcaagggcccagcggagagaguucgaauccuaguucuaccaccacaaaccuaugaccuugggagagucccuucaacuucuuuaccuauaaaaugggauugaugggccucccgguggcauggaggucugauacccugccuuacucuucguaggcgcuuagcaaauguucucccucaccucugcucaccuaugccugggaagcagcccugccccugugugaccuucaccacuucacuuccauguucucagacggggucuuuguccuucccaccaaggcuagcaaugucgaaagccucuuuuuugaguccugcucaggcugagguuuggggcagugaugaggcagcagccaggguccugacacucaugagcuggggugaaguguuagugcucugugaggcucucaccaacccugggggucuuaucaggagggagcugagcaucucauggccaauccaagagcagaguggggaagaucccaacauggaucgaugcccuuaggagagaaaguuccuuucuaggguguaaugcucaccaucaucugucgggaucagaucucuuauccagcagauaccgggugcccacugagagcaggcagcuaugcagaggccuguggacagaaagugagugagaccuaggcagccuuuccuucuuggacugaggaauagauccuccaguuuaguucugguuccauggcuguauaauuuuaagaccuucaaagagaugagucaaaaaucugcuacccacucgcaacuccgggggcugccagggacauucuugaugccagcugggguggcgugucccauaccugcugccacauuaguacccucugcugccugcaccgggaguccccauccugccuggugcugugcucugggcuccgugcaggugacuccucuccugcuauggagucuggggugcaggcggcccucccagcucaggggugaggaccuggaggcucggagguuggggagugguaggacuuggauuugaacuccgauguccguggcgguggggacaccgccugcccuggccugucuuuuagagggagccaugugggucagcuggggagacaaugaagaaugugcccccacaaacaaauggaccuuuguucccacaguggcuucagggcugggcugggcccagcagaugaucuccggcccccuggaagcugggccacugcucccucaucuauggauuuuuccagugccuguuaugggcaggaaagaaguguugggcccugaggggcagagaggggagaagggagauggggcugagcucugugugccaggggacuuaacgguguugggggcuaaugcaggugccaggaugaccccgugcugggcgggcccgggugcucccagggggcugggccuggcccuguacagugccucuuuaugugucaccacccucaccugguaaccacugcugcgucccugugccauucaggaacagggaacuuuuagguaaccuugaggagggcggaaacccagggcaggcgagugaaguggcaauugagaaagagucacgaccacccucugcaggaguuuagaugaacauggcaggugagagauugguccaugagugagcuggggugcuugucuccuuucugcagaagcacgaugguggccuggggcuggcuggcuucgggguucuccaagugagugucgggaaccccugcacuccuccgcuggggagggggagguggugaguucuuguuggaaacucaguacggagcuuucauacgcugcgggggaaccugggaauuggaugccauuuuucuuuauuuuugaacuuguuccucagguugagaaucguuggucuuaagggauucaggaggcuuuccuggucccauucccagcaaccccccaguggguuaaauccucuuucuccuuucucagaggacccagaggaacugcagccccccggggccauuuccacugcccccacuagcuugugaguugucacccacucgucccugcggggacaaaggggaccuggcauacaauaggugccuaaugaauguuucucagaugaaauugaacugccuuaaguaucagggguaagaaguagcagagguggaauccgaucaccagcggguguggauggcguggggguggcugccucguaccacuucacggggggucacucacagauggagcagccuacauucucugggccuucagcaccucuaggagguaggaagggccaggcuguuccuguuuuaaagauucaagcuggggaggaggugacuugcccccacagggugccuaaguggugaucugucccaucccuucuucucaagcgugaguuugugaacgcugaccuuccucucugcugccacacggcagugaucuguaugggucgcauuucugccagcuucuagaagcagguucaacagcauuuagaguguucuguguuccacuucacugccucauuuaaucuuuggaaaaucaaugcagcgugcugagcugagguggccucgugaggccugagugugcgccgcuugcgggcgggucaagugcugagaagccuggggccccgcggaggcugauugucugggggaccugccucugugcugccugcccgugugacucugggauacugacuucacuuccucagccagcugggucacauggcucuggcagggcuccugugagggugaggacauggagggacaugguucagcacugccuugacaccuggcaggucucagcagccugauggccuugccuccugcuccccaacugcccugugggagcagagcccagaguggggcacuucaaaggggaggucacugcucucagauguggaaauugcucaagggagaugagugacugggguccucgggaacuucugguugaccuugaggagggcggaagcccaggguaggcauggggugaagggugaguggaagugacaauugagaaagagucacgaccacccucugcaggaguuuagaugaacauggcaggugacagauugguccaugagugagcuggggugcuuggaaccaaggcagggugccuuuuuuuuuuguuuuccagaggaagaaaggugagcaggucuucagcuguuaggaagguuuggugcggagaggugcagggaugacugggaguaagcuggcugggggucacuggccgagcuggagaguuggccuugacccagagaaccaucuggcucaacaagaaggaagggcaggagggaggaugggcaugguaucauucagaaucuuuuggucaacucaacauggcuuacaugggauuggaaguuggugggccguguaacugaaaaucccaggugguggaugccauccccaaaccgucuuucacucuuuuccaucccugggcuggccauacuuucaggcaggcccuugccucacggugacaauguggcugcuacagauccagcccucccaaccuugcuccaucaaguccgauccaguuccccaauuacuagaaauaagugcagcuggcuuuaguuggccugagccaacccauguguucuuuccugauccaguccuugcaacugggagguggagugcaugaauuggccuugacuugugaaacguggggaggggggucacugucaacagaacacuuaggacugagggugaggguuggguggguuccugaaggaaacugagggcuguucuuggaaguggggagugaauucuguguagccccaagccagcagauguuagucacagguacaguaaccuguggggccaguggggccugagggcaaggaagcaaggaagcgcaggcuugauggccuguuuuccagauggagcaaacaguccggggcagagaugguggcgggcaagcccuuuccccagcauuuggugcauuuaacagcgcagucugagccaggccucuguccccugccuccugggaguccccuccuagcccugguccuuggaguggcuucuggccagagagagcugcugcccgaagccggggcucuuauggccagaugagaagagagcuuccucaaaacacaguuggaaacaggcuggcugucuucagccacgcggaugccaugaaccccacaugaccagcccacugucugcugugucuccucaggagcaggacaucgagacuuuacauggcucuguucacgucacgcugugugggacucccaagggaaaccggccugucauccucaccuaccaugacaucggcaugaaccguaaguucugaggagcucugauucccugucagccgguucccaagagaguggcggaaaaaggcagccgagaagggcugauggccgggagcuggugguuucuuuuugccugggacuuccuggggcuguucugggaagaacucuugccacagccuggaaaagccagaaaugcgcugcaugugggcacggaguugucugugugcccggaggcgcugggaacacaggaagcuguuugcuaucuguggcagugacuucuauauuaaugcacgcauaugguuuucagucuuuucacagaauugugcaacgaucagcacaauuuuggaacauuuucauccuuccaaaaaauccuguaccuuuuaucugucaccccacccucagaugacugacccuucauugacuuuccuuuucugugaauuugccuguucuggaauuuuguauacauugaaucaaauaauaugugauuuuuuuuugguaacuggcuucuuucuuagugcuuucaagguuuauccaggccaugcauuaauauuuguauuuccuuuauuccuuuauugaauaauaauauuccauuguauggauuuaccacacuuuauucguucuuuuuucuuuuucuuucuuucuuuuuuuuuuuuuuucugagacagaaucucgcucuguugcccaggcuggagugcaguggugcgaucguggcucacugcaaucuccaccuacuggguucaagcaauucuuuugccucagccucccaaguaccugggauuacgggcacccaccaccacgccugacuaauuuuuguauuuuuaguagagacgggguuucacuguguuggccaggcugaccucgaacuccugaccucaggugauccacccaccuccaccucccaaagugcugggauuacaggcaugagccauugggcccggccaucuauucuucaguugaugggcauuuggggcauuuucacuuuuuggcugugugaguaacucugcuacgaauguuuagacugugaauuccaagauuaccaggaggguuuucuuagguggguuccccauuuuucauagaugagaauggaauggaagcuacugaauguugaaauuucauggaauagaggugaauucuucugugaggaaucagaagacacagguuucacuggucccguaauuuuuaugaacuugaguauugcaagcuugcuugauuuuugacgauggacugccugauuuucauuuguuucuauaaagcuuauuaauaccuuauuaauaccuugaggcuggggauggugucacugaaauccacugaaaacacuuuuucacuucauucucaccuucuuuuaucucacuucuuccccugucuguuucccuuauauccauuuuguaccagguccaugcuagguauuuugauuuacacuaucucauuuuauugacucugacaaggaacuggaauugcauauggcagcgucucuccccauucggagaggcucauuguugguuuauaauaggcuuaccacuguaacaaaagaugccaagcccucuguggcuuaacacaguauauguuuuauuucucgcucauguaacaguuuaguggguguuuagugggacauguucuauuuggcaauucaaggacccaggcuccuucuagcuuguggguuugccauccccuggggcugcagagccuucugcuggaaacugugcuucuggcagguagaugagagaagagagaaacuuagaggaucuuagagaaucuggguggcagguauggugaggaaauggugacggucacaggcuaucggccagaaacagaucacauggcugccucucauugcaagggagcuugggauauaccgucuagcugagugcccaggaggaaaagggacaggagguagggugagcagcccgacuuccuuaggcuucagcagugaggagacucauccaggccacaugaaaggaggaggcacgccucaccucccaugcuccuccucguuugaaaauuauguguguccuggaccaguaccccagaugggaggguauaguggacccagauggaaagagaggaucaggagggcaaagccaucucaugccagggccauccugacccuggcugacuggaggagcuacaggagccagccugggaaccccuuccagcaccaacugcaagacucaucugccagcuaccacucccuugccccaugaaacuuacucuugcuuuuuaucagcagaggaaagugggcauggggacaaaaccaaaaaacaaaaaacgccaacaucuguguucuucuaaguucacuuccuacuucugaauaggaaugaaacaaaaugaaugugcuuugccaccgagacaccuaauuuuuuucucaucuuacuuuuuucucuucucucccucacugcuguucuucagacaaaaccugcuacaacccccucuucaacuacgaggacaugcaggagaucacccagcacuuugccgucugccacguggacgccccuggccagcaggacggcgcagccuccuuccccgcagggugagaggccucuugcccuaugagcucuacaggguggaaacugggugucggggagggguucaggugcuuugcucuuuuaaauacuuuuuaacugugguaaaauauaaaacguaucaucuuaagcacuuuuuaaauugugggaaaagauacauaacauaaaaguuagcacuuucacuauuuuuaaguauauaguucaguggcauuaaggacaugcagacauuguugugcagccgucaccaccauccaucuccaggacuuuuucaucuucccaaacugaaacaacauacuuaucagauacuaucuccccauucccccagccuuccugcaaggcuggcguuacgauaggugugcucagccuggacaggacuucaguggaggaggacuugacaccaccaaauagugugaagaaaaaccuagaagucuggggagaaacagagagggagagaaguaacauugauggagcccuuccugugggcuaggcuucaucauuugugucuaacacugggcuuaauccuuacagcuagcucuguguggcugcuguuguuagcuccauuuuccagacaaacauauugaggcauggaggcauuaacuaccuugcugaagguugcacagcugaggccgggcauggugguucaugccuguaaucucagcacuuugggaggccaaggugggcggaccaccgagguugggaguuugagaccagccuggccaacauggugaaacccugucuccggccaacgugaugaaacccugucuccacuaaaaauacaaaaaugagcugggcgugguggcggguggcuauaaucccugcuacucgggaggcuuaggccagauaaucccuugaaccugggaggcagagguuacagugagccaagaucgcaccacugcacuccagccugggugacagagcaagacucugucuccaaaaaagaaaaaaagguugcacagcugaugacuggggaguuggcuuugauccuaucuacugagacguguauccucuuuggaacaucaggcugccuuaguugagaguauuugcacugccuggcccuugucagcucgugaucuguaugggcauggccuuucaauuuccccuugugcaauuauggucaagcuuguuggaucccccaaucagcaucauguggggguggcagaccucagagauaaccccucuugucccugcaccugaccuguguuuaaacuagggcaggagcagguucuugggcuuaaagucuuccagaaggggccuucuuggcauuuauaaauagauauccuuuuuuauuaguguucagaauuauccuuaauaauuaaccuuuaucagagaggaagggaagggacagccaaccguauggggccaggaccaaaaauuaaaaguguauuaaaacagugggacgugguuaauuguuaaccagcagauaaagccagagguguguccguaaaucuuugguuggaccaguugugugaaagacuugggggaaagcagagacucuuaguucccccuggugaaguuuuacaaauauucugaggccugagccccacccccaggaauuuuuauuccguuggucuggguauuacagcgcauuuucccccuaguuuacuaugugguuuucgugugcaucuggugggacccacugucagagugggaccugacuuguuucuuccuccuggaguagggcagaggagaguguggggcuugggaggggugagggagcaucucccaggcccuuuaagggugagcccccuguauucugaagccgagacagcagagcaggguaggggaucccuggcugggcuccuccuggccccgguguccaccaccuacacaggagggaccuuggaaguagaauucugcugcuuccucgccucacaccagcccuggggaacagggaagaaacagagggcccugcaauuaaguggcuucuccagugucacaccuuaggagcugcuggcuccaaauugagccauggccauuucagaggagcuucaugucuuugccgcacuucugcccugcggcuucucagcucaguggcucuguugauguggagccacaccauacgggcucuuucuggcucuucccagggcguccgcauacacugcuucccugcccacacgcuuuacucaucagguucccaugaccccuucagcgucacuucuuccaagaagcccucccugaucaucugagcacggcaggucucuguuucgauaggcuuuguuaugaguaacacccccuguuucuguugacucgagggcuggcuccuguccugguuugcaucugcuuugcucacagaccccugccauugccucaccaagagcccggcaugugugaggaucaaucacugcuuugcggauggaacucauucaugccuguuuuaauuccuucucccugacauuggaauugugaaaugccuucuagucaguuucugcaacacccuagacccaaaaccagacaaacacagugaggacauguuucuggcuaaccaucuacugcucuugugaggccaagugucucaucucucagccucagugauguuuauaaucuugcuaugaggggaaauccuagcagccuccuagaguuauugugaaaauugaaugagcuaauucccagaauguguccaugggaccuggagcguaggaagcaauugauagagugugcugcaggggucuuggaaggaggaugcgaagggacuagacuugggggugggggggucugggugcauggggcaggcugcugcaugguccccacccuucaagcgugucccuguuuggauuacccguuucuguccgggcgcucacuaauggcuucucugugucauccccagguacauguaccccuccauggaucagcuggcugaaaugcuuccuggaguccuucaacaguuuggguaagagcgaaggaucagcuccuucucugucugcagagaagccugguuucuagcaucuuccugccccuuggcuuugaucuggacugaccacuaaaauuaagguugcaauuuagagaugaggcaagaaauuagcucgucacucugugaacacuguucuucacacagucucugagcucuagucugucuccucuaacuucaguuuuccucuugcgugaauguuauauugcaugauggcagcugccccacccauuugcucuugccuccuguucuuccauucccuucucuuucccauggaauguucuggaauggaguugccugaguccuuagcuuuucucuccacacccucauuuuuccaguguuccucucugucuugagcucuucaaagaaugauaacuucaugguucuugcucaauuuguuuucauuccaaguuuuagaauccaaaauaaagcuuaagagugggaagaaaugaugccguaacgggccuucccguaaaugucagacggucucucagagccuggguggcggccaggagggaagugaggagaaggggcgcggcucuccaaggucgaggucucuguccaguccuaaagcauggugaccucagagcugugcaggcaguuacggcagcaugcucccgcauugccuagccaggcggucacccucaggaaguucuaaguggguccuuggaggcucccgucacucuguccuugugugacaugcauuuguauuuuugcuuccaggcugaaaagcauuauuggcaugggaacaggagcaggcgccuacauccuaacucgauuugcugugagugcuuuggcauuuuuugaaaaucgcauuuuaaauaacauuuuaagaugaaggaagacauuggaaaagcaucaaaaacccaaaagggaaaaagaaaugacccguauucuccacaguuguguguguguguguguguggugcauggguacucguauauauauauacucacagccuuuucucuuccuccacucaaggaugauacuggacacauuccuuugucaugggcuuuguccgcuuagccaucuagugaggacgcuccucacucacugaguacucugcuaugacacugcuuuguaacagcuguacagguuuuuguagucagggcacuccugggucauaacugauucuaaacuagaaucagacacgggaaguuuucaugacaguugucauuguuauuucucugggcucaggucaagagccacuguuccuuuguauccucaccgagcaauuguguaagaaugcaacaauacucauuuuguacauccauugguauuuugacuaccuauuauuugcugggcuuugcuggagguugggaauacugacaugauucuacaacauccaucuuacaaaaaaaagaaaggaaugcugacaugaauacaaaauggucuggccauauaggcucucagcaaauuaaaaauggucucaacuguaccccagguguacauaucuauaucuguauguaucugcaucacauaaugacauuuuggucaaugacagacugcacauuugacagugguuccauaagauuauaaugguucauuuuuacuguaccauuuuuauguuuagauuugcuuagauacaucaauacuuagcauuguguugcaauucccugcaguauuggguagcgucauaugcuguacagguuuguacagcaaaccuaggagcaaagggcuguucuauacagccuuggugaguuguagacuauacugucuagguguguguaaguauacucugagaucuucacacaaugacaaaaucuccuaaugaugaauuuucucagaaaguaucccuguuauucagcgaugcauaacucugucucucucucuguguguguguguguguguguguguguguguguguaugcauguguuuauccuggaaguaaguaauacaguuguuacugccacaacuagagagcauuugugcugugcgccuuguuugauugaugaggucgaugguguguuacacccauuugauagcuggagaagcugagccuccguggguugaagugacuugcccaaggcaggccugcaaagcagcgggcuuccuacuucuccugcacuuccucuuucuccuucccacucucucuaggacccgauaccgugucugcugugcuggaaccucaguuuugcaugggguggggccggggagcagcagccugcucugcugcccacacugccuuuuucuggguacuucucucaagcuuugguuugccuuggaaaguuccuaguguuucagauugcugggaugucugucucacuuugugucuugaauugcagcuaaacaacccugagaugguggagggccuuguccuuaucaacgugaacccuugugcggaaggcuggauggacugggccgccuccaaggugaggugggggccugucaggccggcgggaucccugcaagaagagggacaggugcacacagccucugccugggggaucccuggagcuacgagcucucucuuuacccacuccuccacuacccucuacugcccacuccaguucccucugcuuuacuuagaacaguacacaugaccucagccguuugccauucagaagacuuaaauaccaccaagcugucuaagccagggaaagcacugggacacaggucccugaggcagcuuggagaagcauugcuuggauuaaugaguauuagcuggguacauaacuugugccaggcuuuggucaagaugcugagcaucuugaagaacaagacuucuugagaugaacaagacaaaagccucuaggaaugaaucuuaggaauccauucacauauuauuaaagaaaaauaaauauguauuuaguacggacugugccacagaauuuuacgauaauaauuagcuaacguagauugagaguuuaccaugugcuaguuucauucuacguugcugugugugcaugaucucaguuaaucuucauaguaacucuaggaggugagaauuuuuaucaccguuucagagguaaggacucgguguggcuaaggggauuguccagggucacauaaagcuaggcaguagaacggggacuggaugcagcuugcuuugacuuugugguucguggaccugaccacccgugccccuggggcuccuguccagggugggagacaggcaggccuggcaagcaggguaggcugccuggaggagaagggaccugugcugucuugggaagcucuguccuggcugguguccuaagguuccuuguuuaucuuuuaaaaauuaucauugugguguuuuuguuuuuguuuuuuucccuguaaaggccucaguguuggccaaggagagggggaggucauuccaguugaaauaggacagagucuuucaagcugaggugaucgcagcuucucauucugcaagugcauuuuugcccaauuuuggguggcugccagggaccgaugguuugaaggggcccugccucuugccccauccccugcccuguaccagccacugugauuuugcauuuguucuuugaacauuccuccagaaugcaggagcccuuccguccagccuguaugacguucuggaguggaacacacucccuguuuuuuauuugauuuuccagcaaaggaagugacauuccagucaacccgcugggcuucaugauagcuguccugagugagacucgaaggucuggggaugucgaccacuggcuaaugugaagccugaggauugucuuuaauagcuguacuauucccuucaguacagcuuuaauagcuguacuauucccuucuuuuucaacuccagccuuucgauuaccaggcauugguauuagauacugugaugugugcaguuacuucuugcaguccuucccuugaccuuguggccuugaaguuccuggcacucccaguuccagauuagaagucugagacccagagguaugcagacugcccagugccacacagcuaggcuguggcaggcaagggccagccaaagacccuuaggucuagagcuucucuccuacucauuuuugccuaaugcuuaggucagcacacauuuauggagcuucugcuguauacuaggacuuauagagcuccugcugcaaaccuagucacuggggagagguaggaaaagaagauugucagugucuuugguaauaucaguauacuuagaaaggggaaacuggcuuggagaugagagaggagggauaguugggagccaagcauaucuugggguauagacuggggagcucaguguguuuuuagaagaggugaauggauggcccucuuugcugaggacuuggugaauguuuggagcaggguaagcuagcaguagcugggucuuuauucagcacuuauuugcugugcaucuugugcaugggccucugaaaauaaggaacuggauauagucccaggcccugcauuugggggaucagguccaggagggaacuggagacaggaacugaguuucuaucaagggggauguccuugaggccugcauguaggggggaguccagcaaugccacccugcacccagggaagugggguuuugcugaccuuguuaacuacuguuagcuccugguuucucauccacccacuuuacuccuuuccagaucucaggauggacccaagcucugccggacaugguggugucccaccuuuuugggaaggugaguugcguggucuggcaaaucuguuguuccugcugagcaaggcauuguguggugcucagcacagggccccauguggggguggagagaacaagacacaaucaacugggggccaccgagcuggugcucaugagauaaugugacauuauucauucauaagcaacaagucauucauucucucucuuuuuuaugugucuuuuaaaaacagcugauugaaguacaauuaacugcacauauuuaaaguguacaauugacaugcauauacauuuguaaaaccaucccuguaaucaggagaauaacgucuccaucacuccaagaguuuccuugugccccuugauaguccuccucucccuccuccucaggcaacuucugaucagcauuggccucuauagauugcuuugcaauuccuagaauuuuauauaaauggcauuauauaguagguacucuuuuuuuuuuuuuuuuggucuggcuucuuucccucagcauaaccauuuugagauuuguccauguuaaugaguggaucaauaguuuauuccuagucggggugcagugcucauuccuauaaucccagcacuuugggaggccauggcaggaggauugcuugagcccaggaguucaagaccagccugggcaacauagugacaccuugucucuacagaaaaauuaaaaauuggccaggcauggugguucugcaugccuauaguccuagcuacuugggaggcugaggcaggaggauugcuugagcccaggaguuugaggcuacagugagcagugagcugggauagcccacuguauuccgccuaggugacagagagacccugucucuuaaaaaaaaguuuauuccuuuuuagugcugagaaguauuccauuuuauguaugugcaacaguuuguuuuuccauucaccuguugauaagaccuuugaguuguucccaguucugggcuguuauaaaucuggucaguagcaaacauguccguggaguuagcugugugcugggcugggcucaguccuaagagcuucacaaguguuaacuauaggaauaggauuccacccaggugcucugugaccugugugauaaauucuguucucauucccaguuuauggaagaggaaacagaccagagagguugagugacuugcauagggucucaaccagggagagguggggccgguauuagaaccuaugaaucuggcuucauucuggucaccacagcaggauggcggcugccugugcugcugccuggcucugagaugagcugcucuucugcagaguuaccccacuaaaggggauugagccaagccccucacagcaugcuagaagugagcagucaucuuaucagcccagccugccuggccccagacacugguuuugugucucuagcuggggccagcuacccucgggaaggguaugccaugggcuugguugcaagcccagggucuggaaaaccccuugguugccugaaauugcagugaccugcuuugcuuacauaccacugucugcuucugagcuaacaugugugaccaucugacacucccaugaguccuggggacacagccuccacucuggagcuggcgaguacaccaggggaacagacgccccacucuggaguugacgaguguaccaggggaauagaggccccacucuggaguugacgaguguacgagggcaauagaggccccacucuggaguuggcgaguguacgaggggaauagaguccccacucuggaguuggcgaguguacgaggggaauagagccuccacucuggagcuggugaguguacgagggaaacagaggccccacucuggagcuggcgaguguacgaggggaauagaggccccacucuggaguuggcaaguguaccaggggaacagaggccccacucuggaguuggcgaguguacgagggaaacagaggccccacuccggaguuggcgaguguacgagggaaacagaggccccacuccggaguuggcgaguguaccaggggaacagagaccccacucuggaguuggcgaguguaccaggggaacagaggcuccacucuggaguuggcgaguacaacugcuagguuugccuguuguguugguuuccuguggcuucuguaacaaauuaccacaaacaggauggcuuagaacagcgaaagugggaugagcaggguggcucacaccuauaaucccagcacuuugggaggcuuaggcgaguggaucaccugaggucaggaguucgagacgagccuggccaacauggugaaaccccgucucuacugaaaauacaaaauuaaccggaugugguggcacgcgccuguaaucccagcuacucgggaggcugagacaggagaaucacuugaaccugggaggcagaggcugcagugagccgagaucgcgccaugcacugcagccugggugagacagagggagacucugucucaaaaacagagaaaaaggaaaacaaaaguguauucucucacagcucugagucuagaacuccgaugucaagcgcuggcagggccgccccuccgccacaggcuccaggggaaauucguccuugcuucuuacugcuccaggucgcugucggcauuccuuggcuaguggcugcucacaccacucucugccucugucuucacauggucuucuccucugugucuguuuuauuucucccucuccuuccucuuuuaaggauacuuuccauuggauuucaucccggcucauguaauccaggauuaucucaucucaagauccuuaauuaauuacaccugcaaaaacccuuuuucccagcaaguuugcauucccaaguucaagagauuugacauggacauaucuuuugagggccacaguuuagcccacuagaguccucuuuccccuuuuacgauucauuccacagcgugugacacauuuucccuguccugaguguguaaucugaaacugauaggaauugggaaaaauucacagccacugucucuguuucacuggaggagggaugucagacauagcguugagcaucugaucugauuauaccccaaguuauuuggagacugguugguccggccauggugucugaggguacccccagaucgcuauaguugguuuugaucugaaaucccagcgugauuccugacuauuuuuuccagaguuugcucuuaguagccaguugaccuccuugcugccuaaaugauccuggacuguuugaugcagcucaagcuugacaccggcuuucuuugacccccaacuccaacuucucaucugguugccacuggucauaucagacccuugugugaaaccuacagugucugcccucguacaaaugagaaacagagcaaacaaguuguuugucgcaaauaacauucaaaaagcacccagagacggggaggcugaggccgacuuccccaaggcucugguuggccguggugggaguugcaauugcccuucuuuucaguaacuuccuguggcaugaguugauuuugcuuuucaagcaugaaaaacuucuuuucagcucuucccauuggaaaacaauuacuaacauuugccuccaauuuuuacuguuaguagaggugagaacacaaccuccauuaaguccuacaaccuagugaaguaggcaacauucucucucuucccuuuuuuuuuuuuuuuuuuuuaagagaucugaggcucagagagguugaaagauuugccuacgaaagggacagugaugaagcuaagcucuagauccaggaugucugacuucaaauugaaacucccaaaguaaugaguuuggaagggugggguguggccuuuccaggaugggggucuuuucugcucccagcggauagugaaaccccugucugcaccugguugggcguguugcuuucccaaagguuuuuuuuuuagguccgucgcugucuuguggauuaggcauuauuaucuuuacuuugucuccaaauaaccuggagaauggagagaguagugaccagcucagggccacagugcgaugaggaccaucuucucaccucucuaaaugcaggaagaaaugcagaguaacguggaagugguccacaccuaccgccagcacauugugaaugacaugaaccccggcaaccugcaccuguucaucaaugccuacaacagguauugggauguaguucagccacaucauugcuauuuaugaggugucuucuguagauccgaaaugugggacagaugagagggagaguauaaaaugagcggaagaggcaggcucugaguuugagcaaauagauuaauaggacagguguccccaggaaggacaccuggccuguaagcugguuccuggcauucagcucgccuugcagggaucugaacaaacacuccagaccacugggggugcagacgugagagggacgcagucgcacacucagaggguugagaguaaauaugugugcccgcugcugaccuucacgaaaggccaaauguaagaagagcuaagugagagagcagcaaagcacuccuggaggccggggauaauccaggcaggcuucugggaguuugucauuccaaggauaaggaggaccugaacauggccuuugccuaaggcguggcccucucaaccagcacuaggugcuuaucuggagcucagcuaggggaggagacagcucagggccauuggugucagccagagacucuguaaucuuccagggagcucgcucaaccugcugagcucgcucugccacgcucgcagaacaggagauagaaaugagccucauaguguuuaucucugcucaaauguuaauaaagugacuucuugaaauuaacauuuguaacagagcuuaguaucugccuccuuuuacaauccugcccucaucucagugguaacauccucacuguggaugugacugaagaaaccgaaaccuggcagugcgguucacuuaguaaacacuuucugagaacuggagcgagucaggcauucggcugggcgcuggagacacagaggaaaccagcacagcccgcagacuccacacuguuaacuugcccguguagauagcaccguaauuaacugaccccucuccaaaucccacugugaagguccuggaauuacugucauuuccuguugaggaagcaaaggcgcaaagagauccuguguucuccccaaggccacacagcuagaaaguggcagagcaugauuuggauccugcuugucuaacuccaggcugugagcugggaaagagcuucucauguugggagcugcaagauagcagagaggguggguggcugcgugcaggaaagguggucggcacugggcuggacccacacugggccucacacgagugcagugggaaaccaccacaggguuugagacagggaauggaaagaugaggccugaguuuuaaagagaucauuugggugcuuuauagaggacucagaguuggugaggcugggacuuaaacuaagaggcugcgagagcauuugggagguggccccucugucaggugggggcucugacuagggggacagggaaggcggggacccucuaugguggagaaucugacuucuacuccuggaaaaaaaagccccacaaauauuugugacaaaaugagggggcucugcuugaaaugcauguguugugcugucccucuaaccaggucuguggacaccaagaggguguggaguccugaaagccacagggccucucucaaguuggggauguggguagcuuaccagaauggccacuggcaggaccuccugggcuuggcuggaugggagugggagauuucuccaggggagggguccucaugcuaaugaugcauuuguuuccugcagccggcgcgaccuggagauugagcgaccaaugccgggaacccacacagucacccugcagugaguggcuuuucucucccccagcacuugcagucggggcugcccacuauaaagguggccuugcuggcagggccuucuuucugaguguggcaggacauugugucagugagaccuggauauauuccacccagagacugagcauuacccagccugacuuggacuucucccugugccgguggcauccguuucuaggguguccccaugaccuaggccuuugaucuuggagaaggaugguugauuguacuugggacagcauuuauuaagcaccuacuacaucaauaacugugugaggcuuugcuccaugaagccuagggauggauagcacaggacccagccuuaaagugcuccauacaccuaggaggaaaagacagucauggacagaacuaacuggguuuccaccaguaaugauggugucuuuuuguggcugagugcaccgcguugugugacacuugggaaccuggcacgucauugccuuuguccuucaugcuguucuuguuucggucuugauugccagcuaaguccugcuuaaccauccuugaggagaagaugcuuuaaaacaaaagcacugagucacagaaauucccuggcugaaauucauacuaaguugugaaugacuaguaaccaauguuauccuaagaucaaaggagaaugaaguaaaagagcaaaggguguuggggaaaccaaaaugacauuguuuguagaaugcaggccccagccuggcaggccugggagugggacaaucuuuaaaggaaccuugugcuaauucucugcucuaucccugaccccaggugcccugcucuguuggugguuggggacagcucgccugcaguggaugccgugguauguagaaaucacagcugauuucuguguuuaauucaacaggcaaagucugguugacuuuguugaaguggcccugccugccccuccucuccucugccccaucagggcaggugauguuuuuugaaaugccauauuggccuuugggcagagggcccagccacucagucucuuucccugguggcugccagcccugguugcuuggcagugucuccucucccagguccccucacccgccagucugugucccaucggcuuguuuauaugggcauguuugccacuuggcuuccuggccaagagacucaccucuuauuugggaagcagcuggaucuuuccaaacugacuggugccugaugagcuggcaggggagagaggcacugggaggcagggcuuagcaaagcuuccugacuccuuucaccccuuaacucccaccugcaacuuuguggcagcaaagagaggaaucugccuuucaaacaaccccacagcuggggagauggaagacuuaggggcuauggaucagaguccugcaguacugccaugcuuugugcagugaucugcagagugacauuugcaaauguucauguaguaaauaccuggcaugccuuagugaaccaugaguuucuuacgggcugacugacuggagauaaucaugggauacaucaauagagauacacuguucaaaucaagggaggugauaguuuuacuuuaagcauuuugaacauccuggguuacauauggguauucugcccaauuccagaugccccuuucaagagguucacugacaaaaugaagagagaaaccagugugauuuuacaugaagaauaguuguuagaucugggaauauuaaaccuguagaaucucuggcagcugcugguuaaacaaggauauuuauuuagcagguauuucuacaguacuguuuacauuucggcuaaucuucauaauaaccuuuugaaaaaagauauuagcuccauuuuauugaugaggaaacugaggcccaaagaaguuaaaucacuuauccaaguugucacagcugguaauggcaaggcugggauuucaagccacaucugcugaaucccaauaacuccacauacuuucuucuuugccagcagaaauacuggaguuucuggugacgguggcagaguggcggagaagggggagauguuuuggcuuuggcuucacguagaaaauuaacagauuuccucccucuugugcagguggagugcaacucaaaauuggacccaacaaagaccacucuccucaagguacagggaaaacaguggggguucguguuuguuauuucuuagaaacucucagacguuuucugcaacauugaguuaggcuugaaaaaggcaaggcacacgaucagaaacuauagaauuaaugauuuaaucuaucuguuuaugaacauauauugggugcugacuggugaucugaggcugcaaagaugagggauccuucucugggacugcaggaaucaauaggcugcuggucugggggcuuuggggauagagggaccagggauggcuuggcaagggcccuccauaggcuggggccaggacauuccuccaagaggggcucucugcuugucacaauaagaagagacgugucccacagccggggaaggucaggacuuuguccagcaaguucaucugagcacauggugagccagcucacucgcagcuggauuugagugucuguagcaaccuccgccaguccuuugccaguuaugacugauugcacaaugcaaaccacuggcuguuuguggcggccucguccggagaugcagcccaagagugggaaccuuucagaggggccucucagccggggugcaccccugcaggggcagaugaccaggcgggaccuggguggagaugaggcggcucccucgcacugggggaaggacaaagagguggcaucuguaggucaccgugcccucaacuucccccauagaaguagaaugccuuugaaaggcauguaggggguguccgauacuuauugagugggaggcuguuuuccuguauugggcucuuuacauagauuuucuuucaagauucccucaaaaggaaauugcaagauuagaagcugcugggcgucaagcuugcauaaugccguacuuugagggcgguugucacaaguaucacaaaauggguggcuuaaagcaacagauauuuauucccuuuuaguucuggaagcuaaaaguccgaaaucaaggugugggcagggccgugcucccucugaaggugcuaggggagaaugcugccugccucuuccagcuucugguggcugcuggccacacuugguucaccuuagcuaguagacacaucacuccagucucugccuccauccucacucagcacucucccgauuguaucucugcgucuauguccaaauuuccuucuucuuuuaauaacaucagccguuagcuuuagggcccgcucuaauccaauaugaccucaucuuaacuugauuuuaccugcaaagacccuauuuccaaguauagccacagugauagguacugggguuaggacuucaguaugucuauuuuggggacacaauucaaccacaaccuacagcaaaggguagguggccugacugaggugggguggccgauuugaugguagauccagaaacagaacucacuuaggccugauucuggagacuuccacagcgucagucuaaugugcugagugccccgccuggaggaaaaauucgggcauccugcucccugcgugcugguugagcugagggcugccccaggucagugucgcuuuguggcuaguguuggggguccacacuugaggcgcccugggcuguaggaugcccacagccucaccacucccaugaacuccuccagccccguuucaccccaggccacccuccccgcagccucccccugcucccuugccgucagcgcugcccauuuccaggcuggcugcacagucucacagccugcaauggccucuugcgguucggugauuucacagggacuuugaacguccaccauuuaggaaggguacuggucagcugaauccggccugaagacccaaauucaaccacuuccuuuugagggaaacuuucaagggaauauaugaagagggucuuguuuaucaaacccuuucgggucagagagauccuggccuggaaccuugcgagucccucaagcucuuccuggcccaguuucugccuguaaaaugggacagcuguaccuuccaugguucuuggggaauggagugaaauuaucuguagggccuagcauagugccuggcacguagcaagcugcaagugaugguugccacggagacaccagcagccuugccugguggggcuggauuguucccuacccacgguccacccuguuccuccuuuguaaggcaggacaaggcagggcagggcagcgggcggaugggcauccuuucggaaaaaauucauagagcgcagagggccuuggcugugguguuuggcacuaacgagcuucccucucuccuagauggcggacuguggcggccucccgcagaucucccaggugagugccauguuggcuuuugcauuauacagcugucgcuucccccuggguggagugcaugugccucugugacaccuguucccucauuaccuugcugugacaucggaugacaguuuguggacuguugggaaaaggugcuauauaggaggacucugauucccuaggaaccaaccccuguggaguaggugauacugcgguucacagagguugggggauuugccaaguagacacaccuuggucaucaugggucagaaucuggguaugucugccccaaagaccacgggcuucugcuggagugaagggccgcaaggagcuccagcccagagcagagggacauggaggagauuaagccaaauugugugugugugcaugcauguuucugugugugcauguguacacgucugugugugugcauguguacacaugucugugugcauguguaaaugugugugcacauguacaaauaaacacauugaucaacguaauguguuugcuacguaacugaucccuucaauuuccccuccuauaaagaaucucaccaaccuaacaaguaaacuuuuaauuuguugucuuauaauuuuauauccugacaguuuuguguuccaucuuaaaaugaaauagaguuuuuugucaucuuuuuuauccaaaaccugcccugccuccuuucuuccuccuuuuuuucuuucucuacuuaaaaugagaacagauguaacccuggucauaauuaaaagaauuuucagagcuucagaggagugcaacgagcacaggcuucgaggacaccagcacaggggggagcaauuccugugugacacugucguccucaugccguugcagguuggguguauguuuacacaggguuuucccauccuugauuaaauuagguccuugcaauaguccucagaggugggaagagcaagcauuuuaucccagugucacagaagaggaaacugaggccaaaaguugagagagauugcccaugauuacuggagcuaaaauugggcccaaguguucucauucccaagcguguauucuugguucucuccaccaucucgaacacaggcgucccuguucccugcagcccugaccugcuucucuugucucuuucuuccacugucacacaaauuccagagggcaauuugagcauagccgcucuuuuaaaugucauuuggcucuuuguggaauccuggcaggaguuaguggagagcagggaggggggucagcccagccucuaccagugcccucucacugccucaggagaauaggacccagggcacuggauagaacaguugggauuaacugaagaacagauacgccuugcacguaugcccuugauauuugagcauucaccuccaaguuuacauuaaaugaacugagagaacugguagaacuggauguggucucagcauuccauacgcauuucacuuaaaguagcccaguuaguuguuaauuaauugguuuguuuacccauccaacgaaccauccaaccaucauccauucauucuucuucauauccuuucuuccuuuuauuuguccuucuuuuguucauauuucucuuuuuuucuuccuuuuguccaucaauucuuuuuuuaauccaucuuuccuuccuuccuuccuucucuuccuuucuuucuuuuuuccuuccuucuuuccauccauccuuuucuuuccacccauccaucuauccaucaucccuucuuucagccagccugcuauugaggcugacagugauuugccucaagaacaaguguuuuagguuuggagagcccuggguuaauguacaggacccaccacuuacuuguugugggacccugaguggauuuaccuguccaaaucuguucagcuaugaaauguaucuaagguagcacugaccucgugagggguugucaggaguaaaugaaugaacgcagcaaagccccuugcauugggaguggcucaugaugccgaugcaguuauguuccacuugcuggguuagacaugucccuuuguggaugguaaucuccucagaaacacacagaaauagcugugauacucugcccuguauuacaggugaggaaacuggcucagacaggucauguaacuuguccaaguuccacagcuguggggugaauuucccaucauugucccauacucuuacuuuuguguuuuguccugucaacacgugauggcuuuugucuugagccaaacucucaaaugaaggugaccacaggcacagccccccauggccucgggugaucuggcuccccagcaacugacugcauuuucucuccuugucucucgcagccggccaagcucgcugaggccuucaaguacuucgugcagggcaugggauacagugaguauggcauuccccgugugcagugggucggggcaugugucggaauuggaagugcucuguccugagccagguuuggaugagcaauucugugucccccuggccagcuucagcuuucugggaggaaacaguuagguguguggagggcauguggcagccuggaggaucuagccucucauuuaucagugaggcucauuuuuccuccuuuguugaauagaaguuguuucacaccagggauuuugggggguuuagaugaggacugucccuuuaagcaccaagacaaugaccaacagugaaacaauaacauuuuuaaaaauuuugaucacaaguuuuaagagaccacuagcuacagugaugaugaagauggugucgaugaugaugaaagauuacuaacacauuauuuuaucucacugaaccaucacaguacuccuuugacauauucuuagcccaucuuaucagugaugaagcugaugcuucgggguuguaagcagggagcagagggcggaucuguggaaauucuuugaagacugugaagcucuguggaaguggcuaacaaaguugcuuacauucaagguggagcaugccauagucaagucaugagcuuugggaaguggaggauacauuggaagcaucauucaggaacucacucguucuuauuuugcaguuauaguuuguuagacacauacagccuuuuuuccagaagugcugucccaggacuaggacagacccuggcgaguuguaacucggcugaacagcagccacacucagugcugugggccugucagccaugguccggcccugacaugacuaguggcucuucugacccuacugcuuggaacuauaauucguguguccucccuuacuaggaaguuauugaacuucugaucccuuuuaucauuuccuuaaacuguuugcccauguauaguaagaguaugcuugguaagcugacugcaguccuagcauuggccuuagccaugauuagcucuagcaaggcgaggcuggcagguuugauuuccaugccucaggcucaggcaggauccacauccccaggugcccucuuccaacagaagcuaucugcuaguggggcuccugccuuucuagccugcuuuccccgacggaaguugcaggcaaagguugucauuggagacagccauggagacagccgcggggcaguccugcuuuacccugcacggugugaauuguggcucccauuugucuuggucccgccaggguuuggauuucugcuuugagaguguguucuggagagaaaggaagugaaugcuagaccucaucuuucuccccaaaucggcuucuauuaccagaaagcugaagccuccugcaggucuuggggggaaaauaacaggaagagcuauggucucaaaggcaucagccaaagagaaggaaaggaaccggucacuggccuucugcacaccacggggugcuggcuugaugaacccuuugcacaccuggcaucagugcucacuguacgcuucucauccugcucaguagacaucccagauuugugggugagaaguaggggcucagagaaauaugugagcugcggauguggcauugaccccaauucuuucugaauucaaaacuagcucuuuaagacaauucagcaaggauuaauucuguuugggagugccugacaucaaaagccccucccugugccuaucaaggagauaacauaagcccugcaugcuugguguggaucaacugccccuguuucugaugucugacucaguguggccuccuagccaugaugcuucaguuggguggaguacuaguuuccuaaagcugccguaacaaaucuccacaaacuggguggcugaaaacaauagaaauccauucucucaaaguucaggaggccuaaaguccaaaaucaaggugugggcagggccuugcucccuccaacgcugcuguggaagaaccuuccaugccucuuccuggcuucugguggccccagcaauccuuggcuuuauguggcuuguggcugcaucacuccaaucucagccucugucuuugcguggacuucuccccugcauaucccugugugcuguuucuauaaggacaucacagucauuggguuuaggguucccucucaacccaggaugauuucaucucaagauccuuaacuaauuacauaugcaaagacccuauuuccaaauaagguucccuucugaaguuucagguaggugugaaucuuccgggacacugucccacccgguacaggugggcaggauuguuccuccucauuccaccccaucagcacgugcuaccccaucagcaugugccacuugcacgugccaugugcaagagcauuugaggucucagagaagaucccaaagaauagacagcgcccuuguuagcaccugggcugacaggcuucuuugggagagaugacaacgaauagccaugccgggaacuugccguguggccccucucccuuuccccaccugugaugugcagggccacugaccccagguguccucccugcuccagugaucauggacagcauggggucaugggcguacacacaggugcugauaccaggggucaguauuuaacauacuugcuuuacagaugggaacagggaggcucagggggacacucucaaaauuacacagcuuuuaacagguggcagaauugggguucagacccagaucuggguucaagucacucauggugugauugcggcaguuccuucccgcaucugggccuugccaucucucucuccgaguggacauggagaggacgggggcccagcagcuggauggcugcagggaucaagucuucucuggggcuggcacguaaaagagcauguggcugguggacgggcaugccuggcuccucaccuggcagucuccugcccucuaaccggcugucucuuguuccccuagugcccucggcuagcaugacccgccugaugcggucccgcacagccucugguuccagcgucacuucucuggauggcacccgcagccgcucccacaccagcgagggcacccgaagccgcucccacaccagcgagggcacccgcagccgcucgcacaccagcgagggggcccaccuggacaucacccccaacucgggugcugcugggaacagcgccgggcccaaguccauggaggucuccugcuaggcggccugcccagcugccgcccccggacucugaucucuguaguggcccccuccuccccggccccuuuucgcccccugccugccauacugcgccuaacucgguauuaauccaaagcuuauuuuguaagagugagcucugguggagacaaaugaggucuauuacgugggugcccucuccaaaggcgggguggcgguggaccaaaggaaggaagcaagcaucuccgcaucgcauccucuuccauuaaccaguggccgguugccacucuccuccccucccucagagacaccaaacugccaaaaacaagacgcguagcagcacacacuucacaaagccaagccuaggccgcccugagcauccugguucaaacgggugccuggucagaaggccagccgcccacuucccguuuccucuuuaacugaggagaagcugauccaguuuccggaaacaaaauccuuuucucauuuggggagggggguaauagugacaugcaggcaccucuuuuaaacaggcaaaacaggaagggggaaaaggugggauucaugucgaggcuagaggcauuuggaacaacaaaucuacguaguuaacuugaagaaaccgauuuuuaaaguuggugcaucuagaaagcuuugaaugcagaagcaaacaagcuugauuuuucuagcauccucuuaaugugcagcaaaagcaggcgacaaaaucuccuggcuuuacagacaaaaauauuucagcaaacguugggcaucaugguuuuugaaggcuuuaguucugcuuucugccucuccuccacagccccaaccucccaccccugauacaugagccagugauuauucuuguucagggagaagaucauuuagauuuguuuugcauuccuuagaauggagggcaacauuccacagcugcccuggcugugaugaguguccuugcaggggccggaguaggagcacugggguggggguggaauugggguuacucgauguaagggauuccuuguuguuguguugagauccagugcaguugugauuucuguggaucccagcuugguuccaggaauuuugugugauuggcuuaaauccaguuuucaaucuucgacagcugggcuggaacgugaacucaguagcugaaccugucugacccggucacguucuuggauccucagaacucuuugcucuugucggggugggggugggaacucacguggggagcgguggcugagaaaauguaaggauucuggaauacauauuccaugggacuuuccuucccucuccugcuuccucuuuuccugcucccuaaccuuucgccgaauggggcagcaccacugacguuucugggcggccagugcggcugccagguuccuguacuacugccuuguacuuuucauuuuggcucaccguggauuuucucauaggaaguuuggucagagugaauugaauauuguaagucagccacugggacccgaggauuucugggaccccgcaguugggaggaggaaguaguccagccuuccagguggcgugagaggcaaugacucguuaccugccgcccaucaccuuggaggccuucccuggccuugaguagaaaagucggggaucggggcaagagaggcugaguacggaugggaaacuauugugcacaagucuuuccagaggaguuucuuaaugagauauuuguauuuauuuccagaccaauaaauuuguaacuuugcagcgg

SEQ ID NO: 21529 - RNA, 24783 nt, Homo sapiens
ggcggggcaguccggcgggcagcggcgguuccggugcggcacagcgggcggacgagcgggcgggacgagcugagcaggaccaagcgggaugcggagccgccgccgccgccgcuccccgcgcuuccuaagagucugagacccgccgggccgcgcccccugcccaggcccgcaguccgagcguuccgagcgcgggccgggcccagcgccggccgcggccgcguccccguccagucucgggcggcccgcccccugccugcgcccccuccccaugcgcggcgcccaugcggacugagccccgccccccggccccgagcccgccgagcgccgccgccggagcccgcgccgcccacccgcaccaugcucaagugcaucccgcuguggcgcugcaaccggcacguggagucgguggacaagcggcacuguucgcugcaggccgugccggaggagaucuaccgcuacagccgcagccuggaggagcugcugcucgacgccaaccagcugcgcgagcugcccaaggugagcggccgcccgcaccugccgcccaaaggcgcgcccccagcccgugauuccuccggcggcagaaucugcccgggcgagucaccgcagccuccagccggcccugcugguuugcacuggccagguccccaccccagccagccccacccuucucuuccagccgcccuggcuggcgcagguggcagcggucaucaggugcuugccuggggauagcgauugucaccgagccuggaggcggagccucagagugaaacccguggggauucagggagguggaugggguuaggguggaacuuggauucagguggcugaugaguacuagcuucuugggccgcucuggagguggguccagaccuccucuccuuuuuugcugggugcaggggugagugggggagcccucuugauguacucuuugcucucggaucuguucgcugucccccuuucuuuacccuugcuucucguggucaggugcucuccuaaggcugcuacaagaaaggaggcuggagaaagcagauuaaaaaguauuucuuuucuggagauggggugcugggugaucaguaccuagggguugggugucccaaagaaugugacccuguucuggccguggcagugacagcucgguccucuguggccaccugcaggccucgcgcguagcacugugccugugguacuguguuauuguggggagcguuuacugaguucuugcugcagaaccaggccaggcuuguugucaggaugcaguagcagaggccagugugggccccuggaggguggcagaagugguucaggggcugggugggcccugagguaagacacaggguaggggauuggggcuuugucuggucgccagcaggugucuucucagaguggaggcuggugugaagaguagagggaggcagccacagugggcguguguaccguguguuucuuuccuuuuuuugcaaauggggugucgugguuagaccccaggacccggugugaccuggagcagacagaggccuagggacucuugacuugugacacucacguguccaggagcucuucucugcucugcaguggucucugccacagaguccguguccucccugcccacagccuuuuuuccggcugcugaacuugcgcaagcugggccugagcgacaacgagauccagcgguugccucccgagguggccaacuucaugcagcugguggagcuggacgugucccggaacgguggggagccugggcaggggcuggguggggucuggggaguguccgcuggggcugcagacggccugcaggccauggcaucuguccacugugacccucugugacagauaucccugagaucccggagagcaucaaguucugcaaggcucuggagaucgcggacuucagcgggaacccccucuccagguggguggcagccugugguggggucgguaggggcuaugggucccacagcccuggacuggucauccgagggccucugcuuccucccauccaggcucccugauggcuucacucagcugcgcagccuggcucaccuggcccugaaugaugugucucugcaggcacugcccggggacgugggcaagugagugccuucucagguggaacuaggguggggugggggaccaggauuggcccugccccugcugccacugcuuuccuuccucuugccccagcgccuggucucucuuucagccucgccaaccuggugacccuggagcuccgggagaaccugcucaagucccugccagcgugagugugacaggcauucuccuaacagccagggcagggccacagcccagggaccagggcugcguggccacaccuccacccugcuuccucugcaggucccugucauuucuggucaagcuggaacagcuggaucugggaggcaacgaucuggaagugcuggugcguggaggccugacagggcagagaccggagggcgggccacggaagcaagggcaaagaaggggacagcgagcagauccgacagcaaggggcaccucgggagggcaggcgggugggagcugggugugggggcguauagucucuugagcacggcgcagcaggaggcuuugccucauagucacuauuuucucuguuccuucuugcagccagacacucugggggcucugcccaaucuucgggagcuguggcuugaccggaaccagcugucagcacugcccccggugagucaggguggggcuggcccccugcuucgugcccauccgcgcucugacucucugcccaccugcaggagcucgggaaccugcggcgccuggugugccuggacgugucggaaaaccggcuggaggagcugccugcugagcucggcgggcuggugcugcucacugaccugcugcugucccagaaccugcugcggaggcugcccgacggcaucgguuagugugccugggggugccuggguggggcacacggagccuggcccugggaggagcguggggcgucggggcugugugugguguggaacacaggggaggauccugagugugcccaggcucugggagcugucccuggggaggggaggugggacccuggggcagcccagaaggcugaggaggcagcugguggugcuggagggggcgguggagucugugagggcggaaggguggcagugccacuggggccugguguuuucuugaaggagguugggucaggcuuguggggcaagguagguaggguccucccgaaguacggcggcggcagaaggggcugggggccuugcugucugccuugagggcgcuucuggccagguggguaaggcacgucuggggaccaugcucagccuugucccccugucuccccgacgccaggucagcugaagcagcuauccauccuaaagguagaccagaaucggcugugcgaggugaccgaggccaucggggacugugagaaccucucugagcugauccucacggagaaccugcugaugguagggucuggcuugggaggcagaaaggauggggccgucgggggugcagaacaaggacagggcaucagccugugucugcugcuggggggugcugguggcagccugacguggagccacucaggaagggcucuucucuugucagagggggagcaugcuggccggaggugaggcggggcagugaggccagggcaggggccuuugccguuuaccgugaagaaucuaggucucguguuuaucgcuguauguuguaacacuggggagcgguuacagaagaggcaggaaugggaacuuauuugucuguagggaagacagauggagagcaggcugcuccccaggggcgucugccugccccucacaaagcagggcaagcugaggcaccaggccacgguucgggacggugguguugcuauccccauccccaggcugggaaacaggagcuagcuguggggaggguguucaugggaguuuccggggggguuccucacuggggagauggagaaagggacucugggguucagggcccugggaaggggcuggcccugagcaggcaggcuggaacugggggccuggggagcccuagggaugacagggcagaccaguggggcaccagacaggcucacagggcgcagccucgcaggucaguccagggcacccaugggagagggucagggaugaccuggugggguguuuuggugguggggacugaaggcugagggcagugggcagagcuuggggagcagagggcacgaagugggguggagacagcuucuguggucagguccuugucccggucuccaggggcugugagggacccuggcuggagcuggccuggggugucugugcccuccugccaggggcugucaucuccuucccacccccagcaagccccuagcguccucugaccuccucuucuuggccaggcccugccccgcucccugggaaagcugacuaagcugaccaaccucaacguggaccggaaccaccucgaggcgcugccgcccgagaucgggggcuguguggcacucagcguccucuccuugagggacaaccgccuggccguccugccaccagagcuggcccacacgacagagcugcacgugcuggacguggcggggaaccggugagugccagccuugcccugcgggccuaaccguggccccaacgccugcugacugugcccgcccggcccgcagccugcagagucugccguucgcgcucacccaccucaaucucaaggcccuguggcuggcagagaaccaggcgcagcccaugcuccgguuccagacggaggaugaugcccggaccggcgagaaggugcucaccugcuacuugcugccccagcagcccccacccagccucgguagguuguuggcaaccggugcuuagcgcgggguggcucucaggcaggguuuggggacuagccuggguccugacgcucaccugcugcagaggaugcugggcagcaggggagccucucggagaccuggagcgaugccccgccgagccgcgucagcgucauccaguuccuggaggcccccauaggugaugaggacgcugaggaagcugcagcugagaagcggguaugagggugaggaucuggggggcgaaccucugccugaccccugcccuguggcugcugcucauccuugucccuacaacagggccuacagcgccgggccacaccucaccccagcgagcucaaggugaugaagaggagcaucgaggggcggcggagcgaggccugcccuugccagccagacucugggucgcccuugccugcagaggaggugggcauggagccacggcaaccuggcgggccgcugacccgggagcuguggugguccgguccauccugggaguggggcugugagggccagggcagcacagagaaggagcaggagaugaggcuggugacagguuucagggacauggagcugcagggccagcugggugaagggugccaggguggacgugugggucgugcagggcgggucuguggggcuggaguauggggagaaccaguggugggugugccugggagcacagggaaugggguuugguugugggguagggucucugguggaacugccgugggugucaucggcaccugggaagggguuugggacugggacagagcaggccugacuguucucacucagagcugugacaugcgugcuguggguuuuugggugcagcagaaccagugaucugggcugggguaggguguguggggccgugcaugggaggggaggagguucauaucacgcugggauuuuccugggaacuugugugguccuuguuuguuuuaggaaaggcuuuccuuggggcugggcuguggaaccguggcuuuguccacccuaggcuuuggaggcguguggcuuccuugcaggcugggacagggagcagcugcgagggcgugagcccguuaacggugccuggucggggcagcgggaagcucagggaaggccugccacguggggggcaucccagguggccagccugugagucgggagcuccgucgaagccugaccccacuucccgccgcaggagaagcggcugagugccgagucuggccugagugaagacucucgcccaucugccagcacagucucugaggcugagcccgagggcccgucggcugaggcacagggugggagccagcaggaagccacgacugcuggcggggaggaagacgccgaagaggacuaccaggagguguggauuggcaggaaggaggcaggaggcugggccugcugggugggggcugccuccccugcggggccucagcugggaucgguuuuggugcaggcagugccugggcccugcugaugcuucggggagcugcccuguacagaguggcuacggguggugcagggccgugcugcugggggugcccuggagagcugccucccuaggugggguuaaggucuccccugacggcugggcucacagagcccacccccacccuggacucucuucugacccccgugggcucccuggugugaggccuuggcgcaccccuucguuuccaccuggggcgcugcgugucuccaggaugagccccuggccuucagcuuuucucagggcugagacacgcgccccucacugggcaguuagugcugagucuuuguguggcggggaggcuuucggagcccgucuguggccacacuguuuaguagggucuuccuguggaagcacagccacagagcuggggccacccucacccuuuuguccgcacagcccacggugcauuucgcagaggacgcacugcugcccggggaugacagggagaucgaggaggggcagccugaggcccccuggacccugccaggcgggaggcagcggcucauccgcaaggacacaccucacuacaaaaagcacuucaagaucuccaagcugccccagcccgaggccguuguggcucugcugcagggcaugcagccugauggggagggcccuguggcucccgggggcuggcacaauggcccccacgcacccugggcuccucgggcccagaaggaggaggaggaggaggaagaggguaguccucaggaggaggagguagaggaggaggaggaaaacagggcugaagaggaagaggccagcacugaggaggaggacaaggagggggccgugguuucugcgcccucugucaagguuggugucagccucaccccugccugacccagauuccccuggcccuccugggcacccagggcugcggcaggagcagggccgaggccugacccacuggccccuggccacccggagaaggugguggacacgugugcuccacagucggcaucacggccacucucaccagaccccaggccugcccuggcauuggucucaguccaugcuuggacuccaggccugcccuggcguuggucucaguccaugcuuggaccccaggccugcccuggcguuggucucaguccaugcuuggaccccaggccugcccuggcguuggucucagugccagaggcagcucugcuggccaguauuugcccgaccugcuggcgggcacggaguucacagaagucaagcauggcugcccacucuuugugggucuccagggccugucuacaugugucguggucccagggcagggucuguuccucucccaagaucacugggcucuccugggauccucucuuguguugggcacugcaggcccgaggcccugauggcucuuuucugccuugucgggcccuccugaggugccacacaggccuucggggcaccagugugucccucccuggcccucaagucuccucuccaugggucacaaagggucucaccugcucucugggcaaacucagauuccagggggaguccccgggucucacuaucccugcccuugaugacacucugacccugagugugggccaguggcaugauagcugagggggcccggaggggccacagcagggacagcccggugggacucugcucagcucuggagccccgcuuguccccagguguguggugucacucacgccuccaggauggaggcgcccgugccagggcagucgagggagcuugcuguggucuccucuguccuuucugcuuguggcgggggcugggugaggcgguggugguggucuuggcgguggcuaaccugcaugccucacugguccuguccuaacagggagugucguuugaccaggccaauaaccugcugauagagccugcucgcauugaggaggaagaggucuguacugcucgcucugcacucuggccgggccgcugcuggccuugcuucccgggcugugggcucacgccucuccccgccccuguugcuugagcgcagaucccucucaaaagagcucucagauccagcugggcuccaggaucaggacaccuccugccuggggcagcccgucuuggcaggggugagcggagaggcugguccagcucccaucagccgccuguggugcucugagccuuaccugccugcggaggcagcgcaguccucacucgaggguggcaggggggccucgggccaccaucaccuggaggugggcaagccccagcccaccacgcucugcagagcagugcccuccugcuggggucuuggggcuucuccagcuggcgucugggcuggcccuggcuggugaguggcaugaggccccauucagcugccuagagaaaagccagaaauggcaucugcgugcugguggggucuccugcagagagcacaggcagccccacugcggcccuucuagacacccugucuguucuguuuccagcugacccucacuauccugcggcagacugggggccugggcaucagcauugcgggcggcaagggcuccacacccuauaagggggacgacgaggugagcacugccuaggagggccuuuccgcugccacuggccugccccaccacaguucacacugauggcacacaggccccuugcccugagaacacucacacgcucuggggacacgggcugggcccaaggcaccuacuguugugggaucccgaaguccaagagcaaccugagggugccugggucugucuucccuucacagcccuccuucucucaccagcugccugugcaccaggccuggggccacgagcccuuucucggggcugacgugcuccuucuaacccccuggcacucaggaucccacaguggcuagagcucaguccuccugcuggccagggcuaggggcugcugggagugggucuuccccuccugggucuucugcagaaggagcaggaaugcgggcccgucucccuggccccugccaagcucgugucugugcccuagggcauauucaucucucggguguccgaggaaggcccugcggcccgggcuggaguccgugugggugacaagcuccuggaggugagucggcaaccucuccgccccgaguggcagcugugcccucuggagguacauggucccugguauuagggugcuuggcugccuucucccggccuccccaagaguuccaagcacaggacacccagacuuccgggugaagccacggaaccuguaaaccccaggagagaaucaccugggcaagugccaccugggcuuuccguugucacccuggcucccauccagcgcccugauugcucaucuuuguucuguggguacagguguguuuuucuaccaguggguagggcagcagcugcaccuggcacaguggccucuccaggaggggccgcuccugggcugaccgagaggggucaggcuacuggcaggucuggugggguuuggacccuguaugggaguccuggagccuccaccuggacaccuagcuguucagccggggcacgggcauccgggggcucugaagaggcaugcgcccuucuuguagggacacacugagggcaggugagggcccugaagcccagccaggaggcgucugcccagggcucauaugcugcgucugcugcucagcucuccugaccuuugcgugggaacugcugcuccuggguguuggggugggggugugggucaguaacccagcgaccuuagguguguguugggcugugcagaugggccggagguauccaggagcggggccauguguggccuggccgugggggcaucugcuugccucccguggccaguguguguccuggcccuagggcuucccacaccggguuucagaggaccugguaggggaggggucggugcccacgaggaaccuuguggcuaaaggucucgggugaugucagcgccuggggccuuuccccucgcccugugccucagucuccccauccuggagggagcguguggagcccccagcacguggcugucuguggcggcacuggguccugaauacgcacguggucccuggcccgcaggugaaugguguggcucugcagggcgccgagcaccacgaggccguggaggcgcuccggggggccggcacugccgugcagaugcgaguguggcgggagcgcaugguggagccugagaacgcggucaccaucacgccgcugcggcccgaggaugauuacagcccccgagagcggcggggaggggggcugcgccugccccugcucccgccugagagccccgggccccuccgucagcgccacguggccugccuggcacgcagcgagagggggcugggcuucagcauugcuggugggaaaggcuccacacccuacagggcuggugaugcggugaggcuggggcccagggccggggagggcugcucuagagcugacagccgcacuccagccucaccggcagcccugccuccuccacccuccccugcagggcaucuucgucucccgcauugccgagggcggugcugcucaccgcgcgggcacacugcagguuggcgaccgcguccucucugugaguggggauggggccccgccccacccacccauccccccugccccgccccgcgcccucuguccccuucugcccuugggccucccugauucgggcacgcucucacagauuaauggaguggacgugacugaggccaggcaugaccacgccgucucccugcugaccgcugccucccccaccaucgcccugcuguuggagcgggaggcugggggcccucuuccucccagcccucugccacauuccucaccccccaccgcugcuguugccaccaccagcauaaccacugccacccccggggugccuggguugccgagccuggcccccagccugcuggcugccgcguuggaagggccauacccaguggaggugagacacaagcccccacccaggcacccacccagcuucagcugugggcacuggccuucccaggaccugcucucuuauggccuugcggcccacuccaggugggaagccggccugcucgcccuuuccccugcagcuccuugaggcuggggcucugccccacagccagacuccucaguaugguccccuugacacagucuccuggcuggccacauggccacagucagcgaggauauuguccucacgcugcgugccugccugggcagcagaacacugguggcgcagaaauccccgugggcauuagggcagcccccgcccgccauccccaaggaccgggacggacucuugggagcccucccacacccuuucccuguccugaccgaggccuguccuugucccgcccuaaauccccaggagauccgucugccaagagcugggggcccucuggggcuuaguauugucggaggcuccgaccauuccagccacccguuugguguccaggagccugguguguucaucuccaagguagggcggcccauccaggcgguucugugagaggugcacccaucccagguaccagcgcaggucagcgcggccucagccaccagcugccacccuccucccugacaggugcucccgcggggccuggccgcucgcagcggccugcggguuggggaccgcauccuggcagugaacgggcaagacgugcgggaugccacgcaccaagaagcagucagugcccugcuccggcccugccuggagcugucgcugcuggugcggagggacccggcacccccgggccuacgggaacugugcauccagaaggcaccuggggagaggcugggcaucagcauccgcgggggugccaggggccacgcuggcaacccccgcgaccccacagacgagggcaucuucaucuccaaggugagccccccccaccccagcccgcccugggccccaccccccaacaggucucucccauaccacgucuccccacaggugagccccacgggggcagccgggcgcgacggucggcugcguguggguuugcggcuguuggaggugaaccagcagagccugcugggccugacgcacggcgaggcggugcagcugcuccgcagugugggcgacacccucaccgugcuggucugugacggcuuugaggccagcaccgacgcagcccuggagguuagcgaucccgccccggggaccgggccucccucuggcccagcccaagguguugugagccgcugacaccucucggggcaggcgacggguccccugugccucugggucugggcggugcucugcggcucugcaucagccgugcgggcuggggagcugugggcggagggcccugccuucccuuucugcugagcuccggcucaucgagcuguccagaggcccaguccaaguaggacgaggcacgugaacggauggugggaggggcguguguuugggacgcacuacguggucugguccuaaaagaagcugagcacuggugacuccugcagagucccaucaggcugcuaagggaugacuccaagcccugcccaaagcccaccagccaggcagacgccuugggaugcugaggguccccgcuccugugccuaguggcaccuugcuccucucagcccaucccugggccaugacuccagggagccccucuggugaccccucaacagagaacucccuacccaagaucuccugcccaacugcugguccgucccuuccuggacuccagagcagaagcccagacggggaguugggaugcgagguggggccccaggaguccuccccaccagcacggccuggauccuggacaagccuggccugucucagggggcucccaucucccuuccgucuucuuccccaugccaucccaggggcccugcagcaggccucagcaguuuccagggguucuucacuggcgccagggugugcaggcuggcuucccacuggaguggccugcagggccacaagagggugggucccgggagggccagcgcccauggcugaagcuggguggaugccugggccuucaccuggaggggccaucugcuccucccagagggugucccugcuggucacacagguccacagggggcagguggcugucaccacuccccaccggcacacagauggcuuccucucuguaacagccucugggaugcggcggccccucacauugguucuguccugcaagggaucucugggaugguggcuuucugccaggcugacagucacagaguguccugacccacagccagcgugggggccccuuggcgggaagugggucugcauucguuguuuuugcuccacagcuggacguugagcuugggguuggccccgggccagcccucacccaccggguccccuccuguccuugagggaguccuggugguuucuggggaaggauuuaucugaggacucgagcucuggaccaucugguucucagagagggccuugccuuuuauuauuuuaaauguguaucuaaacacguuucauucgauauauuuacucgugaaguuuuuauuagagagggagcgagcucccucagggaagagcuagguaugcagaaggcagggcuagugccaugucugcagccggcgugccgcgcugcugucggccacagguuguccuugcaucuggccgggucccccacgagccugccgugacaugucgguauaggaggggcaggggucucagaccucacacucuggccagccacggacagagccaccuccacacccucccugguguugggggcagauaccauuucugccgcgucgggcaagccaggggucccgagcaguggggcugagagcugccauccagcuccccuuccccgucacugcuaccucuuucccauguccuuccgucuucccgggggcucgcuguccgccccagcacugcccuugcucuccguugucacccuggcuuccguccagcagccugguugcucaucuuuguucuguggguacagguguguuuuucugcagcgguugcuuaucuuuuccuuuaaaaaaaugggaucuuuugaguuacaaaaaucaaaauuuuuaaauuaagucuucuggguucuuuaugacuucuggauucugguuuuuuccuugggaagaucuucccuacugcaagauuacaaaaacauugucauguuuucuucuaguauuucuggaaguuuaaacaacacauagcuccaugguccaccuggaauugcuuugaugaggucucgcuugucgccuaggcuggaguguggugacacaaucacagcucacugcagccuccgccuccugcgcucaagccauguccccaugcccagcccuggaacugcuuugcaaguaacuggaugcauagcuguccccacaguacugacugaacagucugucgcuuccccagugauuugggggaaauguggccucauuguguucaguuccuguaggcuccaagcccuguuucuggacuuggucccagugaguugugagcuacuucugggccaaugccacgcauuuaaaucccucacuuuguagcagguuucaugccuaauccuaaugggcaaagucacccacuccuuuuucuugucuugaaaaguuucuauugucaauguguuuucucuuacgaaugaaccugccaaguucugugcagaaaccgacuggaauucugggauuucacguacguguauguauguacauauuuugagaaagggucucgcucugucgcccaggcuggaguagcggcacagucgcugcacgccgcaggcucgcccugccgggcucaagcgauccucccaccucagccucccgaguagcugggacuacagcugcgccaccacacccggcucauuguuuuaaaguuuucuguagaaacgggguuuugucauguuaccuaggcuggucuucagcuccugggcucaagugaccugccugccuuggccucucaaagugcuaggcuuccaggcgugagcccugcgcccagccuugggguuaucuuuaugucgagcuuuucucuagggugucccccgguggcucuugcuuuccuaguaauucuuauaaauccucaccuggauuuguaaaucugcuucacccccuggcagaagccuggccgcccuucccccuucgggccucucccuuguccccucccgcagagccccugguccuguggaggugggcuugucuugugcucagcucugagggacuuucaucuuguacugugacguuugcuguagacucucuuacaacauuuuuuaaauggagggggggcuguuucuauuuauaaccuguaagaauuguuaucugaagcggguguugaguuuucugaaguccucuuaucugcuaaguaggguugguucagcccauggagguuucaucagcgggcuuggggcuugagagagaggagcuggggucucacacaucaggaguccacgccaugucuggcuuccuggcuucucacagaaagcucagaggacguggcacggccaggccggugcucccacagguccaucuguguuucugacuccagagcaugggugggguggggggggggcuucaauucaugacccuuccccauuuuucugaaacucaggccacuggacucaucugugucugucugccuggcccugugggcaucgguuugcccacuggguucuguaacuuucuucucacugugcgagcccaucuuggcauuggcucaggagcugccugcaugucccuagcacucuggagcaguggcccguguuugucugucagagccuacgucuccugcuuucuacggcccacgucugucugucagagccuacgucuccugcuuucuaggacuggugcauuuuuaggggucgugcacaguccaucuaagccuggcccucacuugcugucgggccuugacuuuacuccucagucuccucgucuguacaaugggucacccgcagugccugcuucucggggucgagaggauugauucaguaacgaccugccucgccauggucggcgccgaccccugcgcaaaccuaggugggugugcgcugucugagagacucgcccgcuaccccgcguguuuggcaugaggacgcaaguccucucccacugggccccuccucugcggccaccucccccucggcccugcuguccgcauccucuuccuccuggucacgcugaccaggguccuguguguugaugggcuugucagagccagcuucugacuacuggucaggaccaccucucccuugucaucaucaccauuaaaaauuaaacuucagaagagacugcccuuucuuuuggcauuuccucgauuuacgcucucaggaagaauccuucagucuuucccucugcaucucuggcuguuaacuuuucuguagauaugucuguaaagaagagaucacuagcucuguuucuguccugaugugagcuccugcaggaaagaccuaggaagaugaaaugcuugguucuuccauuuguuaguuuuuagaauaacaggcuggggcccuggaaucuuccaaaggugguuccugaggugucuuucuguuuuuaggguuuucgugaacuuaugagucuuuauuuuccugauggguuucaacacagcguucccuugaugucccuugaucaggcagcgagaccccgcaucccuguggcaugaccccaucauuccccagcugcuuugacagggcauucuuuguacuuccugccccggcccuggauuccaacauuuuugugugggaccuggccccucucggugggagcuggguguggggcuccuauaaccaugggccaggcgugcucaggacucaggcacugccuuugcugcucuguggccucugcagcagauggaggcugagagguggauguuuucagaaagagaacaaauccugaguuuguacuguuacauuuaacucauuuaagauuguaggguuuuuacuaacuuuuguaauuuuauacuuuuucucauaaaaucuuuccuuaauuccuuaauuucaaaauuaacugagugugguggcacauggccuguagucgcagguauucaggaggcugaaacaggaggaucgcucgagcccaggaauuugaguccagccugagcaagacagacucuaaaaaacaaaaacagugacaccacugguacaacugagagcaggagcguggagaggggccgaguucuggcggcugcuuccugaggguucacccugccugggacguacaguccgcauccuguguucucagccacuugagaucauucugugguuuugcuaccaagcugauaacacaguugggcugacucauuuuagcuuuuaggguaacuuuuuaaaaaucuguuuuuuguuuuuuuuuugagacggagucucacucuguuucccaagcugaagugcaguggcacgaucucagcucauugcaaccuccaccucccggguucaagcgauucuccugccucagccucccgaguagcugggauuacaggcgucugccaccgaaaaaaucuguuucuuaauuguguaaaucuucacgugguuccaaaguugaaguuauauagaaucauuucagaagaccggccuccaucucucugcucccagacuaccaucuuuauuaguuuugguuuauucugccauuuguuucucuuugaaaaauguaagcacauacauaaaugaauuuuaaacuuagagaaaaguugcaaaaacaggacaaagaaccucugacacucagcccuauucauggcucacccacugcgccggggacgugcuccgucguggaagggcgcggcccgaucccuguggggcuuggccaccgcaucccucuagucuccuucggucggagcgugccucugucuuugcugauuucucugaccuugacgcuucugcugggcguaggcccugccugcagugacugcccccacgcugggucugauguccucacaggcuucagcgugugcaucuuggccgggauuaucauggagcuaccacgugucugugugccuaccaccagggcucacuggugaugcucugaaccguggggucagccagguuucccccugcaguuacuccugccccuugaaaucagcaagugaggaaggugcuuugagagcauauaauaggcuguuucucauccagcuucgccugugagccucagcaccuugaugguucugagcgggccccgaggugguuggcgacauuccugacccaccacugccauacucaucaggcagcuuccugccaccgagccuucccuucucccaguuuaugugugucugcuuaccuguucacgugggcucacaagggaguccauuucauuaacaagugagcuuccauuuuauuucaugggcgacagccuuuuaccaucguaauuuauuuugaggcucaaauugucccagccuuggcccacggaaggggcuugaggaccugaggcauucugacacgaccuccccucucucagcagccccucaccuucugccuccaggaugugcugggcuucucuccauacccugcccagcccuggaguugccccuuucucucaggagcgcuggauccuuuuaguggagagugacauuuagaagcuguggucuggcccuggacccagcguucuuggggugucaucucgggaccuccugggggccagagcuggaggguaugccggucauucccaagguuauucuuggaacaguagaagagggugagcuccuaguggcugucggagucagcacccgggucugccuuuucuguguuugaacagcucucucugacaugagaggccgggcuaccugggaccuugcuucccacucugccaggaccccugccucucuuggaccugcccaguggcuuuuugacuuguuauuucagaaacugagaagacaggcaccuuguuuguuguuugucccgcuaguccugugagucugaaagagacguagcuaagucugccuguguaacugugcuuuuacgacacucgcguuucuagucuuugcuuucuguguuuagcugcuuccuuguugagcgcuuacaguugaugacuguaucaucguuguaaacagcaucuucuguggugacggcauccgucugccugcucgacagcucugaacucacacccuuucucccccggccugagcagccccucccugugccucccguguguuugccuggcaucucuuugccugccccuuacuuaccauuucagcuguguuuuuaaccaacaguacagggcuggguuugucccugaggccacacugagagcuccucgauuuugcagggaccccgucugugaugagggcggugagcaaugccuguguccacugugcugccuccuccgcugcuucuggcugcugcuggggguggagguuugaagcagucccguugcccgccgcaggcuuggaagucagcucuucccaugguucccucugcccguguuaaccccaggcucgggauucaaguacaucuugugcccaaccagaagccccugccuguccuggcccugucuccucgccccccucugcccugccugagcuaucugagugccuuuccuuucuagacgcccccuccgcccugccagucucuggcuugggacaggugauugagcucuggggagugcagagcuggccgggccuccugcauggugucccuuguuucagaaucccugcccagcacucacacuggggucuggagccagccuuuccacccgagggggccguucugccccaucaguuccagugccugcuacucacgccccuccuucccccaucuugguggcugucagcucuuccuggggaugacuuuacacagucagcagaguggcaggcaucaugcuacuucacagucuugccuagugcagacgugaccacguccacggcagcccugugagcugugauggggaccggccggggacagugcugcagcguccuggggggcccagcggagugcccuccaaggcugccccagccacgcggucagcccugcccagggacgcggcuccugggcucaccguugcugacuauucugggcugggaccccagccugccccagaggugggaccccggguugcaguccccccuucuuagcccacaccccucuucucagguguccccaggugucauugccaaccccuuugcggcaggcaucggccaccggaacagccuggagagcaucucuuccaucgaccgggagcugagcccugagggcccaggcaaggucagaggugccugcagccggcagccccagggccagggagcccgaggccgguggugccugacgggucugcucugcucugcucacaggagaaggagcugccuggacagacccugcacugggggcccgaggccacagaagccgcagugaguguggucgccccacccccucacaucagggcacuggagcggggugcacauugccuguggggugcuggguaguaacccccaggacccccucuccugcccugugcuggccgggugcugccacggagcuaccccugcuagugcuguguucacucugcccccagggucggggucugcagccccugaagcuggacuaccgcgcccuggccgccgugcccagcgcuggcagcgugcagagggugagugcccagugugcagugccccccaccuccguccuguuguccuguucaucggccaccccaggacaaacgccagggccauccgggagggaaccuuugggcgggggcuggggugggaggaggccacgucugaccugcaggcuaccccagccuggcacaugcuuaucacccucauucucaacccaagccauguuggugcugccccacccacacacccugagcugcggaugggugacacaggccgaggcaucccucuaguggcggugcgagagcuucaccugcugcugcuggggcugcccagccccagagggugcgagugggggcagaggcuccugggggauugggcaggcacauguccccaaggggaggacaggcuggagcagcuggaggggcgggugcuggggacaggcaggaggaugugcaggcccaucccuccccuuagagauacaaauaacccucccagagggugcgccccaccagccccaccgaacgugagugccgagggguggcuccugcaggcccuugcccaagcgguggggugguggugaggggccaggcagggccuggaucugaggcagcgcauucgggggcucuuggguacugacccugccuccucuggccaugggcagcgccaagagggaggcuuccgggaggcccuucauccucaugaacaacagcacagucaugggggcagcagucagggcgccacugagcccugagggcugcacaccacaaguaggggcuccccaccaucaccucugucucuggccccucccccgagcccucccugcucucuucuccggcuguccugucugcucccaucucuccugcaaagcuccagccagcacacugccauggagacagcagcugcccagcccaggcccccgcauccugugggaacggggacgagccccuccgugcugaccgagugucuggggcauccccugggcuauagucagguuggggaacugaagagcugcuguggcuuuuaggcaagccccagggcccccagucccuccuggucgggggccacagcccugcccauccucaccccacccacugccuacuccuccagguaccgucuggagcagcuggagggaagauggcugaaucucccugcuccccuaguggccagcaggugagugucccaaguuaacgggugugccccaugguggguggagggcagggcagauggccgcugugcacagggccccuccuccagggauggggggucaggggccaucguggggugcuguugacuccgguuuucccucugcuaccauggggccuccugugugaggaaggccagggacgcuuuccuggccagagcugccuggcgaugggguggggggccugagugugcuguuccuggaggggcucaagcuccugagaccccagucagugucucaggcccaacaccucccagggcccaccuuaucccugccugccuuuugucuggggguccuugcccccccacuguuggcaccucccaacacacugccacguggggguggagguggcagcccccaugagacccagccccagcucagccccucacaggcaagaugucagccccacccagguuggucggucucucucucucugucucucccaccccccucucuacccccgucccuugccuuaaaccccugauccugcucuccucugcccccgccgcccccaccugccuuuuuuagacaaaaccaggggugauccagccauuggcucaggccuggccaaggggcuccccagcccccaggggcagagguuguccccacuccgugagugcucugucccguggguggggguggcagagccuccuuccccagcaggaugguggguggggaucaaaggcaggcggggggacaggcggggggacagccgguggugaguugcacacagcugcagccccgacagcugccccagcauagcucacaagagccccaccccccagccgcccuccccgccuucuccggaugagcugcccgccaaugugaagcaggccuacagggccuucgcggccgugcccacuucucacccgccugaggaugccccugcccaggugugugggggcagcacgccucccugcugcgcgugguuggggugggugcccgggggccccaguaucucggaggaaugccagccaaaccucaagguccgcuccccccagccccccacgccugggccugcagccuccccggagcagcuguccuuccgggagcggcagaaguacuuugagcuggaggugcgcgugccccaggccgagggccccccuaagcgcgugucccuggugggugcugacgaccugcggaagaugcaggaggaggaaggugaggggcacggaagugggguggggguugggucucggcuggucuggccugacccacccugcccuccggcagccagaaaacuacagcagaagagagcgcagaugcugcgggaggcggcagaggcuggggccgaagcgaggcucgcccuggacggggagacgcugggcgaggaggaacaggaggaugagcagccacccugggccagcccgagccccaccucaaggugagcacccgcccaccagacgcccccuacucaccccacgugccccugccccccacagcacguccugucccuuccccaggcagagcccggcgucccccccaccccugggagguggcgccccggugcggacggccaaagcugaacggcgccaccaggagcggcugcgcgugcagaguccggagccaccggcacccgagcgugcccuguccccugccgagcuccgggcccuggaggccgagaagcgugcgcuguggagggcagccaggugagccccuguguggggucgccaccccgcccugcugccugucccugcuccugccccaagucaccccugcccgcuguucucugcaggaugaagucauuggaacaggacgcucuccgagcacagaugguccucagcaggucccaggaaggccggggcacgcgggggccccuggagcgacuggccgaggccccuuccccugcgcccaccccgucgcccaccccuguggaaggucugugggucagggcaggucgggggggucagccugccgcaugggcugcuuccaaugcccgcuucuuguccccccagaccucggcccccagaccagcaccuccccgggacgccuggugaggagccgguggcuaugccuucccuucacccccgaggcauggggguggggucuggccugcccccacccccguggcccucaucccccccuuuccucucacucucugccucuccccucacgcuguccuuucaagcccuugucuggaaagaaguuugacuacagggccuuugcggcccugccuucuuccagaccugucuaugacauccagguaccuggccuccaggccucugcaugccugccacccuguccgugccugccaccgcccccauccgcucccgcagggccuccccacgcucugccguggcccugccucuucacccccccucccccuucagccgggcucugugggccucagggcugggagcccacccguccaccugggugguuuggggcagggcuggcaccggccugaccaacacucuccccaucacagucaccggacuuugcugaggaguugaggucccuggaaccaucucccagcccuggugaguuggggccgggcuggggugagcucccaggagcccagcugcccucagcucacugcccaccugucccugcccuccaggcccgcaggaggaggauggagaaguggcucuggugcuucugggcaggcccucacccggcgcugugggcccugaagauguggcacugugcagcagccgccgccccguaaggccugggcgccguggccugggcccugugcccuccuagaggagcaggcaccucccccagacuuggggugggggcccugccagcuccagcaccacccuugccccaagucuuuuaaccuggguguuagcauuuuaaagagaccccacaggaguucuggccugugacuaacuaacugccccaccccagccgagaccucggcgagacuguaacuagugauguuuguacaaccaaagacucuauuuugugguuuaagga

SEQ ID NO: 21530 - RNA, 33484 nt, Homo sapiens
ucaagauaagcuuaaaaaucaagauaugcuucaauaaguccauuuauuuuacaauuuaauguaaaucuagaauaucuaacuauuuauacaaacuuaacuuuaaaaauagccacuugcuauuuuacauacaaaacauucaaaagaaaauucuucauuuagagugacugaggcuucacauuccagcccagagaauggcagcgaggaggguggcggcgggaagcagaggccuugggugguccgugcuggccccagucccucagcccacccucuccagcacugggaauauauuuaugcuuauuuuucuuuuucaaauaaaacuucuacuaaaacauguuucuuuuuuuuuuuuuccaagacagguucucacauuggugcccaggcuggagugcaguggcacaaucacagcccacugcagccugcaucuccuugagcucaggccauccucccacuucagccucccaaguagcugggacuacaggcaugcacuaccacacccggcuaauuuuuguauuuuuuguagggacaggaguuucacuauauuucccaggcuggucccgaacuccugggcucaaguaauccgcccaccucagccucccaaguucuaggguuacaaguguaagccacugcgaccagccuaaagcuuguuucugaggguugaaaaccacuuuagggcuguucuuucaaggcaaaggauuugguucggcuuagaacuugaggaguggggaauccacguucuccuugucagccucagggcucagcuggaucagaggggagcucaggucuaugagcuggaagagagcagaguggaggaggugagcguggauccggcuagggccucccuuccccucccugcacagaggacuggcugcgugggucaucacagccacucgcucauccuggcucgggugcacugaaaagcacucugggccaccacgucuaagaagcuggaaggagacaggacacacacggagaagcccaggcccccaccaugcacauuccucugucccacaucuggcccuggggucuaugggcaggagagaggcggucccuguccaacaagagcuggcaggguccuggcagggcaccucagaggcagcugaucuuugagaagcucaggcugccaaaggugcauccugcccugagguguguagcugagaagacucaacagccacucucaagggucccacgauggcccugggaggaugaacaaucccagaacugaggacacccagggcugagucaacaugaaccaccugccacuucucaccugucccaccaccggugaagguuuggccacauuuuuauucaugucuggaguguuugucaugaggucgaucagaggccugcuuucagauccuacagccacgugugcuucugggguaucgcagaagucgaugagaggaaggucaaugaggggcuggcuugcagcaucuggagugaccgcgagugguuccaguuugauaucuacaagaagagccuggguacaaaaccaagguuaagagcagaguccagcaucuuucuggcaaccaucuugggagaaugugagcuuugcucauguuccaggugggcuggcgguuuggaaagccaaggaaucaggcggggccuugguggaaggaggcucuguauggggugggccgugccucucugacuguugcccaccucccuguccauacccgcucaccagcagccaccagcuccugccacccugcuucccgcuuccucagcuuugaucccugacccuugccuuagucaaaugcagggcuuucuccccuggaggccuggaaguccugacugccucccuuuggguugcuuggcacggaggcacuggccccaggaugaagcauggcagggaacuccgccagccacagcccuggguuccacgggcuucccgagcagccuccaggaaucucagcuaacagaacccagcugcgcccguucugcccaccucacuaggggcugcaucuccacccggcuuggcuuccucccgagcuacuucuguggcaguacuuuuggagaaaguagaaucgcuuuccucuggagaaaaguuaagugccugaggcacacgggaaggaggagaaccccugucaggggacacauccaccagccuggaaucugucuuucuguugcucucccuuguugguucaguucugugggaaggaaaaaaacuuaugagaaaaugucucuaaaaugcucguucacuuggcugaugugggaagcaagucacucuggaggaacaguguccuggguggagugcgucccggcucuagggccuucacccuccagacccccaguuuccuguguauggaaggggcucagugaucucuccaguuccucucagcucacaaaucuuagcuguccagcaucaccaggggcugauguuagccccuuccuuucuaguuacuaaacacaagguaaugcgcacgcccgucaccuccugaagggagcccagaccacacacagggaccccuccuugagccacggccagcuccuccucgcaugcagcuaguggggggcuucuccuaggccuagguggguaugcagcuggcuccuucugccccagaugcccccuccccugcugcccagugcccugaucagggcugaggccccagguacaggcugcccacaccagcuuuccaauggcgucucccacaggacccugcacgggcgcugcugggcuugccugcugcccacagguccucgaguaccugccacgcaaaacugaauuccuuccggaaacccagcaaagccgcagguccaucaacuaacacacaguaccuucuuuuuaauacuucagagguuucauaagaaaauuccaaaaacaagcagaauuuuguuucuacauuuacacuuacaaacauacaagauaguuaaacacauauuccuauuuauauaucagaucugguguuuucagugaggccuuguuucucauuuucucuuuggcauuccaugccuuucccucucccucuguaaugcacacacaugccagcauauuuucuuccagagucuucugcauuaucauagaacuacauagauacacacagugucaacaccuacuguugguagauguacauacacagaaacauauaagauauauaaaaauguguaauuuguguauaaauacacggauauuauauauguuuuuuuguuuuguuuuucguuuuuuugagacagggucucuguugcacaggcuggagugcaguggugcgaucuuggcucaccccaaccucugccucccagaaucaagugauucuccugccucagccgccugaguagcugggauuacaggcgcaugccaccaugaugcccagcuaauuuuuguauuuuuaguacagacagggucucaccauguuggccagguuggucucgaacuccugaccucgugaucugcccaccucgggcucccaaagugcugggauuacaggcgugagccaccgcgcccggcuaagauaguuaacuuuacacacuagcaugaucuguuucaaagguuauacacgacugaggugugacuucauuggaaucaggugccuuuuucaaucuuuaaucauuucugagcuccagcuauggcuuacuucauguguucugggucaauuuagauaaauuuuauuuuauuuauuuuauuuauuuuaauuuuuacagacggggucucacucugucccccaggcuggagugcaacggggcaaucucagcucacugcagccucaaccuccugagcucaagugauccucccaccucagcccccuaaauagcugggacuacagugcacgccaccacaccuagcuuauuuuuguauuuuuuguagagaugggguuuugccauguuacccagguugaucucaaacuccugagcucaggcagucugccugccucggccucccaaagugcugggauuacaggcgugagccaccacaccuggccaauaacuugcaaauuuuagaaaaccauuagguuuucaaauugauuaucagagaauuacacgcaguauuuccuuguaauaccuuuaauuuuccucuaugcucaugucuauugcauuuucucuuugcaaugaaaaaaaaaacaaacaaacuuuccaaauacuauuuacuucacuaaaaccuggagcaaggcaagaaaaagguaugucacugucugggacagcaagccuaggaauuugagaccaauuuauuaccaccuucgugucuuaccucauugcagaguucuugcggggcucagaggaacgucuccgagcuggcacacacaggggagagcccacggcccugggcaucguuuugggggucaucgguggaaggccagagcagcgccggcuggcgggugugggcaaggcugacacacgccaugcgcucagcaggcuuuguggugcuggcccagaugagcgucuaaccggggugcuguggacagugacccuggcaaacacaacaucagugucgugagcugagaugacauagaaaaaguaagaucucaucauucagccugugcuaaugcagugcugagggcuuugguuucagcccagaagagccaagccagggagcccgugugagcuccgcucuccugggacaggccccaaggcgggcaaggcuccgagcugcuaccaacccauccuggcgugggcuucgggcucccagugggaauggcuucacugcccuuccucacaggcaacucaaaagaaaauugaucaaaugugauuacacuuuacggaugcuaccauuaaaugucacuucacacgagguucagaagagacugagcaaaucaucuuucaguuggugucauagauauugccauaaggaagucagagccgcagccugucuggugggccagcgaaugggggagcaggucucccugcacgcccacucauacccaggcuuaaggucgccugaaucagaugugaacacaaaugagugaagaggaagcugggcacuugguccucacaccccucacgucccuggcaauaccugugguucgggcuacccaugggucuugccuaacuguugcuuucuuguguugcuguugaugaagaagaggcugagucaacuggcauuugcuguggacugaaugucuguguccccagauucaugugcugaaauccuagcccccaaggugauggcauuagaagguggggccuuuaggaggagaucaggucauggagccaaagccucaggaaugggaucugugcccuuauaaaagagggcacauuggugcauaccuguggucccagcuacucaggaggcuggagugugaggaucacuugaacccaggagguagagguuacagugagccaugauugcacuacugcacuccagccugggcaacagagcaagacccugucucaaaaaaauaaacaaacauaggccgggcggguggcucacgccuguaaucccagcacuuugggaggccgaggcggguggaucacgaggucaggagaucaagaccauccuggcuaacacggugaaaccccaucucuacuaaaaauacaaaaaaugagccgggugugguggcaugugccuguggucccagccgcucgugaggcugaggcaggagaauugcuugaacguaggaagcggagguugcagugagccaagaucgcgccacugcacuccagccuaggugacagagcgagucuccaucucaaaauaaauaaauaaauaaaucagcauaaaagaaacuuguucaccccuaacccagugaggacagagaaggcggcagcugugaaucgggaaacaggcccucaccagacaccaaaucugcaggugccuugaucuuggauuucuagccuccagaauugugagaaacaaauguuuguuguucaagcuacauagucgauagaacguuuguuauaguagcccaaaaaggacaaagacauuauuuuaaaauaaaaugagucaaggacaucccaccaccauggccccucgggaggccagggagaccugucuauugcucuauucugggcaauuguuacguucuucaaaaggagccugaaaacagacugacucuagccuauuuaaauggaagaaaagcaacgaggcugaaaucaagagagaaacagaaucacuccagagagcaacugcugucaaccccagcugcugcucuccgcgaaguucuaggauuccccacccuccucccuuuauugcuaaguucuggcagccccaccacaaauuccagugaaaauaaaaauuccggccaggcgcgguggcucacaccuguaaucccagcacuuugcgaggccaaggcugguggaucacgaggccaggagaucgagaccauccuggcuaacacggugaaaccccgucucuacuaaaaauacaaaaacuuagccgggcgugguggcgggcgccuguagucccagcuacuugggaggcugaggcaggagaauggcgugaauccaggaggcggagcuuaccaugagcugagaucgugccacugcccuccagccugggugacagagugagacucugucucaaaaaaaaagaaaagaaaagaaaaauuccaauaaauguaauucucaaaguaacccugggugaggugaggaaacugaggcacagagaggcaagugagguggccaguggcugccuggcucuggucuuugcucuucaccaccaugcaugggagggacggcagcuuagcauggcaccaugcgcagcacgugagggacuggcuaguucgaccucgcgaagcgugucucaagcucacacaggaggaaacuaaagcccagagucaccaaaagacuugcaaguggccccagcugagcuugggccaucccuacuugacgugaggaaaaaggucagcaacauucgggaacuuaaacuggaucaaagaccaggaagugguggagcugggauucaaagccaagucaggccggacacgguggcucacgccuauaaucccagcacuuugggaggcagaggcgggcggaucacgaggccaggagaucgagaccauccuggcuaacacggugaaaccccaucucuacuaaaaaaaauacaaaaauaauuagccgggugugguggcgggugccuguagucccagcuacuagggaggcugaggcaggagaauggcgugaacccgggagguggaguuugcagugagccgagaucgugccacugcacuccagccugggcgacagagcaagacuccaucucaaaaagaaaaaaaaagccaagucagaaucaaggugccacgccagugcucuucaacugcgguacaagucacagucacccaggagcuuuaggaaauccagcugcugggccucagccuagaugaaccaaaucagaaccccuggggugggcugggcacgggcaguccuaagagcgcuggagggacuucugcugugcagccuggcauggcaaccacaccaguccagggcugggagcugccguacugcaucgcggaagucucagaugucuuaagucugcaguagaucuaaaaggggcugguacacaucaggagcucggccugcacccaagagacuggcguggaagccagaugcgcaggccaggcugcaggguuaccaaaugguugagguaagcagaugcgugagucauucuacagcaauaaagagaggaagcggaccaacgucacucaccugccaacugacgugcacgacugcggccgcugugcccgcgaaagcuuugguguugagcuguccggggagucaccuaaguccaagaaaggaagugugcggucagguaaagugaucagggggagaccuacuguugggggaucgucaccgaaugggcaauucuccgaguaucuccacugucccaacuugaguguagguggcacuggcucagacaaguacacaaagggccacccugcugcaggcagccacaugagaggcauucaccccuacacggggaccccugcccaggcaaaggcuguggucugauggauggacacgggggagaaagagaagagccaucuucacugcgccgccccacccuggcuguauaucccaucagggccgagcacgaccuucacagagcgaagucgacuugucagacggcaccugcaugcgcuagacacuugcccacaggaacaacaccgcagggguuuagcuucccaggcacgcgcaacagagcccacauucccucauuuucccgaaccaugacuuuacugggauaauaauaauucauuacacuguguuugugcuguuuuaguugacaagcauuuccauguguaugaucucaucugauauucacaacaggaugaaaagcaggcucagagggcaaaggggucaccaguuaccgagcuaaggcccaacacaggccccagagguccagucccgccaccacgcccccagacacuggcuccaugguuccuccuccucuauacuggcuccuugaaaaucccagugugcacuugaguaucagcacaugugcucuggggccuccaaagccucaggcaccaggacccccuuggaacaccuugcuaugucugggaagccaugggaaaagaggcugucccucagagccccuuaccccagcaccaagagggaaggguggggccuggagcugaggccucuucuccacaggugcuuccaggaggccaggcgaggguccaggcugcugcccccacagacagccccucucucuggcaacagcacagcugcugcugggcccuccaucuuaacaagccuaugcccgcccuccugcgccugcacccaagcuccugucccacgucccugccccgcuuuaaaccagaucuccucagaaaggcugccugcacuuacauuuccucucuccugcucuuuuuuuuuuuuuuuuuuuuuuuuugagacagagucucucucugucgcccaggcuggagugcaguggcaugaucucggcuuaccgcaaccuccgccuccuggguucaagugauucuuuugccucagccuccugaguagcuggaauuauaggugcccgccaccacgcccggauaauuuuuguauuguuaguagagacaggguuuugccauguuggccaggcuggucuugaacuccugaccucaagugauugcccgccucggccucccaaagugcugggauuacaggcgugagccacugccccagccucuccuauucuuuuaaaaaucaccucuaucaaagugacucaugcacaguuuuuaaaaaugaagguuaaaauuuuaugagacaaacaagucucccaccacacccagcucugcuuccagcgugcuggaagcuucuugcgaugucucccuucacucauuucuaaaucacgcacccacauugcuaccuccgcauucuucagaaacuccguuuguuacaagaguuaagaaucugccccucacaccuccccaccgcccccaccugugcguucaccaggccuccauguucaccccagcacuggagaggcgcgcagcucgcacacagcugagucaaacaugcucccacccucucuccaccuccguuuucaguuuguuuguuucuuuucuuucuuacaagaaacaaggucuugcucugucacccaggcuggagugcaguggcuugaucacugcucacugcagccuugaacuccuggguucaaguaaucuuccugccucagucucccaaguagcugggacuacaggugcccagcaccaugcccagcuaaauguuuuuguagaaucggggucucacugugucgcccaggcugguguuuguuuucuuguauggagugggguggucugugacuaagucaucccauaaucccugucuuuugggaacauucuugggucacugaccccgcaccauucacagaggucucugugagacccaaguuggucacuccuggcggguguggaggcaagcccaccucucucucccucgccgccucccucucccuugccgccucccguguuggcucccucucucccgagaccccuuccucucgguuguccucucccucagcuggguggagcgcacucuucagcagcuuccaugguggcacgggaaggucauucuuaugaaacagaacacgaacaagccaucuccugacacccucacgacugcccuagggcugccugagcacgcacgccucccaggcccacaucagcucuucccuaaaccuggacggcgcgucuccacugcagcucccaguaccggggaggcaaagcccacagccagaauuccaagucucaauccucugggugacccggcagcauggacucauaguaaauagcaacauuuguaacuggacuguuuuacaaagaaugcugcuugccucgaguauuuugagaaagugcacauaugaaagccuccacuacagggcaccguucauguggucccacgcugugagugcccucagcccucaccucuccuccacggugacagcuggugucacagccaaugagcaacaccaccagugcucucagccaaaaagugcacaccaccacgugccucccagagcuguguguucccaacagcguggcugcuccccuggggccucucuuccggccagugcugaguuugugggaccaguuuugacccugaugaaugaccaaaggcgugcaagagacaguccuguucccagcauuguggagagaggaggaaccgccugccgaaggugaaaugcacaucugagaggugcguaaggagaccgcagggacacgcucugggaaacagggcaaagccaacagggauuugggauuagcagaaguccuguggcaucaagcagcccgacagccaggagaccagccaacacuugugccaacguggucaggagagacauggcagacgcauguccuggcuccaggcauucaggcagaagggaagcaaacacuacugaacacaccuccacaugaccugggccguagggugucccugcagaacccacccaaucacagcucgcauuucuuuucuuucuuucuuucuuuuuuuuuuuuuugagacagucucguucugucgcccaggcuggagugcagugacaccaucucggcucacuacaaccucugccuccuggcucaagugauucuccugccucagcuucccaaguagcugggauuacaggcaugcgccaccaugccuggcuaauuuuucuauuuuuaguagagacaggguuucaccauguugaccaggcugcucucgaacuccugaccucaggugaucugcucaccucggccucccaaagugcuaggauuacaggaguuagccaccgugcccagcucacagcucccaucucuacaaacucagcucucugcuguugaaaccuacacugaggucuccagcuguggcuucuccucugagcucucagccugcuccaccccucagcugcagccuaaguggccucucacccucacuacuuccaaaauggggccguggacucugcccgcugccucuuccagcccuccugucacaugaguggcagcacccagguuccgccagaaccucagggacacucgagucccucucugcacugccacaugagcccuaagcuaccagaacgucaggcagaccgcagcgcuccagccuccuuccccagcacuagcuuccuccccaacacagugagggccagguccgcauuacccuccccaccacucuucggcccagagacucugcucuucccucuguggagggaccuucugaaggucaagucgcucugcucugaucucuccuaugcacguccuccugcacugacgguacuccaggguccgcucuggucacgcggcgcucugggagccggccucgggcugccccuccaucuucaucucuucuuacccugccccucggucacugacuggcugagguugcuaguuuuuguucaacagcaacuuuccucuucucaguaagaaauuucagcugugugcggaauaaagacaacguguccuagcauccugugcagggaagcgucguacucaaugggacacaaacggagucacagggacaacuugcagugaggguccuugaaagguggggauuugcucuucuucaccuagaagaaggcuuccugccgggagguaugagggccagagccggugcagccacacuagaccaugaggaugagaagcucaucacggcagcacaggauggaguaagccugggucccugacaccaaggaguacugaccagcugucgcacgucuacgcagaaucccgaccgcagcggcugcacucccacccuccggcccccaugcugcucccagagcacgucccacgccuuccugccccaggaccucugcacuccugccguugccucugccuggagugcucccccuugcacuuuccuaccggcugccucagucuccugguucagaucucagucccgugucaccuccugaccaucuuugccaaagaaccacccgaugcaaauuccuccccaaacaugccagcuccaggacaccaucuucccuuagucccuuuguugugcuaggaucugcaggccugcucaucugauaacauuucguaucuuuuccuauuaaacagaaauucugugagaguaggucugucuuaucaugaugucccuugucccccaaagcauuccagcacagagaagacacucagcagaacagcuuguuccuacagcaggacucagaaugcaguuucugggaguugcaggcugccugugcuggccggcacugccagaacuuaaaauccucaagcacccagagggcagaucugccugacagaggaggccaggacgcuccucucaccuuaagucagcucugagaacuuucugcauugcacacaauuguucaagaaauucaugaaaacuuuacaaacacccacccacuaauggccagacaccugcuggggccaguggccucacugacuggagaaggcaguggcuggagcucaggaggcugagguggcugcaaucugagggccagaaacuagagaggagggggcuacuccgacagaacgagcucuaggaacccaagggaaucucgagucucuggcugagcaccaggcagugcacaggugcagggcaggaguccucaaggucaagagaagagcaacuaccagggagcaacgagcggagcucacagggccgagaaaccgccgucuuaccagggagcaacgagcggagcucacagggccgagaaggugucaucuugcagcagcaggagugcaggggucucgcgggccuugcgggacacacgggugugcagcagaggccuugggaaggacgccgguggcgggaggcggaaaggcuaugcuagacccaccacuucaaagcauaaaaagccucggaaggaugaucugcaccuuaacugccugccaagcccaacccaacuccucagagaaagacaacaaaauccagacauucaaaaguguacaccugacaauauccaacaaccaagaaaaacuugugaaaaauguagaggcaggaaaaugaggccaaaacccggaaacaaaauuagucagucgaaacagaccccaaaaugauggggaagaugguaugagaagaaucguagacccuaaaaccauuaucaauuugcucacgaggauguaaaagaaaacccaaguaccaugagaagaaauaaggggaaacuauuauguuagaaacaaaguuaacuggaugggcuucacagcuguuaggcacugcagaagaaaugauaucugacaacagaaacuacccaaacuguagcucaaggaaaaaggcugggccgggcacgguggcucacaccuauaaucccagcaguuugagaggccgagaugggugggucacuugaggucaggaguuccagaccagccuggccaacauggcgaaaccccgucucuaccaaaaauacaaaaaaaaaauuagccgggugugguggugggcaccuguaaucccagcuacucgggaggcugaggcaggagaauugcuugaacucgguagguggagguuacagugcgcugagaucgcgccacugcauuccacccugggugacagagcgagacuccgucucaaaaaacaaaaaacaaaaaaaaagaaagaaagaaaagaaaaaagauaagaaaaagaaaaaaggcugaaauaaaaaaaagaacagagcuucgguguccugugagacaacgucaagaggccugaaauagaugugauuagaguccuaggaaauaaaguggaaagaggaaaagauagcugaagaaauaauggccaacguuuuccaaauuugcugaaaaaaaccaacccacagaucaaagaagcuuaagaaacccucagcgggauaaaggcaaagaaagccaccucaaagcacauaauaaucaaauucccgacaguaacacuaaagagaaaaccuuacaagcagccuacgagcauuggggugucacacacacaggaacgaacguaagacauucagggagccuccagugaccccccaaaacaacgugggcgagaagacagcgggucacaccugaaagcacuguuggaggaaagaacuaaaaacaccaucaaugccaucaauaauuguuuaaaacuuuaaaugcaauuucuucaguauuuuuuaaagacacauuaaaauguaucuauuacucaccaauagaaaacuuaggaauuuuaaauugauuuguaggaguaggcauaaccuuugucuuggaauuuagacaggaaucucgccgucugauacuucuagucuuauucaauugagaagauucugaccaagcgcaacuggaguucagccacuggccgccaccuuccggagucugggguugggugggggaugcugaggggggugccgugagcugcuccgcugccagcucagaaacaucgacccgcuuggccugccaggaggaugcccccacagggccugcaggcagagcuggccgcagcauggcgggucccauucugccugacuugcugauguuugacagaggccgggagcuauuugcaggaauacuugcaaauucacuugauuuagcuagaagguauacacacaaaaaucacauuauuauaaaaguaugaagcuauuuaacaaacacacagaaguuaugcugucuuuagcauaucuaccuuaaacauaagacacauuaacaauauucuauaagcccuucaggcaacaucaucaaacacaggauggcucaggcagcuuuuagcuuagcugaguguauucuaagguacuuauucucaaaauaauuacuaacauguacauaagcaugcauaaauucaagcucuccuaucuucguugauuauguuggcaggagaaaucuacauuaguugagcagauggaaggggauagucuagucacaugucucaccugucuggucacagaggugggcagggaacaaggaaaaaagacgcaauuguuacugguugauuccuuuaaaauuacaaggaggcugcgucauauuaaccauaagcacuauuuaaaauagaagaccagauaaacuaggguaauacauacugagcuaccaauauacgcagacgaucugguaaaggauucuuaaagaaaaacuuuagcccaggagugguggcucacgccuguaauccaaacacuuugggaggccaaggcaagagaucacucaaggccaggaguucgagaccagccuggcuaauauagugagaccauccucucuacaaaaaacacaaaaaugugggccaggcgcaguggcucgugccuguaauccuagcacuuugggaggccaaggcgggcggaucacgaggucaagagaucgagaccauccuagccaacauggugaaaccccgucacuacuaaaaauacaaaaauuagccgggcgugguggcaggugccuguagucccagcuacuugggaggcugaggcaggagaaucacucgaacccgggaggcagagguuguagugagccaagauugcgccacugcacuccaaccuggcaauagagugagacuccaucucaaaaaaaaaaaacccacaaaaauuagccgggugugguggcaugugccuguagucccagcuacucaggaggcugaggugggaggauugcuugaucucaggaggucaucaccucagucuauaaagauaaggacacaaaccucucuuaaucacagaauggcagagucagaauuccagaucagaucaaucugauuagagaguucacacuuaucauuuuuuuuuuuuuuuuugagacggagugcagugaugcaaucucggcucaugguaaccucugccucccgcguucaagccauucucguggcccagucucccgaguagcugggacuacaggcacccgccaccaugcccggcuaguuuuuguguuuuuaguagagacaggguuucaccauguuggccaggcuggucucaaacuccaggggucaagcgauccacccaucuuggccugccaaagugcugggaucacaggcgugagccccugcgcccggcccacuuuuuacauuuugugaacacaauccacaccaugcugcccugaacgaccccgagacgccacauggccaaugcaccucgaagaggauuucgcucugaagagcagaaaggcgaaggcuuucccuuaccacuagauggcagcuguggcuuggcaagguugaaauguggcuugaccucaaacaggugugggagcauggauuuaaacaggcacccaggaguuauggggccauaugcccuacauuaucuggaauaguccuauuuuaaaacuggugucucaugacauggacaugagggugauuccaguguccauguucucaggcacgggguaucauacaugcuuucuggccauguguaccccguagacugaagccacccaucugagugugcccuccucaugggacagaggcacugagggcagguacagcaacucaguccacagccugguccaccgcacacagcacgcccuccgggacguccugccaagccuaagugguucugcagaaacagucuccaaggccugagcagcacuccaggccucaccuggccagauguggguccaagcaugaugccggcugccucaccuuugcccacugcuggggaugugcacgcacuggaugccccgcuccaaacaggccccgaggaggacuuccuugcgagauugcugguagagccgggugcuuuuaacagggucuucuucagccccaacuggggcaaaaugugaaaaaacagaaucagcaaagaucucguuauuuaccuauuacuugugucugcaaaaguaagggguuuuuggcugggcacgguggcucacgccuguaaucccagcacuuugggaggcugaggccggaggaucacaaggucaggaguuugagaccagccuggccaauauggugaaaccuugucucuacuaaaaauauaaaaacuagcugggcaugguggcaggcaccuguagucccagcuacucgggaggcugagguaggagaauugcuugaacccgggagguggagguuguagugagcugagcucgugccauugcacuccagccugggcgacagagugagacuccgucucaacaacaacaacaacaacaaaaguugguguuuuuacuauuuuaaaauaaucuaauaauuaucaucuugaauuuaaagaagaaaaaagucaagcagcacuucucaaaguguagucuucaaaccccugcaugaggaccacauuagggagcuagcagaaaugcagauuuggggccccaacccagaccccaugagucagcagcugcagggcccagcuuugggcaguucuaacaagaacugccaguacacacagcuugguuuaccgccaaugccagaaaauaaguggcaaagauguggcugguagucuccaugccugugaggaaccgcaauuuucuuucuuuuccuuuuuuuuuuuuuuuuuuuuagacagggucucacucuguugcccaggcuggaauggaaugcaguggcaugaucacagcucacugcagccuugaccuccugggcucaagcaauccucccaccucaaccucccaaauagcugggaccacaggcaugcaccaccaugccuggcugauuuuuauuuuuuaauggagaugggggccucacuauguugcccaggcuggucucaaacuccugggcucaagugauccucccgccucagccucccaaagugcugagauuacaugugugagccacugcacccagcugcuguuuucaaaacaucaacaucucaugucaucuguucaagaacucuacaugagggaaacggaauauccccaccuacaaacuggggcuccgagacgcugacuuuucccaacccacacagcucccagggcagaggcuagccaucagugcacacugcgaagccaguauucuuugcauguauuuugcaggcugccucuuguggguguauuuucaacuuuuccaccucuuuuuuuuuuuuuuuuuugagacagggucucauucugucacccaaccuggagugcaguggcgugauuaugacucacugcagccucgaccuccugggcucaagcaaucaucccaccucagccuccugaguagcugggacugccguugcucaccaccaugcccagcuaauuuuuguauuuuuuguagagauggguuucaucauguugcucaggcuggucuugaacuccugggcucaagugauccucccaccuuggccucccaaaaugcugggauuuuaauccaaagcacuuguacacacagcugccaccucauucccagcaaccacaaguuugggccccagcagccaacucaccuuguuuggaacagggaucgcccgcuugcccuggcccaaguggcuuccggcggccggcacauugacagcacccggggcagguuugucagggagaacaucccggugggauuccuucucagcugggauuuuuguccuggaaggacuagcuggaaucucuuucuugggcugaaaauuuuaauuugaacugugagaacugucuagugcuuaacaauguacagagauacucaggcuuccauucagagcgagccuaggccccaucuuccccagugcuacacaugccccuccauucaucagccagauugaagggaacagggcaagcaguucgcauccuccaccaaaucacuauggacauaagugaugauggauuuugcuuccucauuaaaaacagcaucaaaugauaccuacacagaucauuaauaggagagagguucucuaaagccauuccccagucaggauccuuauuuaagaaugauaaugagaaagcuggucuaguuacacaaauuuuaaaaugcuguacagaaaggacucauccauuaaauggucaucucuaccagagaagcugcucaauugcaauaaaucuucuuggucuaguacugaaagccauuuucuuuggccagcagagucaaaaaauaaguucuugacauauuuagggacaagggcauucauggaacuaauuuauacuuacauaaauagcccccuuauaacaggagaguuaauaagguaacagcaauagaagcucagagugguaaagacgcagcaguaacuuuuucccuuuauagcauuucuaaaaacugagauacuucucauaacauaaaauucacuauuuuaaacaguauacuucagugguuuuuaguagaucuguuauguuguacaaccagcacaagcuaaucuuaaaauauaguggugucccaaaaaagaaccuguacucggccgggugcaguggcucacgccuguaaucccagcacuuugugaggccgaggcgggcagaucaccugaggccaggaguuugagaccagccugacuaauaugaugaaacccugucucuacuaaaaauacaaaaauuagccgggcgugguggcgggcgccuguaaucccagcuacucgggaggcugagacaggaggacugcuugaacccgagaggcagaggaugcagugagccgagauugcaccauugcacuccugccucggcaacaagagcaaaacucugucucagaaacaaaacaaaacaaaacaaaaaaaaaaacaaccuguacccauuagcgguucuccccuuucccucauccuccccagccccaccuagggaagcacucaaccacgccucugucauuggccugucauagucauuucauauaaauggaaccauacgacaugggaccuuuuguuauggccucucucacugagcaaaauguuuucaguggugccaucuuggcucacugcaaccuccaccuccuggguucaggcgauucuccugccucagccucccaaguagcugggauuacaggugugcaccaccauacuuggcuaauuuuuguauuuuuuuguagagacgggguuucaccauguuggccgggcugggcucaaacuccugaccucaggugauucgcccaccuuggcuucccaaagugcugugaucacaggugugagcuaccacgcccaguaguguuucuuuuuauugccaaaaauaaaccauuguuuggauagacugcauuuucguuacccaaucaucauuugcuggaugccuggguugguccuacuuuuuuggcuguuaugaauaaugcugcuucgaacaucugcauguggauuuuucuguggauaugguuucaauucucucaggucuguguacuaaggaguggaauugcugggucccaugggacccucuacauuuauuuuuuugaggagcugccaaacuguuuccacaacagcugccccauuucacagucccaccagcaaugcgugagcuuccagcuucuccacauccucagccuucuccucauccuccacaacauccucauccucaaaauaacaccuguuauuuucuuuuucuucuuccuuuaggcauccuagcaguucucugucaagcacacuuguaaguagguguuacacucaagugguccacccauugcuaaugacuccucacaggagugagcaugugccaugagccacucuagaagugacuucucccagagaaacaugcaggacaugguggggcucccacgugugcaugagugcaucucagcugugcggacagugcccuguccacugggaacaagcucucuggaccccagcucaccacccaggaccaggagaucaaaagagauacuucgaugggucuggagcagcccaaaucacaccaccucucuccccgaguccacgcgugcuacaugcacaaucccugucccgaguccacgugugcuccacacagcaggacccaucccacucucauucuagaaacaucacgguaggaaucuacaucccaaacgggcuccaaauaaaggaguuugcaggccccagcuguuggggguggcagugccgggcauaccuccuugucaagggcaguguguggcguggcggcugcaccucggcugccuuccauccuuggcucucaccacagggagucauguggcucaggagaugggcuugguggggguaaaggaauuucugggcccuugcugagcauucugcauuugccugcaccuccuaucagccccacccagggucauuccucuguacgugcugcccaggggagggggcagagcugggaacgggcugcagggugggccccggggcucccacccgccccgucuuccucucuguggccucucccgagcaagagccagaucgggcagcccuggcagcaaguccugugcucacacccagcuuucccccagaccuccaggacccucagugucccagaguaggcagacugcacccaaaggcaccccugucaacugccaccucccaggaaagcucaccucacucagugcccaggaggaaugcaguguaaacugaggcacggucaaggaggcugacuagcagccauugcagaggaggggaguuuuuggaagagguugcuuauuaaagcaaaugaaaucccuacugugugguauauccagcauuguaacaaaacaaaaggaacaacuucagacagaauuuaggaggaaauauuaggucaacccaacuuauccaagccacccccacaucagcucccuauuggcaacugcuuuuccuggacuccgcauuccuguguuuuguaggccucagagacucgccaccucugaggcuuuccgcauguggcuucugugagagggcugaggggcaaggagugggggcuccccaggcaggcgcucugcuguggcauuuaccuucuccgcagccccagggaugcuucuuccucuaacagaggccgcucgaggcagcagcaauuuggucccgggcuuccucugagucgcugccugacuugcagcaugagcagugcaugauucccugggcaaagcaugagcagagugcggaggccccggcgcccgggugaggcgggccugggcaccagagcugggcagggccggggaggaggccaagagccgaggcucacccacagggggccccagcaaggggcugucugacagguaguaugucucccuuuuaagagacguggggcuuuucuucauuuccuuuucuuucucaaagagguuuauuuuuaauuuugacuccuguaugaaucuuuccacgcccuggcuccgagggucuucaggcuuggcagcuugggcugccugguuccggcugcugcucucaauguguaaagccaguaagugagcuucuuuguacaccuccacgaacuucuccccggccagagggcuccaggcaaagggacucucagaugugggcaacggaggcuguucgggaaccggauuauuuaauuccaagcuggcagcaauacaucuuucuuuauguccaaaggguccgaagaagacuucaucaucuucauuugcacuauuuguuuaaaaaaagaaugauuaauaacucauaacacuggcauuuaaaggaaagacuuuacugaaugugguuaugcccaaggcaagggaagaaaacucauuuguuuaccucgaagaagacaaugaaagaucgaagucaaauuuuucaucggccaaaagaagaaugucuagagggaaaaaauccacuguuauuuuagugccacagcugauaaagagaaaaauauuaccaggcucuauggcuuggaauuaaauaaagguacugugaaauuucacuccccaaaguguauccugucaugaugcuaauuuaguuuuucauagggggcucuaaguuauauuuuuuccuuuuuaaaaaauuuuuuaaauuuuuucuagugacgaagucucgcuauguugaccaggcuggucucgaacuccuggccucaagugauccuccuggcguggccucccaaaguguugggguuacaggcgugagccaccaugccuggccaguuuuuuuuuuuuuuaauugcaucagccggcugggggcgguggcuuaugccuguaacuccaacacuuugggaggucuaggcgggcagaucaugaggucaagagaucaagaccagccuagucaacauggugaaaccccgucucuacuaaaaauacaaaaauuggcuaggcaugguagcgcacaccuguagucccagcuacucggaggcugaggcaggagaaucgcuugaacccaggagguggaaguugcagugagccaagauggcaccacugcacuccagccugggugacagaaagacacucugucucaaaaaaaaaagaaauuacaucagccauucuauguucacuaagccacccaaaagcuuagguccuuacuuuuaagauauaaucuaaaaugcauucacugacucauucaacuagcuuuucaagaagagauaagucauuuuccagguauagaacauuuucaaaagaccaccuuccucagcuccccuagaauuaaauuccccucuuacaagcuacaaaacaucuauucauaguucaacaaugaauuuaauauuacucaaaugcacggaguagggacucuauaagaauucguugaccgccauugcuucuuggaguccuuccugaauccucagaugaaauuacucuguaccccaccccauccauaauucuaucacagcuggcauggcccugucugcccaggucccucuaaaacagaucacaaguuccagguuagugggucccucugcaggggcaccugcucccuccuccagcuccccgcaaggcucccgcagugccuggaccucacuucuaccacugcacuagccucugugagugccucuugacccuucuauggccccaacuagacuauaagcuccuccaagauaacagugucuaacacuaacccaaauucccaaauguccagcuaagggccuggacacuuagcaaauauuuaucaaaaugcacugaaauacaguauuugcucaauacuguaaagcuuauaaagcucucccauaaauguuuuuaucuuaauaaacaaugaaggccgggcaagguggcucacaccuguaaucccagcacuuugggaggcugaggcaggcagaugauuuguggucaggaguucgagaucagccuggccaacguggcaaaaucccaucucuaccaaaaauaaagaauaaaaaaauuagccgagcgugguggugugcaccuguaaucccagcuacuggggaggcugaggcaggagaauugcuugaaccucggagguagauguugcaaugaaccaagauugcgccacugcacuccagccugggugacacagcaagacucugucucagaaaacaaaacaaaacaggcugggcgcaauggcucacgccuguaaucccagcacuuugggaggccgaggcgggcggaucacgaggucaggagaucaagaccauccuggcuaacauggugaaacccugucucuacaaaaaaugcaaaaaauuagccgggcgugguggcaggugccuguagucccagcuacucgggaggcugaggcaggagaauggcgugaaccugggaggcggagcuugcagugagcagagaucgcgccacugcacuccagccugggugacugagugagacucugucucaaaaaaauaaauaaauaaauaaaaauaacaacacagcaugcuucucaaaaaucauaaaauuugaaaauauacuaauauccuaauuugguccugauuaaucaauuauucuuaauuaccuaaucaaggagaagucagaacaaaugcacaaaagaaagaaaagagaaauaaccacacagagagggaaugaaaagauccauaagcacaucugucaacuucaugcacauaaaccuaagaacuuggcugaaagagauaauuuucuaggaaaauauaauuuuauuuauucuuuuuuuuuugagauggagucucacucuguugcccaggcuggagugcaguggggugaucuuggcucacugcaaccuccgccucccagguucaagagauucuucugccucagccuccugaguagcugggauuacaggcgcgcgccaccacaccgggcuaauuuucguauuuuuaguagagaugcgguuucaccauguuggccaggcuggucucaaauuccugaccuuguguuccaccugccucagccucccaaagugcugggauuacaggcgugagccacugcacuugguauauucuuuuuauuuuuuugagauggagucucacucugucacucaggcuggagugcaguggugugaucuuggcucacuacaaccucugcuucccagguuccagcgauuuuccugccucagccucccgaguagcugggauuacaggcacgugcuaccacgcccagcuaauuuuuuguauuucuaguagagacgggguuucacaauguuagccaggauggucucgaucuccugaccucgugaucccuccaucucggccuuccaaagugcugggauuacaggcgugagccaccgcauccagucuauuuuuuauuuaaauugucuaaauguacuuauuuauaaaacugacuccagaagacagggaaaaucuuaauacuucaauaaucauaaaauaacuggugaaauuuauuaaagagcuauccucuucaaaaaagcgucccaacuagauucauaggauaauuguaucaaaacauuaaagaacaaauaauuccaauacuauuuacaucacuccagaggauuaaaagaaaaaaaacuuuccaacuuacuuccacgaggcaaguaaguauguuaccaaaaaaccuagaaagugaucaauaaagaaaguaaagaccagccuuacuuacaucagcauaauaauccuuuuucuuuuuuugagacagggucucgcucugucacccaggcuggaguacagugguacaaucauagcucacugcagccucgaacuccuggacucgagggauccuccugucucggcuucccgaguagcugggacuacaggcacgcacaaccaucccuggcuaauauuuguauuuuuuguagagaugggaucuccucauguugcccaggcuggucucaaacugcugggaacaagcauuccuccuaccuuggccucccaaagugcugggauuacagguaugagcuaccacaccuggccuaacaucaaacucuuuaacaagaauaccagcaaaaagaauccugcaaacauuaaagugguaauaacauaacacaaccaagcucccugcauuucaugacugugagaugguuucauuucauacaaucuacucauauaaucauuuuauuacuagagcuaaagagaaaaccaugaucgucugcacauauguugaacgggcauaugauaaaauacaacauacauucuugauuuuagaggcucuuaauaaaaaguaauagauauauaaggaaauccccaucucaacccaaagccagcauuagguucagugggauaacgucagaaguauuccuucuaaagacaggaacaaauugaucuuaccaguuaggauaggcuaacaugcugaaguaacaacccuuaaaacaacaaagguaggccagguaugguggccugugccuguaaucccagcacuaugggaggccaaggaggaucacuugaggcccagggguucaaggccagcccucgcaacauagcgagaccccagcucuacaaaaagaaaaaaaaaaaugagcgggguauggugccauauaccuguagucccagcuacucaggaugcugagcccaggagcuugcggcugcagugagcuaugaucaagccacugcacuccauccugggcaauagagcaagagacacugucucaaaacaaaccaaaaaccacaaagguauauuucucacucaaacuauaugucugcagagggguaggcuggggcccugcucccuggccuccucacuccaggaccccaacugauggagccuccaccaucaggaacaccgcucgucuccauggcaggaaggaaaagaaccaauuccacacugguucuugaagauuuccacccagaaaugacacacacgacaacauucccauuucacuggccaagugagucaccagagccaacugaauuucaagugaacagggaguacaauucuauuacaugcccagaagacaaacacauagaaaugcucaugaauagcacaccuacgacuaccauuuacuuggaaauuaacccauaacccaguaucggacuuaaugaaaaaccacagaagcaauuccauuaaagccaggcacguggcaaugacaucuccaagcacaauucuuaacacuguucuggacacauaaagcaacacagucaggcaaaggaaggaauguggagguaacaugaucacacugcacagaugccaugauuauagacacgagaaacaaaucaagaagaucaacuggaaacuacuauaaguaguaaaaggauaaaagaacauggcuaaggacaaaaucauuacagagcaaucaacagcuuucauaucuacaaagaacagugagaagauaacauggaagaaaauacuucguuucuagcagcaacgaaagaugcaaaauaacgauaaacaaaccuaacaagaaauaugcaaaauggauauaaagaagacuuggcauaucauaaaaguaacauaucaaauaaagagggaaaguagaccgggcaggguggcucacaucuguaaucccagcacuuugggaggccgaggaggguggaucacaaggucaggagaucgagaccauccuggcuaacacggugaaaccccaucucuacuaaaaaauacaaaaaauuagccgggugugguggcaggugccuguagucccagcuacuugggaggcugaugcagaagaauggcaugaaccugggaggcggagcuugcagugagccaagaucacgccacugcacuccagccugggugacagagcaagacuccaacucaaagaaaaaaaaaaaaaaaaaagagggaaagugaaaaaaugguauuaaaauaaacuacauaaucaucuggaaaaaugccaacuaaguuugguccaugccucacaccacaucaggccuaauuccaaacaaaucaaggacuuaauggaaaaaaaacaaagcccuaaacaaacaagaaucagcuaugaggaaacuuuuguaacuugggaguguggacuucuaacuaugacacuaaacuggaagcuaccaaagauuggucggcugggcccaguggcucacaucuguaaucccagcacuuugggaggcugaggugggaggaacgcuugagccuaggaguuugagaccagccuagacaacauagggagaccuugucuguacaaaaaauacaaaaauuagcuaggcgugguagucucagcuaccagggaggcuuaggaaggaggaucgcaugagccugggaggucaaagcugcagugagccacaaucucgccacuacacucaggcccaggcaacagaacaagaacaugucucagaaaauaaauaaauaaaaaauaaaagauugaccuucaaacauuaaaauuuuaacaucucuguguggcaaaaaucacaauaaguuaaacaagaaauggggaaaagaauauuugcaacucaguucauaaagggcuaauucaugaagcauaucuauaaaguaauaaaaaauuaauaaucuaauaaagauagaaaaaggauacaaacagauaaaguucacagaaaauaaaacaaaacauucuuuuuuauuuuucuuuauuuacuuuuuuugagacggaguuucacucuuguugcucaggcuggagugcaauggcgcgaucuuggcucaccgcaaccucugccuccuggguucaagcgauucuccugcccuagccucccaaguagcugggaucaguaugaaccagcaugucuggcuaauuuuguauuuuuaguagagacgggguuucugcauguuggucaggcuggucuggaacucccgaucucaggugauccgcccacccuggccucccaaaguguugggaugacaggcgcaagccaccgcaccuggccgaaacauucuuaaauagauggcaagaaguucagccucacucaaaaauaagaguaaugaggcugggcgcuguggcucccaccuauaaucccagcacuuuggaaggucgaggcggguggaucaccugaggucaggaguucgagaccagccuggccaacauggugaaaccucaucuuuacuaaaaauacaaaaaauuagccaggccugguggcaggugccuguaaucccagcuacuugggaggcugaggcaggagaauugcuggaaccugagagggggaguuugcagugagccgagaucgcaccauugcacuccagccuaggggacaaaagggaaacucugucuuaaaaaaaaaaaaaaaaaguauuaaaaauaaacuugcucugagaaugcaguuuucgccuauaugacuggcaaaacucaaagauguaugaacuauaggcaagguuguggggaaagagacaauuucuacacugcuggggaagguguaaauuaucacagcucucuagagggccuggcaguaccuaucgaaguaagaaacacacacccucuucgacccagcaagucuacuucugcaaguguauccuacagacacucacagguguggaaagcaauguguugugcaguuacacgguguccacaguuauuuacugcagcaucauugguaacagcaagacucuaggcacaaacuaaauguucacccacagcagaugagaugaaugacauauccccaagguggaacccuauauagguacaaaagcuaguaaugcucuucauguguugauacacaauauucaucaagauaaauuaagccugaaaaacaagauucaggacagggcucuccaugcuauauggaaagggggaugcaacacucuaugcguguuggcuugcaccugcacaaauuaugucuggaaggauacccaagagacugaugacaucgauggcccuuggaagggcaaguaggugacuuagagauauagagaggcagacauuucacuuuuuacaccucuaaauuaggaagucaauuucagaaacuucuaauggucuggcguggaaaaagaauccaggaccagaacucagggaagcagucuucugcuccaggcucugugacuggcuccgaggggucccgggcuggcugacuugcucauccugcaaacacaugagcacccacaacagaccacauccuucgcuaggugccaggcaggcuugggguacaugcagcccacccuggagggugccucaggcagugcggugagagacauguagaggugggaacaccucugagaaaauaucaaagcgugugugagaggaacgggucagaagucagaguggcuggaagaggugaaaacacaaguugggucagaucacagaggguuugcaagccauggcaaggagcuuuuauuuucuccaaagugggauaggaaacuauuaccgggcuuuaagaaaagaauuuuaggccuggcgugguagcucaugccuguaaucccagcacagugguaggcugaggcaggcggaucacuugaggucgaguucgagaccguccugaccaacauggugaaaccccgucucuacugaaaauacaaaacuuagcugggcacgguggcucaugccuuuaaucccagcuacucaggaggcugaggcaggggaaucacuugaacccaggagacggagguugcagugagccaagaugucgccacugcacuccagccuggugacagaacgagacuccaucucaaaaagaaaaaaaaggcugagcacaguggcucaugccuguaaucccagcacuuccggaggcccaggcgggcagaucacgaggucaggagauugagaccauccuggcuaacacagugaaaccccaucucuacuaaaaaaaaaaaaaaaaaaaaaaaaauuagcugggcgugguggcgggcgccuguagucccagauacucaggaggcugaggcaggagaauugcuugaacccaagaggcggagguugcaguaagccgagaucacgccacugcacuccagccuggccaacagugagacucugucucaaaaaaaaaaaagaaaaagaaaaaagaaaagaaaagagcuuuauaaucuaacuuguguuuuuaaaaggugacguuacuguguagaaaguguauccgaaaggaagcagauaauauccccugacauuacaaaugcacauauuagccaacgggaaguagaagccggugagacagcguggcugagacccagacagcagcauguggauggagauggagagucuguagauggauucaggauaucuucugaagguggagaagacguuagcuggugauggcaugaauguaggagguucucagcuugcacagcugggugaaauggagaaauaaaaugggugaugagaaagacaaaaagaacaggguaugcagaugcagaggggguaugccaaguuugagaugagacgugcaugugaagacgccaaauaggcaggugaauauacaagcccagagcucggaggagaggcugcgcucaagacaaaacgugggugccgcagagagcagauacgcugcacagcuauuggaaugcugaccgcccugagggcgaaagcacaaagcggucccagagcaggucuuggggaaaucagccucagaagacagcagagggggagcccccgacagagaaaagauacaccagccagagaggcaggaggaaaaaaccaagagcgucuuggacuccaagcaagggaaguuuccagaaggacgaauguuacugaaaagcugacuggcgauagaaaagugaaaagagauucagcaauguggaagucgucaacgacugaugaaagcagcuugaauggagugguaaggacagaagccggaaugggagggauugagaggcggaaaaaaauggcauaacaagugagaaagcucucaaaguuuggcuuggaaggagaaacacagcaauggagaggcaacggaggagacguggcgacaagugagacaagggaacauuaucuguauguggaugcgcaugauccaguaguggacaggggaaaaguaaggaaaugaagucaggucaacggaaguggggaaggccucaagaaggagcagggggugcaguaugcacguggaaaggacauauuugaaaggaaggacaugacaggaaggaggagaggggugcagaggcaagcgccuugcuagauaugaagaugcaacauugauuuguaaagucuccaggacaguuccugcaaaauggaggcauugaggaugcuuggggccaggcgcggugguucacaccuguaaucccaguacuuugggaggccuaggcagguggaucaccugaggucaggaguuugagaccagccuggccaacaugguaaaaccccaucucuacuaaaaauacaaaaaucagccaggugugguggcgggugccuguaaucccagcuacucgggaggcugaggcaggagaaucgcuugaacccgaaaggcagagguugcagugagccaagaucaugccacugcacuccagccugggagacagagugagacuuggucucaaaaagaaaggauccuuggguagugugagaaaacuacccaagggaugucaaaaugcuuugugaggcugggugagguggcucacaccuauaauccuagcacuuugggaggccgaggcaggcagauugccugagcucaggaguucgagaccagccugggcaacauggcaaaaccccgucucuguuaaaaauacaaaaaugagccagguguggcagcgggugccuguaaucccaguuacuagggaggcugaggcaggagaaucccuucaacucaggagagagagguugcagugaguacagaucacgccuuugcacuccagccugggugagagagcgagacuccgucaauaaauaaauaaauaaauaaauaaaaacgcuuugagagaaaaagaggguguggccuguaacucauucugugaagcuguacccucaccuugauacccaaaccagucaaagacacaagaagaaagggguuuggggccaggcuuacucauuaacauggucucaaagauccuaaauaagucuuagcaaacagaaaccagcgacaaacaaaaaagaaaacaucgaauucaauacaauaaauauuugagagcccacaaaguguuaggugcuguucagggcaugggagcacugcgguaaauaaaacggaugagaauccuggcugugaugaaacuuaaaauggggaggaggugaaagaaaaccagaaaacgaaggcagaugucauguguuucacaggugcagaguacaagucgagcacuugagaaagaauuucucagggaaacauuaaaucacccuccaucucuacugaacauccugaacaacaacagcgccgcagcagcaaggacuugccuuccuucuuagggucauccauguucacguccccugcccggcaggcugaaggcucaucgcggccgccgccuccuuccauggagagagcugucagaagucacugcaggguggaacggggccagaaaguga

SEQ ID NO: 21531 - RNA, 62591 nt, Homo sapiens
uccucuucagccaccuagcgacucuuccggugcugugaaggcgguuccgguucgcggcgguucccggguuuugcguuccgcgcccggccggaaaccccuucgcauggcagccgguuccgguucggugaguggcggcgggaagcugggggaggggugaggauggagggagccugguccaggagacugugucggacccggucagccggcccgggcuggacugggcggaagcggggagcacuguggggccggcgccuuuuccucugccccgcccccugggaccaccuccccuccccccugcuguccgguggccgcgcuguggccgccgguggccguuaggcuaccugaggccguuccuucuggucucucucuccugggccgcggagagaccgucucccugccguuacagcaggccccaucccagcgcccagccguacuuggggaaaggccgguugcgauuccggggcuuucccgccagagcugggucuucucuggggagagcuguuuucaccgggaagcucggcuuucugugguaccggcuucaucucccgccuuccuugagacccgagugauauuucuugacuacuucugcgucucacguaaacauuucuccaacucuccuacucugugguaucucccugagaugugauaucgcuagugccaccaucagaaagaaacgucuggacccuccugcucagguuaugaaaauccccuuaacugccacaauuugcuuaccuggcucaucgccuccugguaauucccuugaaccgucucuuucuugguguacccuaacgugaucucuggaucuaugccucguuucucuuuccuugagcuuggugauuucuguuuaucggugccugugcaguauuuccacuaucuuguuagcaguaacuugcuucuuuaucacuuucaagucagccuuguuaaagucauuuuacuucauauuugguacacuuauuauauuuggagugguggugauucuuguaauauucauauaaagccuuuuaucuacuaccaacuauuugacugagggucuuuguuauaauugguuauucuggauguauuagaucucaucaucuccuaaaucuuuauucuucauaaaaauaauuuguguuaaggacucauguugaaauacagauuacccugacuuugaaauuacaguuaaagcgcaacuuuaagcaucucuauaagcaugaucccuuaaccuacuuccaguuuacacucuaccacccuuuauuuuuccucucuagucccuuuuaggaaggcuuauucauuuuuaacugacuucaauuaauuaucccaacugcaaagauggucuucaugucacucaucuaaugaguugucuagagggaguggauggguacaaaaacagguucugcuacuucuggcuaagggaaugcaguuguugacuugcauugcggcuuuggaacucuuguccuuuucuucccaacuucuacaucuucuaucaguuguaccagcucuacugucuugcgguaccuguuuauggaucuggcuuucccuacuggacagugagcugcucaguggcagggacccuuucuuaaugcacguagucggugcacaguaaaugaauguguaugaaagaauuugaacacuuaggguuuacggcguuagaguguuaagguauuuaagguguuagagugauugggagagauuacauguaaaaauagaaggaaagaaccucaaacacaugacgauauaguacaaacuauuguacacauaauuguuuuucagaacuuggaaaagggugauuucacaugguugcuuucacacccuucuuauaucauaaauuguucuaaccacaucuugguccuggauaaagcuaacauugcgucucucucucucucucucucccucccuccgcccccccccccccccccgucucucucucucucucucucuauauauauuuuuuucuucuuuuuuuagacagagucucgcucugucacccaggcuggagugcaauggcuuggucuugucucacugcaaccuccgccucccggguucaagcgauucuccugccucagccucccgaguagcugggauuaugggugccugccaccauaccuggcuaauuuuuguauuuuucguagagacaggguuucaccauguuagccaggccggucuugaacugcugaccucgugaucugcccaccucggccucccaaaguucugggauuacaggugugagccaccgugcccagccucaauauauauuuucuaguaacuuccuugcagcccuagacauugucuuucauaauccccuuuuugcauauauguaagguuauaaguguuucaccgcaguugucaagacugugaucuuuuuuguucuuucagguuucccauuaucuuguguuccacuacuaaccugacuucaucugaaugucuguaacagcuuauguucuuucaguaaauuacaugaccaguguauacuaggaaaugaauuauuagaaucauuuuuuuuaaaaagaaaacauuuuuacaguugcuugaauuugguggcaucagagguuccagauccaacauuuucauggagaaucuugggguaaaauauuccuucucccaauguaacugcaaguggcuaaaagaauguaccauaagcacacugaaguagcuggauguauuuguaguaaaauauaaaugugggguuuuaauuauuuaaaauuauaaaucaguguggauuccccaggguuagugagggauuacuuuuaaauugccaguguguauuaaucuuugagguuguguuaaaggauuugaaguuguauaauguuugaaaugugcauuugcccuggagucaggauacauggauucuugucuucuuuuugccccaucugugugauuucagggaagucacuuaaccucucuggauauaaucgguaaaauucuuugaauuucuagcuuccuuuucucuucacaucuaucccaacaaaaugcaaggaaauugacaugggauuauucuguugggcaccaagcuuuuaaguuggcauucuucuuaauaauaauuuuaaaaaggcuaguaaugacaauuaugaagcaacuuuaaaaugucaaaaaaguguugcuaauauauuaguugauaagauuuuuucccccuuaaucuggaacccaagggagucuacucuauuaaagaagaaagaaggggaaagaauaaccugaagaauuuuuaguaaagaagccuuuuaaguugagcauuuggaaauauauuugaagcauaaaucuaaggcuuaaauucuuuagggauccuuccuggcaagacuagguaaucagauaauuacucugcuuagucuauagcuaugccaagaaaacuuuuuuuuuuuuuuuuuuuugagacggagucucgcccugucgcccaggcuggagugcaguggccaguggcguggucucguacgccaagaaaacuuuaagcugccuuccuuugugugacuuucauuauugugaccacaaagaaugccuauuaucaucauccagccucaugaauacauugaagcccuaguauugcuaugugguugaugaagugcuuaauauuuuuuaaaaauaugguuauaagauuauaaauauauauaggugugacuauuaccaucccuaguagccuccuccucuuggaaaucuaccaagaccauaugugccgaggauauguuuauuaaccuaguuccaagcaguuugguuguguuuuuguguuugguuuuuuuuuuuuuuuuuuuuuuugagacagagucuugcucugucgcccaggcuggagugcaguggcaugaucucggcuuacugcaaccucugcuuccuggguucaagcaauucuucugucucagccuccugaauagcugggauuacaggcacguaucaccacaccuggcuaauuguuguauuuuuaguagagauggguuuucaccauguuggccaggcuggccuccaagucuugaccuccuuggccaagugaucugcccuccucggccucccaaaguguugggauuacaggcgugagccacugcacccggccagcaguuugguuuuuaacaucuuuauuuuguggaaaaaguggauacaucagaggagacaguaauuuuuauauaggcaaaggggcuuugguuuguagcaguuugauugaugauguugggggaaguacuuuguauuacuccagaguaguucuugauugucauuagaguaucaggcuacugaguaagacauggaagaaaagucuuaauaggaccaucacaaagucugucacuuguuuaugaagugauuuagcaugagguaauagaacaauggauugggaagaauuucuagguuauaauuucgguguaguugcuaacauuaugacuuuaugcaaaccacucagucucuuaaggguuggcgcucccaauuugcuucuugcuuuaauauucugugauucugugcguagucuguaauugcuguuuaauguaguacagguugcagaaauguuuggaaguaccucaagcuaguuuuaguuuuuacucuuuucccaucaagucaacucuuuaccaccuuagauuuuucuccacuaagaacacaaacaaaugucacuucuaguggcugcaccuucuaaaauuaagugaaguagguguuucaguauguaauuuuucuguuuugugucuucuuuuauaggacuuuguaucuuugcuaaagucagugaugugaaaagacuugaaauggguaagacuaacuagcuguugaauccuuuuagcuacuuucauugguuaagcuguagugaaagaauggguuuuccuaacauuuucaguauuuguaucuuugugcuuaauaauaauuuuaagagaaauuuuaauccuaauuauguaauacuauauaccaaacaaaauuauuauuauugcuauuuuugaaacguagucuugcucugucacccaggcuggagugcaguagcacaaucucagcucacugcaaccucugucuccuggguucaagcaauucuccugccucagccucccaaguagcugggauuacaggcaugugccaccacguccggcugauuuucguauuuuuaguagagacgggguuucgccauguuggccaggcuggucucaaaccccugaccucaggugaucggcccaccucagccucucaaagugcugggauuacaggcaugagccaccgcacccagcccacauaauuaucuuuugguuagaacauuguuuauaugcucauuuaggaguauuaucucauugauuguauugaaaaaguuaaguauacccuagcaaacauuuacuguguacuagacccuguucuaaguauuuaaaauauauugguucauuuaauccuuauaaccaucuuacaaggguaccuaauaguaccuaccaaguagguuacuguuguuaucccuauuauaucacaaggaaacugagacacagaaguuaagaagcucgccuagagucauguacuauaacuggcugagccaggauuuaaaccuaggcacucugguucuagaguuuucuagaguucucguucuuuuuuuuuuuuucucuuuuuucuuuugagacggagucucgcucugucacccaggcuggaguguagugguaugaucucagcucacugcaaccucugccuccuggguucaagcaaucccccugucucagccucccagguagcugggauuacaaacaugcgugcgccgccaaguccggcuaauuuuuguauuuucgguagagaugggguuucgccauguuggccaggcuggucuugaacuccugaccucacgugauccgccugccuuggccucccacagugcugagauuacaggggugagccacugcgcccagccaagaguucuuguuccuuaguacuauguuauacuacuucuaaaugauaaauaauuugauuaauguaaauauucuauuucauuuagcuaguguuacugagaauugugguuaggacauuuuucacuauuucauuuguaguacuuuaugucuguuaaggggaucaauauaaggucaggacuaguagcuaauuuaggaauaaguugaaaaaucuauacacuuaggucuuauaacaucccauauguuccuuuuacauucacauuagcuuucucucuauucuguguuuuccuuuuccuuagucugccuucuccuucccuguucauuuguuuccauuuucucucauugcugauagcaguguaagucguugaauucuguuacguuuauugcuucuauucuagcucuucuauaguaacaaagguaucaaaaaugguucugaaguaaaauucugccauaauauuauaguuauugagcugauaccuguuaagagcaauaugaauaaaauuaugcuuuuaaaaaaauguucaggcagauuauuauuauuauuagagacagggucucacucucuugccuaggcuggagugcagugguguuaucuuggcucacuccauccucugccuuggguucaagcgauucucaugcuucagccuccaaguagcuaggauuacaggcaugugccacuaugccugguguauuuuuaguagagaugggguuuugccauguuagccaggcuggucucaaacuccuggccucaaguaagugauccgcccaccucagccucccagagugcugggauuacaggugugagccaccacaccuggcagguggauuacuucuuaaagcacuucuuuguguuaaaacaggaaaugaaccaguguuaacaguguguguuacugaauggugaauuuuuucccccaauuuuuuuauauuuaaaauuuuuucuauaguuaaaauauuuaaaaaguuucuuuugggagcauuuuuguuuuuuguuuguguuuuucuuuguuguuguuguuguuguuuucugagacagggucucacucugucacccaggcuggagugcagugacucugucauggcucacugcagccuugaccuccccgggcucagaguauccuuccaggucggccuccugaguagcugggacuacaggcaugcaccaccaugucuggcuaauguuuuguuuuguuuuuuaauagagacaagauuuugccuuauuucccaggcuggucucgaacuccugggcucaagccauucgucugccucagccucccaaagugcuaguauuacaggugugagccaccuugccuggucucguuauuuuuaaagcuuuaaauuaagcuguuuuuauauguguacaaguuuugaacuguuugguagauggccucaauuaauuccaaaugagccaauuucugcacauggaccucuuuugacaaugacaauaugagauuuuugccauugguuagcuaugaaagagggauuuuauuuuauugcagaguuguucuucaaguucuuuuuugucuuuuuuuauuauuauuguuagacauagggucucccucugucccccaggcuggagugcaguggugugaugauagcucacuguaaauuugaacucaugggcucaaaacaguccuccugccucagcuucccaagugguugaggcuacagacacgugccacauuggcuggcuaacuuuuuuuuuuuuuuuuugagauggaguuuugcucuuguugcccaggcuggagugcaguggcacgaucuuggcccacugcaaccucugccucccagggucaagcaauucuccugccucagccucccgaguagcugggauuacagguacccgccaccaugccuggcuaauuuuuguauuucugguagagacaggguuucaccauguuggccaggcuggucuugaacuccugaccccgugauccacccgccucaaccucccaaagugcugggauuacaggugugagccaccacaccugaccugcuggcuaauuuuuaaauuuuuuuguagagacagggucuuacuauguugccuagauagaucuugaacuuuuggccucaaaaaaauccuccugccucagccucucagagugcugggauuacaggcaugagacaccaugccugggugggaauuguuuuuauuaggugaaaagauugguucauaggaaaaacguuauugaagaauuaugugacuugaacuaauccagacugucuccccagaugauauugcugauaggaugaggauggaugcuggagaagugacuuuagugaaccacaacuccguauucaaaacccaccuccugccacaaacagguuuuccagaggaccagcuuucgcuuucugaccagcagguuaggagcaauuuucuuccuuuaauuaauuaauuauuugggcucaucauaaguuuucaucuuauguaguuuaaaugccacacucaaaaauacaagcauagcuauaaacuuuuuagaaucaguaauuuuaguguuuggaauucugcucuauauauuaaaauuaagacaaggacguuaagacaaaauaggcuauguaugaguucuuugagaacaguacguuuuagaaaacucauuguuccucugaauuuuaaaauuacuuauaugcagaucaguguucuuuuaaacuagcaccuaaaauugcugagcauuaaaugggggagaaaugugaaaauauacagcagcucuaagaugucugugcuauaaugccugauuucucaaggucuaguucgggaccagcagcaucaacauuacuugggagcuugauagaaaugcagacucucaggcuuuaccucauaucacugaaucagaauuuauauuuuaaaaacauccucauuugauuuauaugcacaugaaaguguggggagcacuauuaagcagucuuuuucaauaggaaagccauuaguaauuuggaugagaucauucuuugaugugugaaucuuuccuaauuauaguaggauguuuagcauccaugagcccuaggcacuaaauuccuguaacauccaccuccccccauaaucauuuuaauaguuaauauauauccacacauuuccagauauguacucaggguauagcaccaccucugauuaagagcuaucucuguaaaguuaucaaaagaaccaaaaccagauugauuuuucucaaccuuuuuaauauguguuauaaauggcuuucagacaggauguacuaaauacauauuuaccuucuagugaacauucuuugaauuaaauuguauaacaaauauuuugccuguuuuuuuccuugaagccugaauuauuucauuagauugucuauguguuuuccuuucuuguuaguauguaguauuaauacguauaauauauaaauauaauuauauugaguucugaaauagucuuaguucugcuauagucuuuauuuagagacggggucucuccauguuguccauugcuagucuugaaguccuggguucaagugauucuucugccucggcuuugcaaagugcugagauuauaggcaugagccacugcaccuggcuuauagucuuguuuaauuauauauuuuuccuaguauauguuuuuauuuuauuguuaaaaaagugacauggccgggcgcgguggcucacgccuguaaucccagcauuuugggaggccgaggugggcggaucaccugaggucaggaguucaagaccagccuggccaacauggugaaaccccgucucuacuaaaaauacaaaaauuagccaggugugauggcgcgugccuguaaucccagcuacucaggaggcugaggcaggagaaucacuugaacucaggaggcggagguugcagugagcagagauugugccgguguacuccagccugggcaacaagagugagacugucucaaaaaaaaaaaaaaugugacuuaagaaaaaucuucugcuuuguuuagauuuuaucuuccaggcaaggacauuuggaccgaucuuuuacauguuccacaagaagugcagcuuauaauccaagcuauuacucagguaugacacauuacuuggagucaagggacuuuauaccuuuuggauuucuugauagcauaucguuuauguuuaucaucuccaaaaguaaaaacauugucaaaaacaagaugguauuuucuucacuaaaacaucauuugaauggcuuuuccuguguaugugguugcuaugauacuuuacugauuuugucucauccaaauacugguuuucuagugggaaaguguuuugagaaucuaacuguccauuaugccauuguaaaaagcaauacaacuuuguuuuugaccuuuuuuugggaauauguguaugugauguguguaaaggguguuuguuuugcguuaauuuaaaucacagagcaaguuuauuucuguucugcuugaaaccaugaaaccugaaaauuuauuucuuccugagcuuguccuucuuucagggcaggaaauguuaacuacauguuucugucuagcaccugccacagccauaugcuugcauauucaagggcuuuucuauuuaacuugugauccaugacagaagucagcauucucuaggcuguucuuauccugugaccugccugacuuaucuaucaucugcccucuuacuaggguuuggacuuccaagggucuucugccccugccuugagaaacuaagaguuuuguugguuagccucuuggcuguaggacucagaaagauuacaguagucuucccaggucuuuuuacuccucaugcuucagucuccuugccuuaccacaauaugggaauaccaguuauaccauugaaacugccucaacaggaauuuuuuuuuuuuuuuuuuuuuuugacacagagucucccuguguugcccaggcugaagugcaguggugugaucucagcucacugcaaccucugccuccuagguucaagcaauucuccugccuuaaccucccuaguagcugggauugcagacacccaccaccacgcccggcuaaauuuuguaauuuuaguagagacgggguuucaccauguuggccaggcugguccgaacucuuaaccucaagugauccgccuggcucccccucccaaagugcugggauuacagguguaagccgcugcaccuggcuggauuuuuauaaggauaaauugggaugauaaauauggaaugcagauaauaauuauucuuguuauuuggcuuccuuaggauucuuugucagcaagaugagaucuccucccuaaaaagacguuaguaggaugcucuuuuagauucauacuauauuuaaaugugauuuaggugggugauacuuuaucugcccugggcacuggacuuccauaguaugugcauaauuuguauagaaaaaucaaucaauuuucucaaaacguaacucuacuaccauuauuauugagaaggcuuuuugaugaacagagucugaaaucugguuugauaggucaauauuaaugguggaggaacaguugaaugguuaaugaaauuagaucaucaguauuuccauuugaacucaggcuauguuugcuuauaauuucauaugccaauuuaccauuggauagaaucucugcuuuaaguuaaaaacaauuacuuaauaauaaaguuauauagaaaauucuacucaaaguucccuucucauaacccaauucuaauguuuuauuucuaauuuauuuuuaauuauuauuauuauuauuuuuugagauggagucucgcucugucacccaggcuagaguguaauggcgcgaucuugacucacugcaaccuccgccuccuggguucaagcaauucaccugccucagccucccgaguagcuaggauuacagcugccugccaccaugcccggcuaauuuuuguacuuuuaguagagaugggguuucgccauguuggccagguuguucucgaacuccugaccuuaggugauucaccugccucggccucccagagugcugggauuacaggcaugagccacugugccuggccuauuuuuaauuuuuuuuugagacagaguuucacucugucacccagguuggaguguggugacauguucauggcucacugcaaccuugaccuccuaggcucaugcgauucuccugcuucagucucccgaguaguugggacuacagguacaugccaccaugccuggcuaauguuuugaaaaauuauuuauagaggugagggucuugcuguauugcacagacuggucucaaacuccugggcucaagugauucuucugccuaggccucccaaggugcugagauuacaggugugagccacugcaccccaucucauucaacucuuauuuaacucaagucucugugaucucuuccgauuaucuguguguacauaccucauacacauugcaugauuugacacauguaaucuuuuuuaacucaguauuuuuauuuuaauuuuuuuugagacagggucucacucuguugcccaggcuggagugcaguggcacaaugacagcucacugcaaccugcaccuccuggcugugauccucccaccucagcccccugaguagcugggacuaccagugcaugccagcaugccuagcuaauuuuugcauuuuuugguagagacggaguuucgccauguuguccaggcuaauaguuauaguuuuucaugugucaacauguucuuuuuuuuuuuuuuuuaucauuuucugcucauuucuaauucauggaauugauacgcacauccacagucccuuaugugcaauuccaaaauccaaaaaccucugaaaaccaaaauuuuuuuucacaucucauuuggcuucaaaaccugaccugaggcugggugcgauggcucaggccuguaaucucaacacuuugggaggccaaggcggguggaucaccggaggucaggcauucgagaccagccuggccaacaugguaaaacccugucucuacuaaaaacacaaaaauuagcaggguguguuggaggacaccuguaaucccagcuacuugggaagcugaggcagaagaaucgcuugaacccaggagguggagguugcagugagcggagaucgcgccacugcacuccauccugggcgacacagugagacuccauuuccaaaaaaaaaaaaaaaaaaaaccucaccugaauucauuccuuggcaaaaccuacuugaacugacaugaagcuguuuauauuuuuucuuuuuuaaaaucucuguaaaaaugaguauuuucacauuuugcuguagauaacauguuugauuacagagugcucuuacagauuauacuugaaaguguuaccuaauaugucagguuaucuuucuaaaauuccaaaaauuuaaaauuuggauauagaacuggacucaagcauuugauuugggauaaugggugugugccuucauuugcuucauuauuuucccuaugguuuaggugcacauuuacccuuaccauuuucagcuauuguuaauaacaugacuuaaaagcauugguauauagagcuuuuuuucuccuaaguuuuaguaaacccuugauauucacaaagaauauaucuaagauuaucuuaaguccuaauguaauauuuggccagauuccuuggcuuucuacucaguuacguaauuguugagaauuacauuuuucuuauguuuauccucauaccacaaguugauucccauaucaacagucuuacacuaaaagcuucaucucucacuugaguaccuuuuuuuuggagaagaaaauaauuauaacaguuacuauauauauggugaugauuagagaauaacaauaguaaauaauaaagucauacugaaaugggaugcuaaauuacagcuugaagcagaggacucaaauuugugccuuuaacaaaucucaucuagucccugaucaaacaagcuuauggcaugucacagacaucaaaggucccuuucuaaaaaucaggaauuuaaaucugugaacgucaguggucuauauauauuuuuuucuuauaaugaagucuuuaauuaaaaccuacuuuuuacuauggacuuuaaaaaaacuucuuccucuuuccacacucauuccaauuaugcucucuccuuuggauauauucuuuucugauaauccccacaucgauugcaguggucaucacuuugugccuuaccucuugauugggcuagacacggacccucaguuuaccugccuuuaucugcugauccugacuuuauugguauuugucuucucucucacccugcuguccccuccuucaccaggaugaaaaugagcagcaaggcccaaacuuuaggaucuaggaucuggaacuucuccuuuauuacuuuauuggauugacuucucuagaucaagcuuuuuaaaaaucugccucucaauccacuuaagauuagaguauuuaaaacauugauuuuuuuaaaaaauaaaauuuuaaaaacuuuuuuacaguuuacuuuguuacagcaaaacuuuacacgccuguaauccuagcacuuugggaggccaaggcgggagugucaccugagcccaagaguuugagaccagcccaggcaacguacugagacccugucucuacaaaaaauaaaaauaaauuaccuggacaugguaacguguacauguagucccagcuacugaggaagcugaggugggagcaucucuugagccugggaggucaaggcugcagugagccaugauggugccacuguacuccagcauggggacagagggagacccugucucaagaaaaaaaaauguuuaacccuaaacagagaaaagugggaugaaaagaagugauuuugcuugugcuuagaaucauuaucaaugucuucucuuuggaaaauauguuacauuagguuaccagaaugauacuugguagguaauauuauuuaaacauccugcuauuauuuuaacuaaaguuaacaggaacaacugguaguacuuacuuucauaguaaguaguuagcugacacauucuuuuuuuuuuuuuuggagacagaaucucgcucugucgcccaggcuggagugcaguggcacgaucuuggcucacagcaaccucugccucccggguucaagugauucuuaugccucagccucccuaguaacugggacgacagacgugugccaccacgccuggcuaauuuuuuguauuuuuaguagagacggguuucaccauacuggcuaggcugguguugaacuccuggccugaggugauccaccugccuccgccucccaaaguguugggauuacaggcgugagcuaccacacccagucuugacacauucuuuuuuaauaugaaguuuauuauauucauaaaaguauugcuugucccugcagaaaauuuguguagaaaaguagaaaaauacccaucacucuaucauuagaacauaaccacaauuaaauuuuugguguauuuucuccuaguuuuguguguauguauguacacauaauagguaaucuuuuuugugguguucguaacucugauuucucacagaaaucaguggugacagacuaucauguuaaacucucacuauauguggccaggcacaguggcucacuuguauuaucucaguacuuugccguugggagacccagguggaaguaucaccuaaggccaggaguucgauuccagccugggcaacacagugaaacccucccucuccaaaacaauagaaaaauuaggcauguaugaugguaugcaccugugaucccagcuacuugggagacugaggcaaggagauugcuugagcuuaggaguucgaggcugcagugagcuaucauugugccacuacacuccagccugggcaacagagugagacccugccucaaaaacaaacaaacaaaaacaguaucuguaguuuccucuuggucugucucuagcuuuguuugaucccaucagcaauagaacaccauucagcaauuucauugggauuggaaccaccuuuuucuguuuaaacagacugccugaucuucugcuuuuccccuugcauuuuaaagcugcagucucugucacaugccguugagaaugcuacucugacuuauccuuggucucaaauuucacaccuguuaggguaauuugcauuuuugacagaccgaugccucagauagauaucuguauuuagaucaugcccuaaucaaauuuuagccaaaaugugugagagacaaauauuucuacuguuacaacuuuaaacuuaaguauaauaauuuucuaguucuuuacuaagacucauuuucauuagcaucauguuucuauccucaaaauuauaguaauagaugcuaagcauagauacugauuacaaaggaacaaaguuacaauucauuuugaaaguaaauuagcuuauuuuaauuaucagacuaaggucaccaacuguugaauuaacaagugcuaauaccagccaugacuucuucuuuuuuccuauuuacccuaaauccugacaucuugauuagcuuacagaagcacaaaauuauauuuuggaaggcugccuauuuggauagagcaugaaaagauacauuaaauacuuuuaauagcauaaauuuacaauauugcgaaaaguucuauaguaauauguuuuaaaagaauaucuucaaaauaaugucagcauuagaaaaaaauuccagaaauagagaauuauuauucuuguguuuucacuggagcuccuuagaguuccauaacuuaaugucugaaguuauuuugagggagcuguuuuaaauuguccaauucugcagauagggagaggagguuauagaaauuauucuaccacuccuagcugaaacuucaggagguuuuugauaugccagauuguaauccacaaguuagaaaauucaaauaauaaguaauucucaguuaaucugauuguaguagcaaacauuggaguaauaauauguuugauuauggcauuagaugacugaagauuauuauaccagaaccagauauauaugaugggucauuccuugccauaagccaaccagaauaagcagcaauuagguuaucucugcucuuugagagaguaccugagucuugaacaugguaacuaaaacgaagaaagugacacuagcugcuuaguaaucaauaacuguuguucauuugaauuacaauucucacuggccccccaccugcuuucuuacuggucuggccuaccuucuuucaggcccaggccugggagugcuugcaagauauaguugggguaaaauguugacuuuugguggacaccacggagucacauugaugcagauaaggcacauggcuguggcaggauucagcuccuucaucaauuuucagguuaguauggcugaaucaauuauaguuuguagaaguuccccuacugcagacuuuacuggcaguugagacugggaucuuucuuccaugagagaaauggugacaugccacauuacuuuggaauacaaugguuggucaugguugcagucauaaggagaaccaccuguagaauuuguuuaauuuauucaaacuuuuauuuuuuuagauaauccuuccucagacaguuuucuuggcucaggcgauuuaagaaccuuuggccagagugcaaauggccaauggagaaauucuaccccaucgucaagcucaucuuuacaaaaaucaagaaacagccgaagucuuuaccucgaaacccgaaagaccucaagguucguauuuugucaucuuaguucucaagcccuuccucagacauaagagaaagugacuaaaagguagauaguuauuacauugggauuuuaaaagaguaacaccauuuuuggacuuuaaaccuuaaggauaugaacaaauccauuuuacauuuucaacuucucauuuacuuagugcugaauuuugaugauagccagaucuuacuagaagagagaauuuuaaguaaaucuugguggauaugagaauauugggagccuucaagaucaauauggcucuugcaaaucuuaaagugaaaaucagucaaucuccacaauuugagcaggaaagaaacauauuuuacagcuaucaagugagcagagaccugacuuaaacuaaagcaguucucuaccucauggcauuagucaaguagaccaagcuacuucuauauauuagaaaauaaagagucacagaccgggcacggugacucgugccuguaaucuuagcaauuugggaggcugaagcagguggaucaccugaggucaggaguuccagacuagccuggccaacauggugaaacccugucuccacuaaaaauacaaaaaaauuagccaggcaugguggugugugccuguagucccagcuacuugagaggcugaggcaggagaaucacuugaaccugggaggcagagguugcagugagcugagaucaugcugcuauagcuccagccugggugacagagugaccucgucucagaaaaaaaaaaaaagauagucacagagaacuuuaugcuaguuauuccaacuuuauaagcucuaucuaacaaaacuuacauggauuauuaaaggcagaugaaaucuggcuuagaaacuuuucccucagauauuuuguuauauuaguauuuauuauauuaguaaacauuucuuuuuuaaaauaguauuuaugacuacuuaaauucugcccugguauauuuuaggaaugugggauuauuuaguguacuguuuagucaaguuugagcuuuaugguguugauagaagccaacaagauggcuuuuauuauuuuaugcacauggacuccaggaaugugucaauacucccugggaucauguuccucacuuaacuuuuaaaaaauuauacaguaauucacucauacacucacauuguagaaaucaacacauuaccagcaaagcugaagaucccuugaccacuacccacaaucccaaucccuuuuccuugguguguuuccuuccaaaccuuuuccuauaccuauuucucucuuacucuuucuuacucauauauaguaugauauauauguuguguauacuauuaaauguaugauauuauuuugucuucauuaaagauuuucuauaugcaucauuuagcagguggcuuuuuuaaugcaauaaagccaugcuguuauuuuaaaaaaauguuauuacagaaguaguacaaauacuuugggaaaguuuagaaaauauaguuaagaaaaauaaaaaauaaaaacaucacauugccaccagccugagaucaacucuguaauaucuuaguacauauccuucuacauacuuuucucuacuuuuuuuccaaaaugaguuuauaguauacauauucuuuuguaaauuuuguuuuauacccuaagucauauuuaaauuuucucaguugacccaaaaguaucuuuuauaguuaguuuaguuuugcaucuggaaguuauuggcuuugucacuuauaacuagaacagccuuuuuuuguuuuguuuuguuuuguuuuguuuuguuuuuuuguuuuguugagacggagccuugcucugucggccaggcuggaaugcaguggugugaucucggcucacugcaaccuccgccucccagguucaagcaauucuccugccucagccuuccgaguagcugggacuacaggugcccgccaccauguccugcuaauuuuuguauuuuuaguagagacggcauuucgccauauuagcaaggcuagucucgaacuccagaccuugugaucugccuuccuuggccucccgaucccuuccugggauuauaggcaugagccaccaugcccagccucagccuccuuuuuuuaaaugacaugacuuuucuguauaauguucuacuuuuuggauuuggcagguugcuuccucgugguaucauuauuuugucaaaaaaucaccuguauuuuuuauaagcuagguuuuagaugugacuaaaaggugugcugcauuuaucacauuugaaaaacaaacaguaucuuguuuugguucuccuauuauucaugaugcuagacugaccucuggauugaggaacugacagucuggugguuaauuguacaguuagguuuuuucccgugugacuugaauguaaucuaaauaauguuacuuuggcguuauaugaaugaugaauuucacaucagccaucaccuaauaauuaauaucauuugcuaauaccugauaauaguuuuauuagaguuaaugaaauaauauuuuucuaauuuuaucacuuuuacacuucuuaauuggcauucugauugcauuuuuccuuagcuggggcuauuagagucccugaaauguguuuccuaugggaaaggccugauacaugauuagauuuuucuuuuucauuaccaguuuucaaagcaagguuuuuguaaaauagacacuucauauguuucaaaugaauuugucuguuccuuuuuuagugucauuauggauucaguauuuuguaauccacuauaauuguuauacuuuuaaugcucacauucucagaaauuuggcuaguggaagcccuuuaagcuugcuucugucuguuugaccuuaacucaugaauuuuggguaacacccuugcuuucugucauugcaggaugcccuuguacuguuucuuuagaagaguaaucuuuuauguuaaaaaaaacaugcauaggcgcacgcauacucugggaaacacaaauacagaagacauuguggagaauccaucaugucuuuaccaaacaauugcacugcccuugccaucuuuuccuagcugcauccacucauccuaagaaaauaagccuguuccuaaaauucuaaguccuugcucauuuccccauucuuuuuuuuuuuuuuuuuuuuuuuuugagagaagcaagaauaugacuguaauuuaacaucaacaaugacacuguguaacagcacagggaagagguaguggagagagauggucaggcuuccuguuccuuaaccagccuugauuuuaacagcagagccccagcaaccuagaagcgccucaccuagccucuuaauggagugggaaggggcagggacuuggaaauuagaggcucaaaauguaaagaaggcugauggcaagccuggggagaggccugagaaugagggaagggcugagggcugugaggaguccucacacaaagacccuagcacaggucuucggcagugaacaugccccuggcccuccgcaggguggaguccuuggcguccucauaugggugcuccuuggaggggaucuccaggacaguagggauagagugcugguggguguccagggcaugcugcaccaucucugcgauguacugguugaugaggaugaugccagugucaucccgguuuagaaauugccggaaagugucuucgaucucauugauggucguauccuucuccaccaccaggaaauugggguggcaguucuuguuaagcuccccuaugcugcccagcaggaaaccagucaccguguccuugucucugaucacugcgaugagcuuccuucuccccgccaucccugcagccaggcagagcucaccccagagcaccagaagccacucucauuuccccauucuuaacacacguacaaacccaagaagacuuaaagagaauuaugcacuguuugauuuucuuuagaucuugucugauuuggauucagaccacauguaaugauuuuaaagaguugauuucauugaauuuagaauauucagcuguguuucucuagucugagucuugaagaaaaaagaaaauguauuaugcuaagaauaaguaccucaaacuuuccagguaaugauaaaugagaaagagcacauagaaaaaacucaaaauuggcugggugcuguggcucacauguguaaucccagcacuuugggaagcugaggccggcggauuaccugaggucaggaguucaagaucagccuagcuaacauggugaaacccugucucuacaaaaauacaaaaaucaccuggguguggcggcgggugccuguaaucccagcuauucgggaggcugaggcgggagaaucacuugaaccugggagguggagguugcugugagccaaggucgugccacugccuccagucugagugacagagcaagauuccaucucaaaaaaaaaaaaaaaaaaaacucaaaauuaguaagccuuagauauaagacaggguuuuugaguucacaauauucuucuugccaauuugccaauuuuucccauuagauaguauaaagagacaaaaaauucuucagaggaaguaaauaggccagaaggagaauuuaaugacgcagccuaauaguuguuuuuaaugaaggaugggagcccucuguuggucuuuaaggaaauuuaaaaauucaguuuaaaagcuuaguugagaggcuucagccuuuaugcauuuuuacauauuuaaucuuaauuuccuccaacaggcuggguacaagggguacagggaauaauagaaaauguauguguuguuagcauaccuggaacccagguuuuuugaagacaucuaaucuguuaugcuuugucauaccacaaaacuauaugguuucugaccaaaauaaauucuagauuguggaucuaaaaaugcaguuuuaaguguuugauaauuuugacaauguaagaucuuuuaaguggcagaaccugaugcagcauccuuauauaucauuuauucauuuauuguaucuuucccucaaaugggaaaccuauuauuuuaccuguuuuguuugguugguuuuauauuuugaaagugaaaauaaucucuagguuggauuuauuuuacuuauuaucuguucuuaucuuucuuacaaacucuuuuuuuaguggauuaucaaacaguuuugcgggaaagucaaaccaucacugccauguaucugcauaugaaaaaucuuuuccuauuaaaccuguuccaaguccaucuuggagugguucaugucgucgaagucuuuugagccccaagaaaacucagaggcgacauguuaguacagcagaagagguaaggaaaacgugugacaaaagcuacuaaaaguuaggaucuuucccuacauugagccauuugcucccuauuaauaauuaguuguuuaagaaccauucuauuuuauccuuccugugcuuuuucugucugaauuacucuuuuugaguguuaucaucuauucuaaagagauuaaagagguguuuuagcaggacuucauuauuugucuuacuauuauaucuucuaugccugcuggacagcugacuuuacuuaaucuuuaauguugccugaaugguuucucauacaucaaaguaucucucuuugaucuuugcuagacccuuccuaaaccguugucuccuauggaaaaauuguuacucuuccuccguaguuuuugauaaaauuuuauuucaguccacgugacguggcucaugccuaugaucccagcacagugggaggccaagacagguggaucacuugagcccaggaguucgagacgagccugggcaacauggagaaacccugucucuacaaaaaauauaaaaauuagacgggcuugguggcucauaucuguacuccuagcuacuggcgaggcugaggugggaggauugcuugagcccaggaggucgaggcugcacucgacuugcuuugugucacugcacugcagccugggcaucagagugagacccaucucaaaaaaaaauuguuuuuuuaauuugaugaaauaccuauucuucuuaccaggaacaauuuuucuucaauauaagagaaaaaucaaaaagcuaguuaaacaauauacauccuuucauuaugaguaagaccuuuuuugaaguuacagacuccugaaaagaaagauguucuguugacacuuggguuguuauauuaauucaguaaaccuaaaagaaaaagccaauuuugugaauguaauguagcauauaauuugcaugauaggaugugugcacauaucuguuagauuacauauuuaauguacgucuaaugcugugguugcuuggagauacaaaugaauaauaauuaccuugcauuuaaauagcauuagagcuuccaguguacuuuccacguguauuauuguuuuuaauccuuuuaacucagcaaaauagguagagaugagguaauagucauguuuuacagauuaggaaaauaagggucauaggucacaugacuaguaaauggcaggccuagaacccagaacuucugaagagguuuggucaaguaugcuuucuguuauacaacacagcaauaugguuccugcccaaugaagcuuacugagcauggagucaagaauacagcauuaccugcuaaauaauuacauaauuugguaaucagugaucucuuagguggcaaaacuugauuauuugugauaugguuacuaaaaaugcugugcauauuuuugguuuaaaguuuguauugaggccgggcaugguggcucaugccuguaaucccagcacuuugggaggcugagacgggcggaucacgaggucaggagaugaagaccauccuggcuaauacagugaaacccugucucuacuaaaaauacaaaaaauuagccaggcgugguggcgggcgccuguaaguccuagcuacucgggaggcugaggcaggagaauggcgugaacccaggaggcagagcuugcagugagccgaaaucgcgccacugcacuccagccugggugacagagugagaagccgucucaacaacaacaacaaaaaaaguuuguauugaaucuaaaacauuuggcugggcaugguggcucauguacaaucccagcacuuugggaagcaaaagcaggaggauugcuugaggccaggaguuugagaccagccuaggcaacauagugagauccugucucuacaaaaaaaaauuagcugggugugguggcagguggcuguaguuccaccuacucaggaggcugaagcaggaagaucguuugagcccaggauuucaaggcuacggucagcugugauugugccacugcacugcagccugggugacagagcaagacacugucucaaaaaaaaaaaaaaaaaacgaaaaaacaccaacauucaaguggaggguggcagaacuaguaagucauuuagcagggcaagggauagacaagaaacuggcaacauuugccuuugaugacaaagcuggacaacaaugaugaaaaggagauuuuuuuuaacaaaaaaauuuuuuuugacauuacacaaauuuucaugucaucguuguacaggggccaugcuaaucuucucuauauaguuccagucuuaguauaugugcuccuaaagugagcccaagauuuauuuuucauuauaccuuuuaugcuauugaauuuuauauuauauuuacauuauuuuaugcauaaauaauuacuggaguugugggguuuaugauuaugcuggauucuagacagccuaaggggugcagagagacuuuguggaggagacaacagcagcaugacagcuggguacagggcuccuaacccucgccugccccauguuucuguugcucaggcucaccaggauccuuuaauucuguguucauuguaaguuugccauucacccaccagcucuguggaccacucagccuuccuucuuuugccuccucugccagccugaggacuggggguugcuugggcaauuuuacccuuccaaacagcccuccaggccacagguugggucaguggagaacaugaagguggaguucuccuuccuccuguagugcaaagaagaugcuaagaaucuauucuaugaaaugagcgaugcgggaaauuuugccuguuuuuaguucuauauucuccuaauaugaaagucaagcuaccuguacuacuauauggcuuacagaauaagccauauaacaugaauaauacaaaauauugggccaaacuuuauuaucagacuuucaacaaauuuauuuagauguuuauuuuuggauauuacaaauaauucggauauaauacuuuuuaacccugggacuaaauuuacugaugggaacuuacaaacuggaugaaaagucacuuuccgugaaacguugggauccucagcagagguacauuugguuauguuaaaggaagauguauuaaccuuaaugccggauuuguccaucaacuucaggaauaugaagucuucuacaaaauuaacaauuaagaugaugucaccacugcacugcucagucuuacaacagagguuugaagagaacacaugaagaagaauuuagaaauaugcaaguaguggcugugcagaauggcugaugcucaagaggcaacaucaaaaagcugugcuauucaguaggguaacggcuagccacaagcacuguuuaaauuaauucaaauucaaauugaaaauuuaguuacucagugacacuagccacauuuuaaguauucauuagccacauguggcuaguggcuaccauauuggacagggcaaauauagaacauuucuauuacuacagaaauuucuguuagauaaugcuguuauagaggauauaaaguucuguuuggaaaagagaaaauacuugugacaauaaaaauguaaaauggcaaaaacacagguaguuucuuuucaguuacauguugcuucuagacacgcuucuuugcaaauuauugagcaacauuuuaagauacuggacuuuuguaauaggugacagugaugguuuuauacuuuucuuagaacugcuuuacaguguugucauaagucaagcauuugggacucagaaaauuauugaaauuugcacuuugcauauuuuauaugguauaaaguuauuacuuuaaacaaaaugaaaauuaggaguauuauuuauaaaguuauuggugguaauuuauaaaaaaacaguuuacuaguguccuaaaaauuauuuugugcucucuauuaaaguuuuauaauuuuauaguucuuuuaugauggagccuuuuauagaaacaucaccuaacuacaggacucugucccuuuuaaaaaauauaauucagcaccuuaauuaauuauuuuuauacuucaaaacacucgucuuaggguuuuuucagguuuuaaaacguaacauuagcuagcuucuuuaacuuuaucaugcuaugcaauuauugcuuccuuuacucuuaagauccuaauuuucuuuuuuuauuugagacggagucuuguucucuugccccagcuggagugcaguggcgcgaucucggcucacugcaaccuccgucucccggguucaagcaauucuccugccucagccuccugaguagcugggacuacaggcgggcagcaccgugccgggcuaauuuuuuguauuuucaguagagacggaguuucaccauguuagccaggauggucucgaucuacugacuucaugauccaccugccucggccucccaaagugcugguauuacaggcuugagccaccgugcccagccccuaauuuucuuauucaguaaagaacaguuagggcuuucuuuaauuuuaauuuuuuuuuuaauuuuaugaaauagagucucagugugucacccaggcuggaaugcaguggcgcaaucacagcucacugccgccucaacuuccuggcucaagugauacucccucuuuugccuucugaguagcugcaacuacaggcacaugcuaauaugcagcuaauuuuuaaacauuuuuuguguagagacagggucucacuuuguugcccaggcuggucucaaacuccuaggcucaagugauccucugccuuggcuucccaaagaguuggaauuauaggagugagccacuguguuuaacaacaacaacaacaaaaacaguuuaacaaguaauuuacagagaaagauguuuucuuuuacugauaguaccagaugguccaaaaaagaauuuuguuuaaaguuuuauuuagguaacuuucauuuuggcaaagccaaaaaaguuacauguguucuuuugggaaaggaagaaauaagauugucaguuagcugggcgugguggcgggugccuguaaucccagcuacucaggaggcugaggcaggagaauugcuugaacccgggaggcggagguugcagugagccaagaucgcgccacugcacuccagucugggcgacagagcaagacucugucucaaaaaaaaaagaaauaagauugucacuuuuacugacaacaugaucuuauauauagaaaacccuacagacuccaccaaagaacuguucaaacuauuaaaugaauacaguguauguguaugugugaauauauauguguauauauguguguguauauguauaaguauauauguguauguguguguguguauauauauauguguguguauauauauauauauauaaaauccuacagacuccaccaaaaaacuauuaaaugaauacaguauaguuguaggauacaaaaucaacacacagaaauuaguaguauuucuaugcacuguuaacaaugaacuaugcaaaaaagaagccaagagaacaaucccauuuacaauagcuacaaaaaaccaaucaaauuuaaccaaggaaguaaaagaccuacauacugaaaaacauacaauguugaaagaaauugaagauacaauuaaauggaaagcuauucugugcucauggauuggaagaauuaauauuguuuaaauggccauacuacucaaagcaaucuccagauucagugcaaucccuaucaaaauuccaauguuauuuuucauagaaaaaaauacuaaaauucauaugaccacauaaaucccugaauagccaaggcaauuaugagcagaaagaacaaaaaagaagcuaccacacuagcuuauuucaaacuauacuaccaagcuauaguaauuaaaacagcaugguauuggaaauagacaucagccaaugaaacggaauagagaacuuagaaaugaacccguuaugccugucgugggguggggggaguggggaggaauagcauuaggagauauaccuaauguaaaugaugaguuaaugggugcagcauaccaacguggcacauguauacauauguaacaaaccugcauguuguguacauguacccuagaacuuaaaguaugacgaaaaaaaaagugaacccguuauauagcuaguugacugauuuuugacaaaggugcuaggacuacagaaagggaaaggacagucucuucacuaaaugguguugggaaaauuauauuuccauauguagaagaaugaaauuagguccuuaucucauaccauaugcaaaaaucaacuaaaaauggaauaaagacuuuaagacuagaaacucuaaaacugcuagaagaaaacaggaaaaacuacacgacaguggucuuggcacugauuuuuuuggauuugcacgcaaagucauaggcaacaaaagcagaaguaggcacaugggaguacaucaaacuaaaaagcaaaggaaacaauuaacagugugcagagacaaccuacagauugggagaaaauauuugcauccauucuauaagggguugauauucaaaauauauaaggagcucaacucaauaccaagaaaacaaaacuguuaaaacauaggcaagacauuauccuaggcaaacugaugcagaaacaaaaccaaaugcugcauguucucacuuauaagugggagcuaaacauuggguacaaauggacauaaagaugggaauaguggacacuggggacuacaagaugggaggguggaaggagaccaaguguuaaacuacaaauugguggcugggcgccguggcucacgccuuuaaucccagcacuuugggaggccgaggcaggcagaucacgaggucaggagaucgagaccauuguggccaacauggugaaaccccgucucuacuaaaaauaauaaaaaaaaauggcugggcgugguggcgcacaccuguaguuccagcuacuagggaggcugaagcaggagaauugcuugaaccagggagguggaaguugcagugaguagagaucgugccacugcgcuccagccuggugacagagugagacuccgucucaaaaaagaaaaaaaaaaagcaaaaacuacauauugggugcuguggcucaugccuguaaucccagcacuuugggaggccaaggugggcgcaucacuugagguuaggaguucgagaccagccuggccaacauggugaaacccugucuguacuaaaaauuaaaaaaaaaaaaauuagcucugugugguggcgugcaccuguagucccagcuaguccagaggcugaggcaggagaaucacuugaaccuaggagguggagguugcagugagccgauauggcgcaccugcacuccagccugggcuggucaggagaucgagacuauccuggcuaacauggugaaaccccaucucuacuaaaaacacaaaaaauuagcugggcgugguggcgggcgccuguagucccagcacauaucgaaauaucacaguacgagauggugcuaacacugacauaauguuuaaaauuauguuuugaggauuggugguuguauuaaacuguauauaagauuaaaaauaaauugccagggcauauuacuaagugcuagugaacauagcccauugagucaggggaccuguauagaacugaugcuuuaccagaguuguaaguccuuauguaaucugguucugugucaggugaucucauuucuuccuacucuucugauucacauggaccuuacuauuuuuggaacgcauuaagcaccuuccucucucagggcuuugcauguguuguuccucuauuuggaauauucuuuuauauauuucuaggacugacuucuucccuuggcuuuagguuucugcugaaauaucacuuuuuuuuagagaaaucuuaccuguuccugcugcucuccuuccaucacuuuccauucucuuacccuuuaauuuucugcauacuaccugacugguuuuuuguuugauuccuuucacugcaauauaaucuccacaagggcaggaacuuuauuuuauuugaugcauucauuaucuuuagugacuggagcauaguagguguucaugucaaugaaugaauguuaggaaguauaugguuuucacuaaauguaguauugggucuuacaggaaaaauaaauacauguuggagaugaauauugucucuggaaaguaccugcacuuaaauaaaauaggaaacuguuggcaagauacuccacucugauuuugacuagucugguuacuuccuugugauuuuucuaacagguuucaggagucaagggauuuguuggaauccuaauuuagaggcccuuuuuuucugggacucuuuuuugacucagaagugauuaccugcuggcuuucugguuuuauagccuauaguuccucugcacuauuauuuaaauauauguuccauaauuuuucaaaguauauuaucugguauuuacucaaccugucuuuuacacacuugauaauuuuuguuuuguuuuguuuuguuuuguuuuguuuuguuuuuugagacagagucuugcucugcccccaggcuggaguguaguggcaccaucuuggcucacugcaaccuucgccuuccagguucaagugauuauccugccucagucuccccaguagcugggaccacaggcaugugccacuacagccaguugguuuuuuuuuuuaaguuuucuuuuguagaguuggggucucacuauguugacugggcugguuuugaacuucuagccucaaaugauccuccccgcuuguccucccaaagugcuggaauuacaggcaugagccacuguguuaggcccauaauucuuaauuaucuuaaggauucugccugagcuuuggcagagcuaggauucuguuuacaugcuaguuugagaaauacuugccuuauuggauguguuuaaacuguuuuuuuuuuuuguuuucuuauagacaguucaagaagaagaaagagagauuuacagacagcugcuacagauggucacagggaaacaguuuacuauagccaaacccaccacacauuuuccuuuacaccugugagucacagaagcauauuucagaugaauuuaauucuacaauuuauuacuugauauugaaacaauauucuucucuugcuaggucucgaugucuuaguuccaguaaaaauacuuugaaagacucacuguuuaaaaauggaaacucuugugcaucucagaucauuggcucugauacuucaucaucuggaucugccagcauuuuaacuaaccaggaacagcugucccacaguguauauucccuaucuucuuauaccccagauguugcauuuggauccaaagauucugguacucuucaucauccccaucaucaccacucuguuccacaucagccagauaacuuagcagcuucaaauacacaaucugaagguaaacaugguaucauauaacuacauuuuuaguccuaauagccaauuaacuguucauuagcucauuacaggcaacauuguaauauacauauaaauaaaugagcauaccgaaucugaaaauaugaaguccgaaauguuccaaaaucugaaacuuuuugaauaccaacaugauacucaggaaaugcucaguggagcauuugggauuuuggauguuuggauuugggaugcucaaauuguauaaugcaaauauucaaaaguccaaaaaauccaaaauuugaaacuccuggucccaaccauuuuggauaagggauacugaacuuguaagacauguacuuacauacuuuaaauacauaugauucaguuaaccaugcugugaguaaacuaaauccacaaauaggauauucuuuuuuucuuaccucaagaugcaaaugauuugauacauuuuauuuaaacaacuuccuaaguacaggcuagagucaaaguauauauacucagcccaauugcuucagcacuuucucuguuucuaugacuuuacagugguaaguaagaauucugaaguuguaggaguuuugaaacaucagauaaauacugaagcuuaaguacuuagguuugugcguuuuagaaugauugucagcauuggaagcaaaaaguuuucuacguaacuuucaacuaacugaaauauucacucucuuugcauuccaguuaauuaagguuuugucgugauagguuuguuuccuuaauuucccccuucuuuagguauguauuauguaucaauuuaugguauguacuuagguaugcaacuuaaaacaaguuauagguuaaaugguuaaacaucagggauuuuuugauagauggagcacuagucuuuccccuccuuucucagguuguuugagguuuuuuuuuuaaucuauuuguacuuugugaaaauucucacucaggauuaaacuuuuugguagcaucauuguauagcuacacauauccaugaagacucuuguuauauuuugugaggugauguacugagaacuguaaaggaaaaaaaaaagccaaaaaacccaaacuccuuuaaccucagaaacauacauuguguugcagauacuuagauacaacuaaguugaaacaaauauacuacauugcacuguuuaauuacuuuccuuguaccauguaauaaauacucugagguucuaaugacagcacuuuagaagaacaugauuccugccuuugaguaguauucaacagagaaaauacauaauagaaugauaaaauuuguacuuuuuagacaccuccuggggugcuauuuccuucccugucccccuucccuccuucuuccaguuucuuucccucuuccauucccccaccccuucuuucaccuaauucagucgcauuguagaucaugaacuacaguaguucccccuuaucuguggggggaggauauguuccaagacccgccccccaccaguggaugcuugaaaccauggagaguauacuauauauaccauacccuauauacaucauguuuuuuccuauacauacauacuaaugauuauaaauuaggugcaguaagagaucaacaauaauaacuaauaacaaaaauuauaacaauauacuguaaugaagauguuacuuuuuucuuauuaaaucaaaaacuuuaaccuuuucacuuaaaggaaguaguguuuuuuguuuuuguuuuuguuuuuguuuguuuuugagacugagugucacucuguugcucaggcuggaguacagugggaccaucuugguucacugcaaccucgcauguccuggguucaagcgauucugcugccucagccuccugaguagcugggauuacaggugugagccauuaugcccagcuaauuuuuguauucuuagcagagacagguuucaccauguuggccaggcuggggaagcacuuuuuacggcuucucuuuggcauaccugaauugccaacaucauuacuuuugccuuuuggggacauuauuaaguaaggguuacugaacacaagcacugcuauacugagacagucaauuggaugacugaggugacuacuaaaugacagguggugcauacaacauggauaugcuggacaaagggaugauuucaugccugaaauagagcuggauagagauuuuuaucacauuacuuggaauggcaugcaauuuaaaauuuacuaauuauuucuggaauuuuccauuuaauauauuuggaccgcaguuaacuaugcguaacugaaaccauagaaaccaaaauugcagauagaggacuaccaugaagacuuuuaaggaauccugccauguucuuguucuccugaaacagacaggaagcacagggagcaagugcagccuaggaggaaauucugaagggcaaauauguuuguuauuucccagggauuuucuuauuugugaagcaaauucuucacuaagaccuauuucuguucucagugacaauggacuugccucucucucucucccaucuaaccuuuguucuuauguuauuuuuguggaaauaaaauauagcaaaguaugggaacuuaaacuaagauaucuagaaaguauaacuuuguggaguuuuauuacuaaugaaaugcucuuguguuucuuuaggaucagacucugugauuuuacugaaagugaaagauucccagacuccaacucccagguaaacuuuggaaaaagcuuguucuuuauuaauuaauuaauauaucuuuuugagacggagucucgcucuguugcccaggcuggaguguaguggcgcgaucuugguucacugcaaccuccaccucccugguucaagcaauucuucugccucagccucccgaguagcuaggauuacaggcgcccgccaccacgcccagcuaauuuuuguauuuuuaguagagaugggguuuugcuguguuggccaggcuggucucgaacuccugaccucaagugauccaccugccucggccucccaaagugcugggauuacaggcgugagccaccaugccuggccuaaaaguuucuucuuaacauauuguuuucccuuucuuuaaucacagcuuuuucacuaaaaguuacauaauguaaaacuaccucaauucagaccuuucucacguauuacuugaauuauuuuaguggcuuuauaauuguucuuccuucagccucuauuuuguucuucauuccgucuuccaccauaccauguucuugaaacaauuuuucugccuugcucuuuuuucauuuguuuuuguuuuuguuuuuguuuugagacagggucuugcucugucacccaggcaagagugcaguggcacaaucauggcucacuggagcuuugaacuccugggcucaagugauccucuugccucagcugggaccacauaugcaugccaccauacuuggcuaacuuuuaaauuuuucuuuuguagagacgggaucuugcuauguugaccaggcugguuuuguacuccuagccucaagcgauccuccuaacuuggccuuccaaagugcugggaucguaggugugagccacugcacccggccugcuguguucuuuaguccaucuuccaugcugcaaucagagugaucuuucagaauucaugucugaucauucauuaaagggguuuaaugauuauuuguuaaccuccuucaagggugguuuaucagacauugaauuaagcucaggcuccuuacuaugguauacaaagcacuucuuucacaagccucacuuucucacuuuuaacaaauauuuacugagagccuacugugugccagguacuaguauaaauauugaggauaauagggaacaaugugaagucccuauucucaaggagcuugcauucuacuugaggggaaggaugaaggacaaugugaagucccuaugcucaaggagcuugcauucuacuugaggggaaggauaaacaaauguauaugccuugugauaagugcuaugaagaaaauugaagcaggguaauauauagaguaggauugggaggauacuauuuguauaggguggucauggaaagucucugauaaagugacuugagcagagacaugauggagguaagagggagccauauggaaauaugggacucuuucauguguuuuuauaagcuggacuauuuucaguuugcaaauacaauaagcauuucuuaccuucacauucaguguucuuuuugccuggaauguccuccguaccucaacuuugucugucaguaguguuuuaucuuuuaggucucaacucacaugugaacuucugcaugaaacuuuacuuaucuggagguaucaaauacuucuuccucuguaauacaguaauaguaauccauaguaaccauuacuaugauugcuaugccuuugccauauauggcuuugggaauucaauugcuaggaugagaauaauaucaguuuuccguugagaagauuaagaguaaugaaauauucuuucucaucucaguuccccuacuucuuugcagcuccccauauguucuaagcuuuaaauauuucuuaaaauucucuauuuguuaagucuuuuggggagacuucauaguuuggauucuuuauuucuuacaucuuuuuuggagucagaucugccuucugaucuuggguuggaaaaggcuucauguagcuuuggacaaguuacucuuaugaaccucaguuuccuuaucaauaaaaugccaguauugauaccuuacacuuaauugugaagauuaacuuacagauaaaacacuuauuuuuauaagugcuucacaugaaaugccacaagaugcaugcaacuuucuugggaagaaguugaucucucagguaaagaguugaucucaguuccuuaaugguucuuuacuaagacugccuuuccuuuacggaggauuuccccuagugaugacuaaagaaugagauggcaggagaaauggucuguuggguaaggcuguuugagcaaugcucuuugucaaaguuggugccuacucugcugaggcuugguuuauuggcucucuacucuuaauucuccacuacugccucucaguuaaguuccaguaaugaagaucugcuuuuauuucccagaauaugcuaugcugugucauaccucuuugccuuuauacauucugauccuucugucuggaugucccuuucucucucugucuacuugguaagcucuuauuuugcuuccuuuucuuucuuucuuuuuuuuuuuuuuuuuuuuuuuuuugugacagagucuugcucuaucauccaggcuggagugcaguggcacaaucucugcucacugcaaccuccgccucccggguucaagugauucucgugccuuacccuccaggguagcugggauuacaggcauaugccaccacacccagcuaauuuuuguauuuuuaguggagauuggguuucaccauguuggccaagcuggucucgaacuccugaccuccgguguuccacccaccucagccucccaaagugcugggauuacaggcaugagccacugugccuggccuuaauuuugcuuuucaaaaucucauccagguguuauuuuuuuuuucucagaagauuucuuugacuuugccagauaauguuaguuuuucccuccauccuucuaccuuguuuguuacuaauacuuuuguaucugucacccauugcuggucauagugcuuggcauaugaugggugcucaguaaauaaaucuuuguuaaacaaaugaauuuccuagauagccugaagugcucucuugaguagcccaaguacuuauuccucccccgcuuuuuuuuaaugcuuucaucuauugaaaggcacagucgaaagaacacagucuuuggaauuggacagauaagauuucuaauccuagccuuucaagagaaauuaucuuuuugaaccuccuuuuucauuucuguacaguaugaguaauaauucuuuuuuauauauuauguugagguuuaaauaguauagggauuuucauuaggcuuaacuaauacauaaaacaucuagagcagaguuuuacauguagagcacuaaguaugugcucaaaaacauuugcaguuauuauuacuauaugccucaauuauaugagaaauaaugcaucucuuuggaaaagcagauuuucccugcauuuuguuuuccggagccaguggauaccuugauccauugaagaaaacugcuugucccuacauuacuuguuuauucaagaaauacuauauggcugggcaugguggcucaugccuguaauccuagcacuuugggaaggccaagguggauggaucaccggaggucaugaguucgagaccagccuggccaacauggugaaaccucgucucuacuaaaauaaaaauaaaaaaaagaaaaaauuagccaggugugguggcgggugccuguaaucccagcuacucaggaggcugaggcaggagaaucucuugaacccgagagguggagguugcagugagccgagauugugccacuguacuccagccugggcaacagagugagagucaaaaaacaaacaaacaacacuaaaugccuacucugugccaagcacuauucuaguugcagaucauuuuuuuuuuuuuaagagacagaaucucacuauguugcccaggcuggucuugaacucuuggcucaagcgauucucccaccucagcguccuaaagcacugggauuacaggaaugagccaccaugccuggccucugauccaggucucuuaacucccaauuugaugcucuguuuacuuguucucuauauuuaauaguuuucuuuggaaaaguguucacucuucuucuuuguguuucugugauagauccugccuaguuaggaguuuggagauaaggaaguuugagaaaaacaagaggcucuaggacaauuaaucaugucuguggcucugcucagcauaucacuuggguugucagcagagccacauggaccuagaauuggccugucaucuuuggaaggaaguuguguugcugauucucugcuuuggcucauuggcuuguuagccauuugauguagauuauuuuguguguggggauuuuuaauaaaucuuucaaucugagucauuugggaagagcaauguucuagcuuaauguauuauuuugagaagugauguccucuuucacguaauguuggucucaugcaaguagggagcuaugccaaauguaguaucucugcugaacuuugggucaccuuuuuaacuaauauguauccauaugauuuuaacuaauauguaugcauaaggauugugucuccuuaauuccuaguuacaauuauuuuaugucauuuagauuccuuuuacuuauuccauacuuguaaagcacucauauaaacaauuuaaaugauuguuuuuauugaugaaaauauuuuaauuuucucauaagccuccugcucauuugucaaauuuuucuuuuccuacccauaguucuacuuucuuccaggcagagcuguggaucaaagaauuguaaguuauuuuugguaucauuuuuccuucucaaucaguucauuuuuaguuagaagaaaucaaacaauuagcuaaucauccugcuuauuuuuugccaauaagaaguaccuguuuaggcugggcgcgguggcucacgccuguaauuccagcauuuugggaggcugaggcagguggaucaucugaggucaggaguucaagaccagccuggccuucauggugaaaccucaucucuacuaaaaauacaaaaauuggcugggcaugguggcacgcgccuguaauccuagcuacuuggaaggcugaggcgggaggauugcuugaaccugggagguggagguugcagugagccgagaucacgccacugcacuccagccugggcaacagaguaagacuccaucucaaaaaaaaaaaaaaagaagugccuguuuauacuuuuaaguuguuggguuuucaaaauauuguuggaguuggaacauuucuauacuuauguuuauuaaaucuauaacaauuguugaagcuaaauuaaauuggaaaaauagaguuagcuauuauauaauagggaaaauaaaugauccuauuuuggcauuuguaaaacuaauuuauugaauaauucauauuucuggacuuugcaaaaucacugaaagcauuuagucucacuuaaggaacuuaaguuauccaaaccccucggucucgguaauuuuuuaaaaaucuaucaaaaaugaaguauuugaauuaaacuucagugauaucuuguauucguuucuccuuuaggguucaaucccauuuuuggauuuccagacugaaguuucgcuuucacuauaaucuuaaaagcauguuaagaaaagaacuguguguuuacaaauguuaacaagucaucuguucacauuuagcagcacacuaauauuuuuaguaauuucaguaaaaauaggucgggugcaauggcucacaucuguaauccuagcacuuugagaggccaagguaggggggucgcuugagcccaggaguuugagacuagcccgggcacuguagugagacccuaucucuauaaaaaauaauaaguaaaaaugguagaguaauuucaguaacauuaugugguuucacucuaugucuuaaaauaaggaugauaaguuaguguaaggauuuuagacuuucuuugugaggguccuguauuuaauauucaguguacaucaacaauauguuucauaaugagaguggucuacauuuggucacguuccuuuucauuuucuagaacuaguguuuaugauucucgagcacgagaaagauugcgccagauugaagaacagaaggcauuggccuuacagcuucaaaaccagguaaaaaagaaaauuggaauaauauuacaaauaaauaguacaucaaaguagaaacuauuuuggaaaguuacccagauuuggguaauugcuguuguaauuccaagaucguaugguagcauagcauguuaugauaugucguaaauguucuuggucuguccagucagugcuacucauuguacauaagacaaauauagauaguccccuacuugugaugguucgacuaaugauuuuuugacuuuacaaaaaagcgaaagcaaugggcauuuaagcacgcucuuugacuuaugacagguuuauugggacauaacccuaucauaaaucaaggaacauccacagauuucuuuaucccacuuacucugaaguuuuaucuuucagagauugcaggagcgggaacauucaguacaugauucaguagaacuacaucuucguguaccucuugaaaaggagauuccuguuacuguuguccaagaaacacaaaaaaaaggucauaaauuaacugauagugaagaugaauuuccugaaauuacagagguaaguuacauacacuuaauuucuacacuacuaaguaucauguuuagaaagaaucccucggaugaguuucaaacauaaaagcaauaguggucaggcacgguggcucacgccuguaaucccaucacuuugggagacugaagcggguggaucacuugagguuaggaguucgagaccagccuggccaacaugguaaaaccccaucucuaccaaaaauacaaaaauuagcugggugugguggcaugcaccuguaaucccagcuacacaggaggcugaggcaggagaauugcuugaacccgggaggcagagguugcagugagccgagaucaugccaccguacuucagccugggugacagagcaagacuccaucucacauacacacacacacaaaaagccauagaacacguguuauuuaaauuuucuuguauauuucagcuuucgcuuauuuuauauaccaaucugggcuuuauuuuuaaaauauugaaaauuuaugaaagaacuauggguggcuuuuaacaguuucagugaagaagcauuuaauacauuugucuuucaugucaugugcauuuuuacuuaaugcacacauacaauaguuugaccucaaauuguaagcugagauuugcucuuuuuuuaaguaauaaaacccauuauagaaaauuuggaaaauacauggaggucuguguacauuuuuagauaauccguuucuuuauccauacuucucuuugaaacacuaccauguagcuggugagcauaacacacuuauuauaguuguacugaauuccauacuuuacauuuaaaaaaaaagaucucuaagaaaguaauuucuaaaagauacugccuuuacucucuuacuaccuuuuaugaaaaauucuguuucucaggaagucauuuggaccagagauauaaaauacaguuaauuuuucucaugugcuuagaaaauuugauagcggaagguuguuccagacuuuaggaauuaauauggaaacaaggaucugaauguugugcugaaaaagagaagggaggacuagaugaaguggaaagaaguaaucggggauuacugggaaggaauagaaaccaaaauguuagaaguaaacugauuaacaguaaauuuauaaacaaucgaauggugauaaauauagucugaggauuauaugggguuuggugagaaauacgguuuuucugaagccacgcguguuugaugucuugacaccuuuuguuuucuuaggaaauggagaaagaaauaaagaauguauuucguaaugggaaucaggaugaaguucucagugaagcauuucgccugaccauuacacgcaaagauauucaaacucuaaaccaucugaauuggcucaaugaugagguaauguugcaucuauuuuuacauacaaauaguaaacauuaaguggcaguuaaauuaaggcauuaucucacuuuuucucaaaaugugguccauggaugaccugcauuggaaucaucucucauaggccucuucauucuuguaacuaugagggagugugguggagacaggcauuuuuaacaaacaucucagguguauuuuaaagucugagaaccacugaauuuaccuuuucuuguugaagauuugaacauugaagaagacauucacucauugguauucucacucuuuaaggcuccuauucugcaguucaucucuucugaacaaauaaguauuagccgaccauguugcagcaugagggaauacugugggauuucuuuauaggaauccaguuuuacuucccuuucuaccuaaguucuacucauuuuagaucacuuauauuacgaaugacaagcuuuccaaaaucgccuccauuuauguaugauauuuuuuaaauggacauugaaaaaguuauauuauuauuaaauauuugagguauugggggagaaguuacggucuucaccuccuaacuccaauuuauuuuaaguauauuaauuacacuacaguuuuuaaacugaucuguuccuaagccuaaaccuguagguaccuguuuuauuuuagaagguuauuuuuacagcaaaagaaaacuggguuggguaucuuuuccuaaguaccuucuuugcauaagcaucccuggcuaaucuggguauacucaagcuucacagcuguggaggauuuuuaguuucucaguguaguaaucauuaaauauuuuagauauccauauccuguuuuuguaugaucaagaccuuccaaauaauauuugccaauaacuauugaucauuuaccucauuaguacgauucauguuuuauguguuuuauucuuguaauagucaucauaucuuuggaaguagauaugauaguucaccauucugcagauaaagaaacaaggcauagaaagauuuaaaaacuugcaagguuauacagcuaguaaacagcagagccaagauuaagacccaagcauugggucuuaucuacuauaucuuaacuaccucagaaucuuaaauuggauacuggucuuaggaucagauauauagaacuuaggagccauauaucauguccaggaugcuuuuuuucucuggggccagccccauucuuuuugccacugguugguuuauaagauaaaaauuucagaagcucaucacucccugaauaauaucugugaccaagaauaauaaggaaggcaugguuuguuacugucuuucuuuagaagaaacccucuuugccucuuuuggcucagauauuagaacauugguucaaauaauggaaaaaaagagcucaccaaaucaaaggaggaaauuaaaucaaggauaguuauaaguauccacugauaaguuauuuuugaucugugguccuuugccauuuauuuccugccauugcugguggugcgaggucaguuacucuaaagggauaguaggcuuuaguuuguuguaaaucauggaaaaccuccuagagggcagcaaucaguaggauaugagcugaguucuugcuauuuacuguggcauuuaccucagugagauuccuuacagagacagcauucaucaggacauauuuuccauucccugggcccaucagaggcuggauuuuuagcaagcuaaguuaauggaaauuacauuauuuuagaggagaugagaagaaggaaagauucuuugucuacuuuaucccuaccaccccuagccauaacuuuuguagaaggagugcauuucuucucaguucagaaugauguuauccuugaaaaugagugccaguucacauguccauaauaaugaugggagcuaucuuaaaaagcaccauuuucaaaguaccauacuucguaggcuuucaaaguuacugcccuugagaagcuaacauccugauggaguauuauuagguauccuuaaguauugauacucauugaagaauacuuaauuuuggccagacacagugggucaugccuauaaucccagugccuuggauggcuaaggugagaggaucaccugaggccaggaguucaagagcagccugggcaacauagcaagacccgaucucuacaaaaaaauuaaaaauuagccagccaugguggcauaugccuguagucccagcuguucaggaggcugaagcaggaggauugcuugaguuuaggaguuugaguuuauagugagcuaugacugagccacuguacucuagacugggugacagagcaagacucugugucuucaaaagaauacaaaacuuaauucuguuucucaguugugaacuaucagucuuuugcaaaugauuuguccucuguucaauccucuucuucccucaaguagauauuuucauuaauaauaauuucucuucuuuuucuguuuccugcuuuauaagauguauuaaaacuuucuccaaaauaggugacugauacauuguucuuaucauuuuauaaacaaaguaccauacuuuguaggcuuucagaguuaaaaaguaauauaagagcaaggaaguaaaaggaaucagauucaguuuauaaggaaaauaaaauccagaaauccuauguuugggauauguauggaaagccauuaggauacccuguuccuaaaagaagagugaccacaguaccuauucauacaguagguuuuaagauuuuuuucauaaauggauuucucuauaggucaguuugguuaaauucuguacaacuucaaaggacuaaugauugacaggauuaauauaauaaaacgucucaaaaauggaaugugggaacuggcugccauauaaagaauacaaaaggaggcaagaagacuguuacaaucaagacaccguagauggggauuucuauacugggucaggagauuaguuacuaauagaaauaucuaauuaagggaagggaggauagaguuaaagagaggagaaauuacacugggagcaguggcucaugccuguaauccgaacacugagaggcugagguguaaggauugcuugagcccagguugucaaggcugcagugaguuaugauugugcaacugcacucuacuacagggugagugacagaacaagacucugagauccugucuguuuuuuagaaaaagggagagaggaaaaauuaguugcaaaaguagaaguagauugaagcagucaagaaacagaaggaaauauuuucaaaugggugucauuauuagaaacuauguauuaauuccuggagauugaauuggaugacuucuggaaucccuuccaacuuuaagauucuagguguauuauccugaguacugcuuuaggcuuuguguuucucuuuauggccaaaugguucuccuuugagggacuaaggauuguuuuaaaaggcaucagauaaauuuagaaauacauggauauaauuuagguauacaaguaaauaaaacuuacuuuugcuucuggucaugauaaaggaaacaagauuuacccuuucaacuuaacuagaaaauuagacaaaagaugaaacaacaauuuucagacauuggauaacagguaguaccaggcagugaucccugaggaagggaaauaaaagguauguaugcuauaauauccccagcuuucuagggugggguguguguguugugaaggagggacugguagagucugugcagaggggcuucccuccagucuuuggcugaguaccaauuugugcauguaugaaaagaagcuaccagaggcuggggaaagaaccaccagaaagaaggaaucagcagucuuagagccagcacaggugucaauaguuuauguuccaaccaguuaagaguagaaaaaccuccuaagucacagggcauugaauagaaucuucagagggguauugccucagaaauagggcaaaacugacccuagaauaaaggcugcucuggacccaccaucacaaagccuaaaaacaaaccucaaaagccugaaacugauccaaauaaccuauaucccagagaaaagccaacaauguuuaaaggaauacaacgaauuccaucaacaacaaggcccagcauaaaauuugcaauauccagcauccaacuagaaaugaccagacauacaugaggcgggaaaguacaauuuaugaugagggagaaaagaaacacucagaaaugaccaaaauaauagaauuagcagacaaggauuuuuaaaaaguuacuauaaauaucuuccacauauucaagaagauagaagaaaauggacaucaugaggagagaaauggaagauauuuuuuaaacaagaccgaccuugaacuucuagaaaugaaaaauauaucugaaauaaaaauauauaagguaguauuaauagauuagacacuucauaagaaaaaauucguaaacuugaauagcaauagaaacuugaauaugagacacacaaaaaaagccaaagaaagauaucaagagcaucagugagcugugggauuauaccagacagguuaagcauauaauuggagucccagaaggaaaggugggggcauaggugguguuagaaaaaguauuugaagaaauaaugauggaagauuuuccaaauuugaaaacugaacugacaaguuugagaaguuauccauaccccaaguagaagaaacaccaugcuaaaauguauaguaaucaaguuguugaaaacuggugauaaaaauauuaagugcaacgagaaggaaaaaggcacauuaaguacagaagaacaaagauaggaauaacugucggaaacgaugcaggccagaagacaauguagcuacaucuuugaaguacugcagaagaaacaaauuugucaguagaaauucuauacccagcaaauauaucuuucaaaaaguaaggcuguacuuuuccagacaaacaaaugcaucaccaacagaccuguaccagaagaaauauuacguguucuucaggcggaagaagaauaucaaauggaaaugucagucuacacaaaggaaugaagaguggaauugcucucauuuuuucauaccucuagaagacaggugacuaaggcagaacuaaaacaacauacugugggauuuauaacauacagaaguaaaauauaaucacagcacaaagaaggagacaaaauggacaaauauacuguuggaagauccuucuacucuacauaaagugguaaaauguuauaugaaggaagacuguacguuaaagccauaguaaaucauagaguaaccacaaaaaauaaaaauuaaaagcaagauauauuuacuaagccaauaauggaggcaaaauggagcuuuaaaaauacaaaagaguuggaaagaagaaaaaagauaaaaagaacaaauagaacaaauaggaagaaagagcaagaugguagauuuaaacucaaccacauugauauuaaauguaaauuaucuacgucaacauuguccaauagaaauauaaugugagccacauauuuuaaauugucuaauaguuacuuuuaaaaaaguaaaaugggccgagugcaguggcucaugccuguaaucccagcauuuugggaggccgaggcggguggaucacuuggggucaggaguuugagaccagccuggccaacauggugaaaccccgucucuacaaaaaauacaaaaauuagccaggcaugguggugcaugccuguaaucucagcuaccuggaaggcugaggcaggagaaucgcuugaaccugggagguggagguuacagugacugagaucacgccacugcacuccagccugggcaauggagcgagacuuuaucucaaaaaaaaaaaaaaaaaaaaaaagaggaaauaaaaugaaacaggugaaauuaauuuuaacauauuuaaggcuaggcacaguggcucacgucuauaaucccagcacuuugcgaggccaaggugggugcaucacuugaggucaggaguucaagaccagccuggccaacauggcaaaacucugucuacuaaaaauaaaaaaaauuagcccgucaucgugugugccuguaauugggaggcugaggcaggagauucacuugaauccaggaagcagagguugcagugagcugagaucgcgccacuguacuccagccuggaugacagagcaagacuguuucaauuaaaaaauauauacauauauaaaauauauaaaauaauauauagguaauauauguuauauauaaauaauauauuuuuacauaaaaauauauauaauacaggucgggcgcaguggcucacaccuguaaucccagcacuuugggaggcagaggcagguggaucaccugaggucaggaacuugagaccggccugaccaacaugcugaaacccugucucuacuaaaaauacaaaaauuagccaggugugguggcaggcgccuguaaucccagcuacccaggaggcugaggcacgagaaucgcuugaacuugggagguggagguugcagugagccaagaucacaccacugcacuccaaccugggugacagagugagacuuugucucaaaaaaauauauauauaauguauuuuuuauauauaauaaauaauauauauguaauguguaauauauuaaauaauauauuuauauauguaauauauaauauauuaaauaauauauuuauauauguaauauauaauauauuaaauaauauauuuauauauguaauauauaauauauuaaauaauauauuuauauauguaauauauaauauauuaaauaauauauuuauauauguaauauguaauauauuaaauaauauauuuauauauguaauauguaauauauuaaauaauauauuauauauguaauauguaauauauuaaauaauauauuauauauguaauauguaauauauuaaauaauauauuauauauguaauauguaauauauuaaauaauauauauguaauauguaauauguuaaauauauuuauauauguaauauguaauauauuaaauaauauauauguaauauguaauauguuaaauauauuuauauauguaauauguaauauauuaaauaauauauuuauauauguaauauguaauauauuaaauaauauauuuauauauguaauauguaauauauuaaauaauauauuuauauauguaauauauuaaauaauauauuuauauauguaauauauuaaauaauauauuuauauauguaauauauuaaauaauauauuuauauauguaauauauuaaauaauauauuuauauauguaauauauuaaauaauauauuuauauauguaauauguaauauauuaaauaauauauuuauauauguaauauguaauauauuaaauaauuauauauguaauauguacuauauuaaauaauuauauauguaauauguacuauauuaaauauauauguaauauauuaaauaauauauuauauguaauauauuaaauaauauuuauauaugugauauguaauauauuaaauaauauuuuauauauguaauauauaauacauuaaguaauauauaaaauauauauuauauguaaaauauauacuacauuuuaaauauauauuaaauaauauauacuauauauuaaauaauauauauaaaauaauauauacuauauauuaaauaauauauauaaaauaauauauacuauauuuuaaauauauauuaaauaauauauacuguaugguaaauauauaauauauacuguauauuaaguauacaguauauauuuauacuauauuaaguauauuaaguuauauauuaaaauauauauuaaauaauauauaucauguauuaaauuauauauugauauauuacauauauuauuaauauauguuauauauaguaauguauaauauauaaauauauuaauauuuuuauauauugcauaauauguaauauauuaauauauuauaccuuauacauuaauauauauaaauauauaaaauauauauuaauaugauauauuuuauuuauauauuaaauaauauauauuauauauucaauaacguuauuuaacaaaauaugucauuuuagcauguagucaaaauacuauugagauauuuuaccuucucuuugaaaugugcuguggauuuuacacuuauagcacaucuccgguuggauuagucacauuucaagugcucaauggucacauuuggcuaguggcugccuuacuaaacaguauaggguaaacauccaauuaaaaggcagauauuggcuauccuuggggaggccagcaaauuuccggauaagggaagcuggugggcaggaaaaaggcaugcaauggcccucaugagccagaagaauagcugcugacugaugccugggggaccaagcccauaauuguggagcuggagccgcacugugucccuugcuucagucugaucuuuggggagccugcacaguucugaccucaguuaagagcuaagggaagagauuugggaauguuuggcccuguguaacagcaaaaggauucauuggugagggugucuggcagguauccguaaagauaauaagaugaagggaacaucgccguuuggaaagugucgugauaugauacacaaguugugcugccucuguggcucuaaggcauaccaccuucagaagucaaccuguggcaaauguggcuccccugccaagcgcaagagaaaguguaacuggacugccacggcuaaaagaaaauaccacggcgacugguugaaugaagcaccuaaacauuguauacugcagauuuaggcauggauucuuugcaggaacaacaccuacacccaagagggcagcaguugugucauccaguucaucuuaagaauuucaaugauuagucacacaauaaauauuccgguuuuuaaaaauguauauauuuuaaacauauauauguuuauauguauauguuauaucuguauuacauauaugugaaaagaggcagagauugucagauuggauuaaaaagcugucuguaagaaacuauuuauuauuuauuuuugagacggaguuuuggucuuguugcccaggcuggaguacaauggcaugaucuuggcucacugcaaccucagccucccagguucaagcgauucuccugccccagccccccgaguagcugggauuacaagcaccugccaccacacccagcuaauuugucuauuuuuaguagagaugggguuucaccauguuggccagccuggucuugaacuccugaccucaggugacccaccugccuuggccucccaaagugcugggauuacagaugugagccacugcgccuggccaaggaaccauuuuaaauguaaagacauagguuuacaaaaguuaagggacagaaaaaauauacccugcaaacaugacucaaaaaagugacuuauuaacauuauacaaauuagauuucagaacaaggaauauuaucaguaauagagacauuucuuaaugauaaaggggucaguucaucaagaaggcuuagcaaccuaaauauguacacaccuaauaacagaacuucgaaauacgugaagcauaaucugauagaacugaaaggagaaauagacaaaucuauuacuguuggagguuucacugccucugaguaauggauagaauaaguagaaaaucaguaaggauauagaagacuggaacagguagaucgauccuaugcacccaaauguuuguacaccaggaacacuuccucuacucagcccucuaugcccuauccuacgugaagcaggauaacuggagcauuuccugucucucuauuauuuuccccccaagacccuauucucccucucauuccuugcugucaauuuacguggaugaauuggaaaaauagcaagcugacaugucucuuuuuugggggauggguucuacucuauaaacccauauuaguuauuaccaguuguuuccaauuggaaaagcauuggacuguuggaauacaguauuucuaacuucaccagcuagugaaaggccaaugaggaacaaacucauaggaaauaugggggacaggacgauggugaaagaggaauuuagaaucuacauagcagacuguaauuacacugaaacuacagcuaaccaggcagacuaauuaccuacuugguaagcuucaucucugaaaagaaagagauaucucucagcuauucagcaucacaauagccugguguguagagagcauauucuuacuugauugguggcauaaaauaagaagcaaaacuuuauggggaaguacuaaagucacccgauuuuuauugcagagucagaaucuggaaccagagcacuugcauuuugaugaacauucuuuuuuuuuuuuuuuuuuuuccugagacagggucucacucuguaauccaggcuagagugcaguggugugaucauagcucacugcagccucaaacucccgagcuaaagugauccuccugccucagccucccaaggagcugggaccacaggaaugugccaccaugccuggcuuuuuuguugguuuuuaguuuuuagagagaaagucucacuauauugcccagccuggucucgaauuccuggccucaagugauccuaccaccuuagccuccuaaagugcuaggauuacaggcaggagcccacacccagcuuugucuagcauucuaacuuucagaauauauauuuuugaugggaacggggggaauugguaguggucauaguuugauaauuuuuccaaggaguaguuaaaucugagugaugcucaguaaagagaggaaacaaccugcaaaacauuaaguucaaccagacaaaccuagccuuaggaauagguuuuccuuagagaauaaaagcugauugcauaagaaggaaaaaaacuaggcaaaaugaaauaaauuaguuaagugacuaugaugaauccaccauugcuguacacuuacguguagaauaaaacgaucagaacuaaaguuuucuaacgugacucuuuggcuuccacauuauuaugguuuaucucuuugaaguguuucuaaauagaacuagcccugauuaaccagggauuuaugcaaggucacauggagaauaguaguuauucuccauaaaugacuccauaaacauguugcuugccugucuuucucuaaaaguuuagcuuuaauucugauaauuuguuccuugaauuggcauguaagaaaaauucugugugcauguuugcagugagggaaaccugccuuccugguuucuauaauauuacuagguuagcuccugugagugaaugaccugaaccauacuauucaaaugcugcuguuagucucuuggacuuugugguugauaaggguaaauuuaauuugaaaaucagaauggggaggucaaggugaaaaucuagagagguaaaauuggaaaaauggcuuuuguccccccaaaaguugucuugaucucugcucagaaguauugucaugcccaggccuuuuagaacauuuuuucucaagcuaauuagaagaguucaaacuauaagcaugagaauggcuaaaaaucaagacuuuacugguagugaaauguuuuauuucuaaaaacaugagaaaacaauaguuuggcugguuuacuggggaagaaggaagauacaaauagcauuggucguuuaugucauugugguaauguacaggaaaaagauugaauccuuaguuugaaaacauuguaggcuuuucucugaaagaaaagcuuuuuucagcuucagccuggcagcucuucaaauaaaaucucaaaggaacaaggcacuauaaacaacccacccaucccuaaacaugacugcauagacaaguagaugcuuauggccaaggcugcaaaggcagcaggaaggguagcuccuuaagcaccaagagccacagugagcaaauagaggcaagugugggucccagaaaaggugacagguggacuaauguugacaguuaguccucagauugugguauauuggugagacaaauagcaagcacaggacucaucuacuuuuagcucauuucaaagggaauuuaggaucugcuggugcuaagagagucuuguuugaggaaagggcuguugccaacuuggcgucggggacaguugucuucacaaaagucaagcaaaugcugugaccaucacugcuccucuuucaucuugaacacugugaucccuucucucauuucuuuuuccuucaucuucagcccuccucugugagaugacauguaggacuuuuuuguucucucuuagcucauuuuuuugguuuaauugugucuuggcugaacuauggcaauuuuccucauuuggaugguguaauagcuaaaaaaauugaggagaaagacuugaauccagauucugccuuggaugucagauuuacauucucagcuaauguggggagcauugaggucaccaaacucccuucuacugggaucuaggggaaaugaaaaagaacccagaucauuccuuagagcuaauuaacuaguugacuuuggaggccauuuuccucucaguugagaaacuuugguugggugcagcaauggaagaggaauucucaaagggaacagauaccauggugucugaugacugggguucucuguucuuguucagcuguguuggucuuuagcuuucuagugaacccucugaaggugaaaaaacaagcaaaacucaggcuguguaaguccagcuaagcuuccuugguuucuggaacucuuuccucuugaaaaauagaauagugauguauagcaugacacucauuuaugucauucuuuuuuuuuuuuuucacuucagacuuacgauuccagagguaaucucugauaggcaccuaggggagauguauuuccauggcugucaugugcuucaccguccuuaucucucugccugauuccuuucaccuccugcuucaguccuuauuucuuguuggaauauauaagcugucugccccuauggaagguuucgcuuacaguaacuggcagaucaucugcuuaugucuuggauugaaggguuuacccuauaacauggccaacauuauaagauggguagaaggccagaggaaucagugaauuccuucuugccaauuuuuccucauuagagaacauaguuuacagccuagaaaucuguacuugcugggaagauccuacugcauuuauggcugccuucggaaaccuagaggcagucuuuagcaccauuauccugaggggcagaguuagacugaaaacuuauaguuaagaaauaccugauucuaauugugucuugauuaauuauuaucuguaacaacugaucuccaguuaucuauugggcaucacacuaggcagagaauaagccacaaccugaguccuuugggcugacugggccuguugcucagucaucagcugcagagaaaacagugucuuucuucaguccuagccuuccccuaccucagagcucugccucauggcgagugugguuuucccgcagcugccuaggcauccucaucuauaggcccuuucucuggucuagaccgugcuccgguguguuccuggcaguguuccccugcugccuacccaguaugucguugcuuacuguugggcaguagcucacuguucuggcauccugguguguaaauauuugucaaagaacaggggcauuuucccauuccccaaaaagcauucugaaaaaugugccuguuuucuuagucauauuuccaagccguggaucaguuagcccauucauuccuugcaguugacagacacuggccugaccucagcuggccacauaaaguaaguaugcaguaacuuccggcacgauaacuuucaaguuuuaguaccaaagaguccuggaccuaauggaaccauacacaacauagucacuauuagagaagaugucguuucauuaacaaagaaucacacaucuccccacucagccauuguaauuucuuuccacacuuaauauugaaggcauaaauggaaucaacaaagaugagaaagcuaaccauauagauucugggguagaacguuauucuucauguuugugacuugacuuuaggucucauauaagguagguuuuuauacuuccaugugugccuuuauauaaaggugacauugcugagcuacuaucaguuuacagguguuuuuccaguauaauuaauggcuucuccugucacuuaguucuacuugagaccaaaagaguuugccucugcaggauggguuauuaaguugaaaaggcagucuuuaaccauggagcagaguuuuccaucuuuguguaaaaccauguggcugucauauaaaauuugaguucuugauuuuaacuugacuaacacuaggcgcuaacugagcucaguaucuacuuaaauugcucacacaguuccaguagauaaagguaacugcuaaugugcauuauuaaacugcuugcaugccuuccucuccuuuucuguaagccucaccuuaacaccccugucuuccugcagucuuuugaccuaaccuucagucuucuacaagccuggccagcgucugcccauuuguacucccaaccccauaauauauaugucagcuuuuucucuuuucaccauuuauagcacuucagccuucccccuucuagucagaauuugauuuagagaaaugaaucuguuggauguugaagacuuaauucaguuuauuaggaaacaauuacauaugcuauucaacacagcaacugcaacuauuuugaaaggcuaggccugagugucuauucuaauagguguaauuucuucccacagaucaucaauuucuacaugaauaugcugauggagcgaaguaaagagaagggcuugccaagugugcaugcauuuaauaccuuuuucuucacuaaauuaaaaacggcugguuaucaggcagugaaacguuggacaaagaaaguagauguauuuucuguugacauucuuuuggugcccauucaccugggaguacacuggugucuagcugugaguaccccuuucauuuuugauaaaauguaaaagcuauguacuuauagaacacacagaggguagugaguaguaguucuacauguucccuugauuauugagagaaagaguguuuaguaguagguugacuaaaaucagauagaucuaugaacuuccuaucaagauugggauguagauuuugaagaaagcuguggaauuucccuuucuagaaauauuuaaaagagaguuauagggugucuaagcagccuuaaaggaaggcaugggggaaaaaaagugacuuauuaaugaugcugccacucagauucugugacuguuauuuucagccuaaucauaacuuaccuugcauacuugguaauuuaauauuuuuaugacucugugagcauuagcuuaauguguuaauaaaacuauuucacagucuguuuuggauuacauuucaaaagcauaaagccaaaaggaacuucucaauauaaagaaauaaaacccagaaucugcucaccaucuuucugaaacuuuguggaagugauuuugagauacucaccuuauauucccugaaaaucauguaguuucuucacuguugcccacuuugcagagggagagaaugaacauuagaaaaaggcuucacagcaauaauggggccaccuguugaugagugccaucauaguuuuauguaaauaacccuucauuuuuuuucucuacagauuaagcauaauauaaugcaaaauaucagucaaacuugucaugauuuuguaggaagucuggcaaaagguuccaaagggcagggaagggaaaaacugauaaaccgauuuucuucaucucauaaacacagagacuuuuuuucuuauucucagguuguggacuuuagaaagaagaauauuaccuauuacgacuccaugggugggauaaacaaugaagccugcagaauacucuuguaaguagggaguugaggacagaagaguuugauaucggguauaggugguguuuuuccaguaauugaacucaguuguuugauaccuucaauggagugauugauaaaaucuucauauuaaguaaaaaugcauauuuuguaucuaaguaaguuuaguuuaaaaacaauaccaaaguaugcccuaaugggagcaauuacuauccuaaugcacuaaaauguagacuagauauaaagauauagaugcuacuuagaaaucauuuaauccaaccuccuaauuuuucagaugaagagaccaaggcccacagaggugccuuugauuugcccagguccuauuaguuaguggcucagguggaccagaaugcaaaucucuuuaugcuccaccuguuucauuuuccaaaauaccuauuccucacuguaccacucugauggccaggaggaaguacauuccacaauggugaacaguuugcacuuaaaagagagcucuauugaagguaugcacucaauacauuguugauuuggauuuaauuuuuagauaggagagccaagccuaacaguaguaaauaaauaccucaauaguaccagaaaaacacuuuucuuccauuagauugaguucuaaaggaccauauaaaccaaggaaaagaauaaaaagaauuguuccucagaaggaaugguagguagaaggagcuuaacuguuagaggcagaggucauguuccuuuugaguugacagaguggacauuagaagagacaagcuagaagaggcaugcucagcucuggagaaaacuuaacaauccagggauucccugcccaguauuauauacucuuuuccucagaagagcagaugaaacaaauuuguuccuagguauugucagccccauucuuaguguggcagcugucaucgauguuccccacugcuuaucucauucucuccugauaccuuuaggcaauaccuaaagcaagaaagcauugacaagaaaaggaaagaguuugacaccaauggcuggcagcuuuucagcaagaaaagccagguaccuuucaucuugaugaaauaaaaguccuaaaaguaggguauuuggggaggaaagaauuuuacugcuuaauucccagggaccaccuguguucgugucuagccugacuucagcuugguugguugguuucugggggaggauaaauuaagcuauccguaggaaaagugauaguguguuucuuauguagaacuagguuuucuaaaugcccagauauuuuacuaagcuuuucacuccuaaggggaauguuugcugauuauuuggccucugggggagggagcaguuuuuauacccuuaggugccaugggagucggagauauucuccuguuugauuaauacagaguacacagaccugacuggaauguuguauuuuguuucuuugagccucuguuguccugacuggggggccagagucaucuguuuguaauuuagagaaaccuguacaauuuauaucuuuugguucuuauuuuuaaucuaagaaggaaagaagcuuggaaagaugucauuuuuuuuguuguuggucuuccaggagauuccucagcagaugaauggaagugacugugggauguuugccugcaaauaugcugacuguauuaccaaagacagaccaaucaacuucacacaggugagcugagccuuccauagggagcucuaggauuacuuugucuccaagcugcccuguagauguuuuucucuccaguuguucucuuuaggggccucuacccuaaccuuuagcaugcuucagcccaugauucauaacacugaugguuacuaccugaaucacaucacaaaagaaagaaaauuagugauaagccacguccuggguuaccacaccucaguuauuguaguaaagguuucaagagcagaaccuucucugccugucuccucuaccuacuguaacuucuagagagaacugggaccagagcagguuucuuuaguucccuugcauuucguuaguagucagguuugggaauaggccauaccucaaucuccuaguguaauuuguuaugcugcccccuccccugaccccucacuugaugaaucuggucagucuucucuuagagagugauuggucauuucuguccauguggucucucagaccaaaguggauugagauuagagauuaugguuuauucugauguguucuccacuuuuacuucuguuugaaucagugacuuuaccagauuuuucuaccauagcccuuugucuagaccagccugagcugacucuucaaguucccuuaauucuucuaaaaggugaauuuuuuauuuuuaggccuaggcucauauccucuuaaaaguucaacauagaagacuuauuagacaccauucucaaaauucuuagagacgugggcauagccuggggauuccuggaaauacccaguguaacuucuaaggcuauaauggugaaaaauaacaauagaaaaagcaaugaaaagaaaaaaacuacauguaaccaagaaugaauaauuuaaaagaccagaaauacaacugagacuguuuguugaaaaccuugcaaaagaaagaaguauggggaaaggcguaucaggucuagacaaaagcauugaaaauuaagggugucucugugucccuacagcaacacaugccauacuuccggaagcggauggucugggagauccuccaccgaaaacucuugugaagacugucucacuuagcagaccuugaccaugugggggaccagcucuuuguugucuacagccagagaccuuggaaacagcugcucccagcccucugcuguuguaacacccuugauccuggaccaggcccuggcgagaugcauucacaagcacaucugccuuuccuuuuguaucucagauacuauuuuugcaaagaaacuuuggugcugugaaaggggugagggacaucccuaagcugaagagagagacugcuuuucacuucuucaguucugccaucuuguuuucaaagggcuccagccucacucagucccuaauuaugggacugagaaaagcuuggaaagaaucuugguuucauauaaauucuuguuguuaggccuuacuaagaaguaggaaagggcaugggcaaaagguagggauaaaaaccaccagcauauacauggacauacacacacacccacacacacaaacacacacacacacacaauuuucacgauguauggucaggaaugugacuguaaacuggacuuuggggcccaggcauaagucccuuccuccaggaccuuuccuauuuauaugucccuauacaaaauccaucugcuuuuauacguagcuguuuuaucaucuguagcuucauccuauccggaggcacagcacaugagcccuggacaggucccaaaguuccaagcaguccuuuccgugaaagcagggguuugcaugugcuaccaacacaugauacggggaagacccacccagggagcgguuucaguggcgcaacaaagcaccacuuuuacuguugccuacuucugaccaagaagaaaaaggaccuuaguauuuagcauaaaauuccagcgcuggaugaaugcagaucuaguuuggucuguggcuaguuuaaauauguuucuaaccacagagaauuucauauauauauacauauauauauacacauacauauauauauauauauauguauguauaaaauuucacagggauaugcuuuuuuuuuuaaagacugaauguguucaccauuuagccuguagauuuauuuccauuuuccaaauuccagcacacagagaucccagccccuaugaguaggguguuuguggacuaccuaauggaauauuuuugaggccuggaugaacuuugccauauggguagagguuacagagggaggugauauuuucagcuaaaaaaaaaaacggguggaguuuggacugaucaacuugagauuuaaaaacugcuauuccuuuuguucuuucuagcaucucuccccacccucugagagcuccucaggcuuagauagugaagugaucaaaugccagugucauuuuguacuuaaguuccaaaguaggaacauuuuauacuuuuuucuguauuguaauagguaguuuuguaugaaaucuuuucuccucucccguuguaccgcauucuuuccagcauugugcuuuuucccugggcuuauuugaaaauuuuacuguuuuauacaagcucguuuaguacauuuuucuauguuuuaccacaaguuacaauuugaaaagaaaacuauuuuuuuuaaauauuccauuguuaacugaauguuacuguuuccacuccagcaacuacauguccucccuucaacugccugccuuuuggggaaagaccaccuuuuguguguuuguuuuuucucucucuuucuuucccuuucucuuucuaucucucuuuauuuuucuuucuuuuucuuuguuuuugaguuuucuauaggaaauaaauagcuuucuauauaugag

SEQ ID NO: 21532 - RNA, 8045 nt, Homo sapiens
aggcuacgaaacuugggggagugcacagaagaacuucgggagcgcacgcgggaccagggaccaggcugagacucggggcgccaguccgggcaggggcagcgggagccggccggguagguucccuucggggaacgugcaucuguuuuuaggagcggugcaugaaggagauggguguacgcgcgggcagagaggauguuguagggccggcaugcaagaggguagguguagugugcagcuguagcacaacgggaugagaacccaggucagacuggaaacuacugggugcgggguaggagguaggggagguugacuaccugcaaaguggaagcuguaggggguugggguuggcgccgggaguagggacuuguccagcaggcggcuggccuuaguucagucuccuagggugcccaacugggcgcacggugcucugaacuuggguggguguggaugggggucacagcaccgugggggaacagguacacagagcuuuggcgcugcugggauccguacgauucuaacugggauuggauuuccaaaaggcccuccuuccucccagccugucagcucccucccagugucccgguuguuuucuuaacacuuuagaggcuguggcugaguuggcagggguuccccacccugaacuuucugucugaggugcguuaggaagccuccggaucauugaaggaagugacuggcuugguggcugaccuguggagggcugcuugcuguguauugaauaaaggaggcuucuuggggucggggcagggucucuguaagcacagggagaauugauuucgcuggggcuuggaucacgugugugugugugugugugugugugugugugugugugagagagagagagagagagagagaaagagagacagagguggaaacccuuguccuuggggauccuggauagaaguugccaguguuggagucuuggggcggugcugccuagaggauaccucccaaccauuccagcuccagaugcugaucaucccuaugcccccucccccaguagucucuguuggaucuuacagguagggugcagccugaggcuuguucagcagaacaggugcaagccacauuguugccaagaccugccugaagccggauucuccccacugccuccuucaaccccgccucuuccuccuccugugggacugcuccccccuccugugaggcuagauguagguccauaucuuguguuguuaagaaccugcaugaagggggagggacugauggggguugauccggaugugggacguccagguggagaaacaggauuugaauaaggcaggaacaagcgcccaguucugcccaacugcugucuuuccuccuucacccccagcccaucccuggccaggcuguccuagugcaggcagauguggccacccucaccucucgcagggugcugcaugccuguggacuggugccacuggguguguggggccugagcuacaagggucucuguugucuugguugucaggcuagggguggaggugcccuguucagggccuguggaguuagaaggaaggcuaggaccagagaggacuuccugggcucuuggccaggagguggugacagccuuugcccccaucacugcaccccuugauuaugguacucuguuccugcuugauuucuucuccagcuucccucauugacuggugaggccagaguuacgcagaccccagguguguagguugggagggagacuguccuggagccuccucugcauuauuuuuugaccauucugugaauguaaggaucugccugaaugaugcuaucucuguucaggcucucuucaggcuccucgggacuggggcuguguaacccccuuugccugagccucuggauucuucagggcacagacccugcuuuaguggagggacccaggcaggggcagaaugucuuccacccacccaccagcaggcuucuccuuaagucuucugcuggacucucagaguucucuuauuaagauaacugggggcagcagaacauucuuuuuagguacuguuguccauucuccugagaguccagggggcuguggucuccuuccuccccccuugcccuguccccagcaaauggccuuuaaaggucuggagccagguuaccgaugaggaggccuagguucccuuccucuuugcuucugggagcaucucgagcagugcagaguggcuucccagccccagauggcaggauugggguggguuugggaucugcugccuuugcucagugugcaggguugggguggaaaugggggacaggcuagggccucugcauuaggcugccuucuuaggcaggugggcuuucacuuccagcuccucuuccauuuucacgauguccuucuuccuaggcacugcgaggggaggagaaaaggggcuuugcagaggccugggaguauucccaggaagugccugguuggcgaaacaaccagggagcugcuccugggagcugggcugaggcuuugcugggcugccucucccacucacccuucucccggcccccaccaugccuuccccaugggggaggggcagggggcuggaggaacacagcuucccccuguucuagcagagaaaugcuggcuguaugccuccccuaggguucccaggcugacuaggguguggcuggccuucugauggagcccacucaugcugggccgcugcccaggggcuuuguggcaccuaggucgagaugguacucaggccaggggucaggauuccugggugcucuggucccggugccucugucucaucuuuaggcugggauuccugccaccuugcugcucuggggcccaaauacuuugagacaaggcuauaggcuugucccacugacucuccuuucccucccuggggucuccucucucuccagagaugcccuguauccaagcccaauaugggacaccagcaccgaguccgggaccccgugaccaccuggcaagcgacccccugaccccugaguucaucaagcccaccauggaccuggccagccccgaggcagcccccgcugcccccacugcccugcccagcuucagcaccuucauggacggcuacacaggagaguuugacaccuuccucuaccagcugccaggaacaguccagccaugcuccucagccuccuccucggccuccuccacauccucguccucagccaccuccccugccucugccuccuucaaguucgaggacuuccagguguacggcugcuaccccggcccccugagcggcccaguggaugaggcccuguccuccaguggcucugacuacuauggcagccccugcucggccccgucgcccuccacgcccagcuuccagccgccccagcucucucccugggauggcuccuucggccacuucucgcccagccagacuuacgaaggccugcgggcauggacagagcagcugcccaaagccucugggcccccacagccuccagccuucuuuuccuucaguccucccaccggccccagccccagccuggcccagagcccccugaaguuguuccccucacaggccacccaccagcugggggagggagagagcuauuccaugccuacggccuucccagguuuggcacccacuucuccacaccuugagggcucggggauacuggauacacccgugaccucaaccaaggcccggagcggggccccagguggaagugaaggccgcugugcuguguguggggacaacgcuucaugccagcauuaugguguccgcacaugugagggcugcaagggcuucuucaagguaccgcgcagccccagguggggccuuuuguuggaaauggagagaggcuggccucaucccauugggaccuguggucucccccuggguucuccuccuagcuaaguccuguccugcagggugggaucagcccugccaggugggccgccuuccuggagacccguagaugccagggcuggaagcuuucauuugccgggacacucgggcccaugggauugcacagagcuggagggaggggugagauaggggcagauaggagcugcaggggugccuggcgagccucugguuuuccucugcuccucugccuguccucucccaacucaagguucuagugggaaggggugcccccaggcucucauguuccuggcgugagaugaaaggaucccugcggaggguuugguucuugagggcuggggguggacuugggaacaggcuguguguuugucccagcgauggugccugcuuagcuucccguccccaccccccagccccuuggcccucuccugucugcccuagggagaaggcagguggacaagggcccaugaaaaaauacaggugucuagacugccagggagacccuggcccccaguaguguguccuggggacuuccucagagcgagaaaccucccccaaugucuucaagacuuuucucuccccccgcccaaccccgucucucccucccuugccacccaaauguuagaaaaauagcugugaacagagagcgcuuuugucugcaauggcagcaggaucuggacgguccccuccccuaaguuccccccuccccaccccacacucugacagcuuguuccguguugcccccccacccagcgcacagugcagaaaaacgccaaguacaucugccuggcuaacaaggacugcccuguggacaagaggcggcgaaaccgcugccaguucugccgcuuccagaagugccuggcggugggcauggugaaggaagguguguggcuggggugcggcccagcggggcaaggguaggcuugaguggagugggaccagcagggcccccaggcuucugcccuggaggacccagaggagggcacgucuuauuuccaccccaccucugaaccccaggccuuggagggaggcagccuacaccugccuggauugugagggugguggcagggggagguuccuauaggguaccuuggaucucagggacucuggguccuagggacucgguggggcgcgucucagcaguggugugcacggcuugggcugagaggcccuuccucagaucccuuccuuccucaccccuacccauuccuuugcaguuguccgaacagacagccugaaggggcggcggggccggcuaccuucaaaacccaagcagcccccagaugccuccccugccaaucuccucacuucccugguccgugcacaccuggacucagggcccagcacugccaaacuggacuacuccaaggugaggucccaccccgugucugccuuggggaggucuaugagcacaugcagugccuuugugcguguuaggagagcuacccccucuggaaggacugaaugagaaaggagguuuaaaaaagaaagaaagaaaagcgacucccuccaguucgacagaucaaagagaggaucccccucucggcugaccagaugggaaaaugcacccccucaggcagguggccaauuagaaaaauauguccuuuuggcagcugcagcccuggguuaauaugugagacuuggcaagugagagccugggcaggaucucagauccacucccacucccgggaucuggcauccaagugucugacacagccauacguggcaguggguguaggagccugccuggggugcugaccccacuggaccgucuuccuaguuccaggagcuggugcugccccacuuugggaaggaagaugcuggggauguacagcaguucuacgaccugcucuccgguucucuggaggucauccgcaagugggcggagaagaucccuggcuuugcugagcugucaccggcugaccaggaccuguugcuggagucggccuuccuggagcucuucauccuccgccuggcguacaggugagagccacugacugucugcccagccccuuucccugauacaccugccugugaaccacccugaucgcucuucgugcccaucugccugccaggucuaagccaggcgagggcaagcucaucuucugcucaggccuggugcuacaccggcugcagugugcccguggcuucggggacuggauugacaguauccuggccuucucaaggucccugcacagcuugcuugucgaugucccugccuucgccugccucucugcccuuguccucaucaccggugagugaccagcaccacaccagguccaagggaaugggcgucaggggguugacugguucucaggagggcacugucccagggaguuuggugggccgggaucuagcacuuucugggccccugcacugccccgggcucaugccagcaguaaaguagggaccauaggaauugcagaugggcucagcugcauccagcucuaaagcgcaagacagccuuuggucccagacugucaggauccagacugcaggugucauguauguggccuaggguauuggcuuguuuuuaaaaccuuccugucaauuaugcugcauauagaaaaguacacaaaugguaaauuuucauaaaccgcacuuacccaaccagcgccuuggucaagaaagagcacauaacugccccccagaacccauuauugugcccccuuccagucauuugcccuccccaaggguaaccacuacuuuuuauuuaaauauuuuaaaaauaagaugggaaucucacuauguugcccgagcuggucucgaacuccugggcucaaaugauccuccugucucagccuccuaaagugcugggauuacaggugugagccaccacgccuagcccuucacugugacuucugacagugcagaucagauugguugugccuguuuuggacuuuauguaaauguaguucugcaggauggaaucugguguugaaugcagagguuuucagauuucucuguuuuuuaaaggaaagaauccacccucguucauuuuuucacuuaaauugcacaggggacccaacgauauagaacacaaucagagguacucugggcugagggagugcugaguucugaggcuggguuucucagaacagucuagauuuuaaaaacccaaugaucuagccagaaaacguagguuaggauuuuauuucccguuugugacccugggcaagucauuagccuccugggccucggguucucacuuggaguaugaggauaaugaggguuacugcuucucagacuugugacgaugcuuacuaauggccaacaugugaaugcgcuuuugugaagugccagcagagcaugagggguggucaggggcagcaguuuuaggggccugggggaggcuggggcuuugggggccugguucucagauguacagcuaauccuguacccuucccgcagaccggcaugggcugcaggagccgcggcggguggaggagcugcagaaccgcaucgccagcugccugaaggagcacguggcagcuguggcgggcgagccccagccagccagcugccugucacgucuguugggcaaacugcccgagcugcggacccugugcacccagggccugcagcgcaucuucuaccucaagcuggaggacuuggugcccccuccacccaucauugacaagaucuucauggacacgcugcccuucugaccccugccugggaacacgugugcacaugcgcacucucauaugccaccccaugugccuuuaguccacggacccccagagcacccccaagccugggcuugagcugcagaaugacuccaccuucucaccugcuccaggagguuugcagggagcucaagcccuuggggagggggaugccuucaugggggugaccccacgauuugucuuaucccccccagccuggccccggccuuuauguuuuuuguaagauaaaccguuuuuaacacauagcgccgugcuguaaauaagcccagugcugcuguaaauacaggaagaaagagcuugaggugggagcggggcugggaggaagggaugggccccgccuuccugggcagccuuuccagccuccugcuggcucucucuuccuacccuccuuccacauguacauaaacugucacucuaggaagaagacaaaugacagauucugacauuuauauuuguguauuuuccuggauuuauaguaugugacuuuucugauuaauauauuuaauauauugaauaaaaaauagacauguaguug

SEQ ID NO: 21533 - RNA, 14288 nt, Homo sapiens
uaaaguuuauagaaauucuuuauuauuagacaaaaauagacucucuuuuuuccccuauucaugugauccuacucugaaucucugcucagaggaggcagugacucgcuccccaccccucucccaucccugccgugcuggcaccugcagcuggguggaacuggcaggggcugauccccuggagggcugacguucuccugcagguggggcugccugaucuccuucggggcucaacugcugaugccuccucaccccucacacacccaucucugccaucugcucacaugcaaggucaucuugugggccuguccacuuaacuuagcaggcugggggcggggaaggagagcagugucccaggccugaugcccacuccucauuccuaagggagggugcuuucuccugggucuccuggguccaggccaggggaugugagggcuguggggugcugggaggggggcaguguugaugugggcucugagcuuguggccuuccuucauuuucucuggcccaguagaacuuuggugaugaaggugacaauggcgccagcaggcugaucugggucaagcucugcaaagaggugacacacauucucccaggggcuucccggcuucuuggccacgaaaccaaagauccuagggggauaaaggguggggaaggggcuuaacauuccuuccacaagggaauguagcuggccuuggugagacaaaucaaaugccagcauugagaggacagcagcgcccuggucccuuggaaggaagaggcugaauucguggggaggcuuacuuggagguggucccgucuggguugguccaucugcagaaggagaagaaggugaagaugcacaccccaggggacagcugcugaaggggggccggggccggggcuggggcuggggcugggagcugggaccuggugggaccauggggauuuggggcaaaggguuuggagggagagucaccuccggucuugagggucagugcuggagaaggugaugcuguucacuggauaauggcggcgaaagaagagccugcaaggaggagggugaggaaggucacacucagaaacaugagcccccaggggccuuaagcaugggguucuacagggcugaguauacauacuuccuuugguuguccgucaguguaaugcccugggcugacaccuugaaguggacaacagcuggugucgggcgggggcuacagcucagagcugcagagcuggcccgggccacagcuugggggcccgucagugacucugucuccacugaggucaaguagagcacgcugcaggcuacaggggcagggagugggucagggagggagugcccauccccuagccacccccaccagcucuugcacauuccccagcuacugcugucacaugcuuuacaaucacauaggugacuuguuaaaaaggcagauuccaugacucuacuggaucuacagucagaagcgaggcagagaagccucccugcuaccaccccaugaucgucuuguucaugagacuuugagaaccuaggcugaggacccaauuccucauccccgacaguauggggcuccccugcccucauggguuggccagggcucacccaccucaaggccuuucagugccccaugcccuguauccacaaugcccccuuggugcccagggagagggaggggaguggaggggaagucucuaccagcacccugacgcaggaggucugccgcugugcucauguuggugggcacuggagccucuggggucucuuccagaggaucugagggcaaugagaaccgacagggaagcucagaaggcagaguguuccccaggcuggagcacucccucugcuuccccaagggaaggcggggagccaagaccucuggauccugcuuuggcugcaggggguagggagagguggggaggacagaugaccagacacucaccuuugcugggaaugcgcaggcagcagggcagggagaugggggagauggagugcugggagaccaaggcggacaggcugccugugggagaggagguaggaaagucccgagaugcccagggugccccgccuuucccuuccauccuccugagaucccuuggcaucucccuaaaccgacccaacguagccuuccccaggcuccugcuucucaccaaaguagggcucacuggggcagcccuugaucuucaccccuuugggcccagucucgaugaggaaauggcggaccagcuguuccacgggguccccugagaggaggcgaggggaagauugcggcuuuaggauuccagguuccagcuucuucccuaaugggauucuuucccgagcagcugaggucuuuuccuaccucuccccucuacagcggcauggccagcacagcacccccaccugcccuguuaccuugccucuggcaccacccccaacuucauccccaccccacucagguuuggguguucuguaccuuuccagggcugggcacuggguggcgguguggccaccuugagggccagcccauaagcuccuuggaaugaaugacugucccugaucaggaaggccccaggguccuuguccuucagcagggcaauggcugcagggugagggguagcgggcaguggggaggaguuuucacagggguggacugagccccaugcagccccccuccucugcugccaagcuccauggucucugcccugacagcugugguggcgguaagagucugaggccagggcucuagaguucacagggguuuugaccauguuggaucucaccgccuuggcccaaagcccagaaucaccugcugguaaacacucagccaagaguaaacacagcucagacaggaggagccaagagcuucaacaggaugggacuuaaagccaagacagacacccuggaaggugggaugcaguggggugggggcaggcuggcuucucaccuuggucacgggacagguguggcuuguaccagaacuuggauguauccuggacaaacuugacauugcuuuggcucucuuguguaggaggcucuaggacagggagggaguagguucagaccccaggguacccggguccccauccaugcuacaucccaggagaaaggguucucucaagguggcaccaacccccucaaggccuuuauaccugggguuugggggacauuaucugagagcagaggugcgaaggugacauggugacugaugccucuggcuggcgaugaugccugcucugggccccaggguccuggcuguugccccggcccgggcagguggcguuucucaggaagugggggcuggcuaaggccauuggugucauaggaggcagccagggggaaagcagguguaggugagcucugaggcggcucugggcuggccacaagccagggcaucugggaaggcacaggagugaggggagacccaucugggcugucgggggggccucgagggccuugccagggggcguggcggaggccaggaaguguggugggcacagggcuccgaggacuggcgccaucugaguggcccccuggacuccuuuccugaggccagucacugggcgagcugggagggaaggucggagagacugggcuaggggccagaggcucaggcccacuucccgacggcagcucaggggccuuuccggugccugccugggaaacagggggcaaggccucgccaggacucagucucugagugggcgcugaggugggggaccugguguccugucgccgggugcuguaggguggaagggcagauggucagcagagcccccauuguggcugcucccaccccaccugccuucaucaacugcuuggacaagaaagcacucgagcauccccggccccucugcauaccuuuccuugcccuggacuggacugcuggugugcaggggcguggagggaccagacaacucugacgaagcacugcauggggcaucucggggagaccgaggcagugugcugugcccacuggggcccucccuccaggacaccggcuccagcgacucugcagugaaggggagaggugggcugugagcaggauggggcucuucugucuggcuuagcuguuucucacccuguucccccuugacuuccccaccaucuuccagaaccuccucugcccugggcacuccgcacucuggugccccucaccugcagaugccaaagguccugcugaggccaggugcccaggcaauggguaccuguccccucccuccuccguagggaucucguagcucagcuuccuagauuguggauagggcgggcugcccggggaaauggagccagcccguggggagugggcaccagggcugggauacccucugcccucuccuggagagccacagcuaugaggcacacggccauaugcugggcaguaacugggaacugcuccuccauagcuguaugucaccagggcaggguacccuggaugcccauaccugccuucggggcacaugguguaggagcagcccucgugcccuuccucgccugccuuggguggcuucaggcagcuguagucaggcaucggggcauggugaugcccacaggcaggcaagagcagaggcagcgggugcccaggccgcacugggugcaggagaggcuugccagccucacuugcccacccuucuccagccucccucuccagccgcaguccauacaaggcugcuguaggcagcgccagcuucuccucgcaggcugggcauggguauagggcaggcagcccaggguccuccaggaugaccaccucccgguagccuggggcgcgguagccaaaguccccaguggcugguuuccccaucucagguggguagggguauagccccucugacagcgaucggcagaggcgccucuucuccaucgaggccucggcguagcccuggggggaucccucauagcccccguaggccagucgccuccucuccaggguucccucuggccgguaguagcccccauugggaaccccgcagggcucccgguagcccuggcggcaggagcaguggcggcugaggccaggccuauggccuggauacacuccgaggugggggccuccgcccacagugggcugcucuucgucaucuaggauggccgucucgcgcccagcuccccggcccccacuggccacuccgcagccuccuaggaggcgauccagcuccugccguucagcagcuguagggggcggccggccaggggacucagcagccggcucuguggucagcguggaggaauggccugagucgcugcugacagagagcauggggggugguggaggcucuggagagggugccgggggggucugccggggaggccgcugcaccugggcauaaggacugccauccaggggaccccgggugugggucaaggagccugaguggggaagaggaucagggagggagggcaagcggggaacagggagggagagagaaaauucaugagaggggauggcacuggagacagcugucgggccgggggugucucucgggagugggcucugccuggggaggagggagugugcuucucccuggcaccaccccccagggucccgccacaacccuguaccucccacccugcaggcugccugcgcaccauccacacuguccucguggugcugguugaaguucucauaggagucccagcgcacggcuggcucagugguguuguagucgacagagaccgaggggucguuccguggagugcugccuguggaaggccacucggguauuggggagcaggggagaggcggcccucaguccccagcccaugucccugcucuuaccuuugaucuucucggggcuggaggagaagacaaacuccacggaggcuuggaaggggaaccucucaucuauggggaguggacagugaagaaccaggccccuggcccauaccacacucuccugccugccugccaccugccugccaccugccugccaccuggacuccagccccaggccacuugucucagacucaccaguccaggccucgucaagcugguccuuggggaaagugagcugugguccguggauggugcagguguggaacuggacucggaacacgaggguccggucugugccccggccacccuugugauaacauguuaccugggagaaaggcaggaggcugcggaucaggccucauguccucuucugcgcuuccacccuggggacugccuggucacagcuucugcccugccucgaucucaaggugaucucccuacucgcucuccaaucugucucaaauuggugacugugccguuacaccaccaaccccugccccaucuccaggauucuucuuguugacaggaccccccucaccaugacaucgccuuugaggaggagggcuggcuccaggcugaugcaaagcugcuggggaccagggccugcaaugugacuguggggagagaggagaaggcagagaugaaccagaagcuccugcgugcagaggcagcuaugcagucagggggagccaggagaccagagucugagcccugcccaggugucuagggaggcuggagaagcaggaaugcaggagcaagaggggcccuggucaugaagugucaggggccugggaauagagcacucacuagacuccagauguguagacaagcugcauggacugguagauuuuaaggaagggcuggaagccuggaggggcagaggagaaggcacaggaggggugcugaguggagagggccugaaggugguucucccuagggagcacaucucaggcagacucaccugugccagguucaaaggcuggcagcauggggaugagcacauagugcaggaagagagggcugcuguucauucugauggagccagauagcagcccacugaaguagcugauauaucugguggagggcgugucaaggagaacauaagccuuuuccucuggaggucaccuuguaucauuucaaccauccacccuuagaaggcucgcucuucugcucaacacuuccuucccaucuuccgggucaccagaaaguucuuccuugcaucuaaccucaaucccuccugcuccccucugccucaaagcucuuuccccagagcucugcuucacuuuauaguggcaggcccugacuguccuucagguucucuuuaugacugaucuccucgucuauuuauucccaggucuacugccuuccacccuacuagcaugaaagcuccaugagagcaggggcuuuguccacuuugaauucucagcaccuggcacggcgcuuggcacacucagugaaagugugcugcaugaauaagagagucuuggccuugguagccaugaagggagcugcuccucuggcccauccccacccaggcugcucaccgacgcugggagggcugcaguucuguggccaccuuguccucgcagaauuuccgcaugguaagaguggccagugccugguccgcccuggggauagcaaggccaguguuggggauuagggauuaaucuucauccuggccucccaucccuaagccccaggggauggaggagaaauaugauucucuaagucuagaagaagcccagaguagugguaaugagaaugagaagcaccauguacagucacuuuacuaguuguugggccucaggcaauuguucccugaacuuuaguuuuuucaucuguaaaacagggcaacaaaaccaucuuauggguugaauuauauccccccaaaagacauguaccucagaaugugaccuuauuuggaaauagggccguugcagacauaauuaguuaagaugagaccauacugaaggaggguggacccugaauccaauaugauugguguccuuauaagaagagaggaagagacacagacagagacacacagggagaacaccaugugaugacagaggcagcgauuacagugaugugucugcaaaccaaggaaugccaaggcuugccgcccaccacuggaagcuagaaagagacaaggaaggauuccaucccgagucucagauggagcaagggccugcugacagcuugguuuggggcuucuggccuccagaacugugagagaguacauuuccacuguuuuuuguuuuguuuuguuuuuguuuuuuuugagacggagucugacucugucacccaggcuggaguacaguggcaccgugugggcucacugcaaccuccgucuccuggguucaagcaauucuccugccucagccuccugaguagcugggauuacaggcgcccaccaccacgcccggcuaauuuuuauauuuuuauauuuuugguagagaugggguuucaccuggccaggcuaguuucaaacuccugaccucaggugaccugcccaccucagccucccaaagugcugguauuacaggcgugagccaacgcacccggcccauuuccacuguuuuacaccacccuguuuguggcugccccaggaaacucuacagaccaucugcugcagacuauguugcaguacuagugauaaaagggagguggaagugcuaagcugacagcaaaggacucucaacgaagaggugggcuccaggggagauggguuccuaaggggccagcuggagaaagggccacuggggaagcagcuacucaggcgcugggagccucacccugcagagaucuugcuguagugcauguaggcagaaacgaugaccccaagcuugcccuuguuucccugacagacagagagacagggaugagggucugggagcuccaggcugaccuggaaccuccaggcaccagggaacccgagguccuggcccaccuugcaguauaguacgaccacgugcugugggucagcacugagccaugucuccauggcuuugcagauggagcacagcuuguccagggguggagcaugcagcucaggccagccgaagucuugaaccuggggagaaugcaggggugcaacuggggccgggggccaccaacagagagagaugggcaggguggaaaggggacagggcauagggguccgggggcaaggcugggggucugcugguuguccaugauagccucggcacuuuccuuauccauacaaugggcugauaccugcugcaucacguuuuggggugucuccaguaauauaucaugggagagugggaaagugcuuaagagugaaguagaugccaauugcuacuauuaauaacgaggaagcugggggcuucugggguugggguggcuugguuuaaugguugggcaggccauuuccuucauaccuugggguuuaagcgggucaggucaugccuuuucucugaaagguugaagagcugaaauaaagggggagggcuuuagacagaaaugaucuccggcaaugaggcacgagguggagguggauccuaaguaagaaucuuccucuaaaauaaggugcaggccggucgcaguaacucacgccuauaaccccagcacuuugggagaccaaggcgggcgggucaccugaggucaggaguucgagaccagccuggccaacauggugaaaccucaucucuacuaaaauuacaacaauuugccggguguggaucgcuugagcccuggagucuugagaccagccuggccaacauggcgaaaccccgucucuacaaaaaauacaaaaaaaaaaaaaaaaaaaaaaaaaaauuggcugggcgugagugacgcacgccuguaauccuagcuacugaggcugaggugggagaaucgcuugagcccggguggaggagguugcagugaggugagaucgugccacugcacuccagccugggcaacaaagugagaccccgucucaaaaaaaagguaaauaaauaaagaaaauaaaaagguagcuaaggcccggccuagccagucacagccaagucgccagcguuccaggauucuccgcuccgcuccaggccgcgcuccgggccccgcccccaccccaccacucuggucccgcccccuggcggccucgccuccgcuggugacgucagugauuagccucgcccaucuggacccuacaucccucucauuggcggacuccugauggccccgccccucaccagguacuugucccggugcuuggauugcagcacaugggccagcucgcgcagguggccccggugccgcuguucaucgggccgcgcggggaaggcggcggccaagaugcgcuccgucacguaggugaggucuaagucccagcgccgcuccaugagcggguccaggcugaagcuccuggggaggaggagccuacgcaugaacgcaggggcggggcacccggagguggcuagugugacgggaaggcugucuguugggcagcaggugaagccugcuggguccugaggguggguggaucggucuggagggagaauaccgcuuuggggguggggggcugucccggggagcucuguugcggggcagugcccugggcugagguguggggccggcggaaagggggucacgugggaccaccccagcacccucacuuaccugggcagagugcugcgcugcuuugagugguucagagauuugguggaucccuggugguuaacagacagugucuagacaucucuuuggguacccccuacucuagacugcccacuccagagccaugcccuuuuugucuucaggaaaucuagauccuuacucccaaagcuaccugcuucccccuccugcuccagcaucaccuuaccaggugcucuaugcgccugacuggggccguguuucgccgcuagagggagaugggggaggaaaagggagugguuaguuacagcaggggcaaggaccaaugugggccuuggggacaggggaagggaaugucaguguccuuuugaaggcuguacuggauaaggggagaggaguccuacccccagcaggcccaagggcacaagaucagcagaggacucagacaguuuuuucuuuccucauaggaugagcaauacccacagcacuccguucaaggucaucuccugggggcccucucuggagccaccagaccucuggacaccauggccagguuccuugcccuccccaccccaucccagagcgcacucaccaacuccacgggaggcaaggccugacaggcugaagucaccuggaaggggaccgaguaaggaacugagcuccuggugaagggcucucgugggcuugaggauggggcagccccucagcuucaggaggaagguggaggggccuucaguggaugggcacaggcuccagcugagguugcgcuauuuaagggcaccuccccucuggccucuuggucccccaccccccaggccccccacuuguugcucuuggcgcucagcccccagcccacacagacccccauucauccagcuguagggcaggaguuauauauagagccaagcaggcaggccauggccagggauggacacuggcuucuuucaccgggagaccccgccccugggcacacagcucccccaagccagcuccagggcccugggauccuccucccccuguccugaaggaagaggaccaggggaccucuucagagacagggcugucucagguccccaguggacagugggugcuauccacagcuuauaccuggaaaggcccaguuuuuccagggcccaggacaagacccgcccaggcauuuugaggacccuuccccagagggaaggcacagcccauccggcugcccagucucugaaauccugcucccccacuccccacccaccccacccuuccuccuccucauucuccuccucuuccccacccccauccucucgccagcugcagucugggcacagcaccaagacaaacgcugucuugcuguccacccgccugggcuggccagcccuccagaaggcggaguagggugguucuuaaagggcccaguacagcaccccucccacccaggagggguuccccaguggugagagggguggagguggaggguugaugccagugugguugcagaagccuguuugggaggaggaagggacuccagacccucucccccuaucagguagaaucagauacccaccuuugcuucacauuuucugugcgucgccaccuugcagacuagggaagguaaggggaggagagggguuagcaggggccugugggacaguggaaggaauggccuucccucaucucccagacccuggaaccagacccugggacuuccaagaucccaccuggacugggcuggcuggggcagaggagcagggcuagguuuugagggaagaguguggcagugggguacuacugcccaggccagggguaacguuccaggguggguggaggugaggaggaagagagggaaggaagacuaccgucacaagucaggaugggaaggugauggagaguacuggcucuccuggguuaugggaggugucugucauggggagccagggccaucugaagggggaggcagcugcuucuuagcugccauugugccuaauccaggagcagcauauuacauuugagauugugugagcuggccugcuggaguugugcaacacagugguacuggguggagggucucagagucacaggacagagagccucaccucugcacgaaacgccugucccaucgauggucaccuuacauacugcacagacuggagguuucuuccggaaaaccuucucccggaagcuaugaggcucagcuuuccuaggcugaagguggagggacaaacagaggugugaguucccagugggcccaucuccaucuccgggacugggcaggagccuugccuuagcacugcacugguuuucuccguccagaucaagcccucaaacuuguaggacgcacuuggccacagcugcuucagggcggucauggggccuguccucaacugugcauggaaucugaccccuugcgucaccuuugcugggucagcuccuccccaggggaucacuugggccccucacauggcccuggugugugaugcccuuguggaaaagccuccaugcucaggcuuucccccuggugugguaaggguacucccugacucuucccaucuuguccuccccgcauggagaccugugugcagagugagcagggagguuccaaacauauguguuguaugucaguccugcagcaccagacugagccggcaggaguggccucagccaguccugcuccuuuagcuccugcuguccccacgcuccaggcagcugacaugcccuccucccccacggucagaacaacauguuuacucauugugcacugaggcagcagacagcaauuguguaauggggguggucaugcuggagggaaacagauagaagccugucacuggggagagauguuuagcuggcuuuggaugcugugaguucucccccgacccccugcacccuggcacuugggauucacgcauugaaugagaaaggaguggaccagauucccuguucagccccuccugacccagagaugcagugaggcaggagccugggaugcccccuuauggcccaggccuaucucagucccuuccccucccacuguggguucucuccucccauccucugucuggggacagcuugucuccuugccaucucucuguuuuacccauauucccccuccucuggaguucagacuccugcuguccuccucccggggacccaucacaguaguaucucagguuguccugagcugcugcuuuuggggcaaggcugggaaguugggaaagggagugauggggaugugggcagcaccucugguuucuugacugucccugcaacucuucugggcuggaucaacuuugugggacccacuaagacacuugggagcauguuggcauuagcagcagauauggauguugucaguggaaagcaaaccuccaguuccaaagcacuccugacucccucuccucucucuuuuuccacccugccaccccauuucccucaaacuucccugggccagggaaggggccugaugaucucugagccugcuggaggauaccuggauagcgcauggcaaaguccugcagugaggcaccuggggcuuauguuggggggccaggaccuccugggguuggcccaggcuagagcagggaaggugagaggagccaaaacagacagcaggaccuacucuaacccaaacauccccucacacuacagcccuggccacuccggaggggaugcugggccagggaagaaggcugaggaagcugaaauugggaagaaggccuggccugauuccugguccccucccccacugcccgcaccuccaccccugccccucuuuugcccagcuggugggcacuccuacccugcuugcggcccggcugcugucccuccuccccagggcucugagcagccucuccacagggccgcuggacuucaugguguucggcuggcuggggugcuggccccagggccugaacaaugcuggggccuggcccggggcuuccuggaagcggccuggcggaggcagccgcuuccccu

SEQ ID NO: 21534 - RNA, 5007 nt, Homo sapiens
acuaaguggauugcacucccguccuccccuucuuccgcuccuccccacccuccagucccuccagccagcuguacagcucccaaauuccgggccgagauucccgggaacaaagcaagaaaaaucagagcaauuugggaaguaaacagaaacuggaaagggagagggaaagaagaguggggaggacccagguugggggggcccucuccagucccacccaguuuagggaaugccccugcccucucccccaccccccuucaccuggcucuuaaagggcccggccccuggccggcggcuacuuaagacagaggggcggcggcgggcagcagcugcgcugcgacugcucuggaaggagaggacggggcacaaacccugaccaugaccccccacaggcugcugccaccgcugcugcugcugcuagcucugcugcucgcugccagcccaggaggcgccuuggcgcggugcccaggcugcgggcaaggggugcaggcggguuguccagggggcugcguggaggaggaggauggggggucgccagccgagggcugcgcggaagcugagggcugucucaggagggaggggcaggagugcggggucuacaccccuaacugcgccccaggacugcagugccauccgcccaaggacgacgaggcgccuuugcgggcgcugcugcucggccgaggccgcugccuuccggcccgcgcgccugcuggugaguccgcgccccgccccugccccgcccacgugagacccgcguccuccaggcaggguccuggggagacgggaguggguggcccggcaagccuuuccgcccuggcccuugacgcuuccgacuuuggggggcacauuugugugggggagaaggggcaagugcaggaagcugaggugcagccaggggaccuggugauacagcagaaggugucugcgcucucggccuucuuuuuugcuccauuuauuuucccuugauggagugugcgugcaggugggaacuugggggaggcagggggagaaaugggaggguuuuagggccaucccaugggcuccagcaggcccagcuccuacaacccuagacggccaagcuggggaaaggacccaaauguuguucucagcuuccacuuggagaaaaggggaggggaaccccagacucugaaauucugcacacacugagaaaugacuccuuuccuccuaauaccgguguucgaagcaccuaaacaggaggcgucuagaaccgaagaggccccaaauccaggguuguauuagacuugaguagggacugagggcaggcuagggcguagguuaggggagaggggagaaagaguaggggaaagagggaaucugccaaaucaggguuaugauuuaaaccugcucagaaucguucacccauccuaccccacccugcuccagggaggagagcagaagcugagucacugggugggugggacagaagugaaucagccgugaaaacauggggggcagcggggagauggggagggcaggaaaugcaaacugcgcaucccagaggcucuggguuccuuccacgggaggggauggagaauucacuuggaguuucuuucaguuccaaaugcccgagugcaggcuucugggcguccuccuaaaagguggucuggguggaugagaggaggcaguuuggaacuaaaugguugggugcuaaauguagggaaugaaggagaaggucuggggaggggugggcauccugaggaagaaggaucagacucaggauugcaggggaaaugucuccuggguugugagugguaguuagcugggagcuugucuuuaggcacagaggaagaggaucccuucagggguucugauaucugauuagauguuaggcaaauuccaagcagucaguacaugcuccccuuucugccuuuuccugucccugacuuauuuccucaccccuucccaguccugagcucuccccggacccuccggaaacuuucuccagagccaggagcaaccugcagguuggaagccccucauuccuugcaccuucuuaaucugcccucagccuaucuugguuaaggguugaauccaugugcuccugggaccacugggguugagcuggccugggucacaggguaccagaagggagagguucccacugcagugccccagaaguaaccacaucucaggccugggagggguggguugagucauagcaaggucacagcagggacacacauuccuuuugggucccuguuggccccccuccuacauccguugcucuucugccccagcucuccggcuucgugcgcccccuucuggccucugguggaacagccaggucuuuucacccaaagcccaaagccccaaauaguccuuugaauuuguucuccauuuuuucauuuauuuuauuauuuauuguaauuaauugauugauuuuuaaauuaguuaauuuuuuaaaauuaaguaauuaguuaauuuuuuaaaauuaaguaauuaauuaauuuuuuaaaauuaaguaguuaauuuuuuuuaauuaaguaauuaauuaauuuuaaaaaguauuuauuuauuuugagacaaagucucacucuguugcccaggcuggaguacagugguccagcgucucacugcaaccuccgcccccccgaguucaagcgauucuccugucucagccuccggaguagcugggacuacaggagccugauaccaugccaggcuaauuuuuguauuuuuaguggagacgggguuucaccauguuggccaggcuggucucgaacgccugaccucaagugaucugcccaccuuggccucccaaagugcugggaugacaggcaugagccacugcgcccagccaauaauuuauuuauuuuugagacagggucucacucgguuguccaggcugaagugcaguagcacaaucauggcucacugcagucuugacuucuggggcucaagcaguccuccugccucagccucucaaguagcugggacugcaggugcacgccaccacaccucgguaauuuuauaaauuauuuguagagaugagguucucauuauguugcccaggcuggucucaaacuccugggcucgagcaauccucccaccucugcuucucaaaguucugggauuacaggcgugagccauugcacccauccucauuuuccauuuuugcuuuccaaaauucaucuccuuuauaagccuuaaaaaucaguaugggaaauacuggggaauauugucaggaaaaguaauauaacuauuugucagagaaagaaacuagggccagcaucaugcaacagcggggcauaaggcccucccuuccuuacuucagcaggugaugugggcaaggcccuucuccacauggcucugccugauuucugaccucuccuucuccuauuccuccuccaguugcagaggagaauccuaaggagaguaaaccccaagcaggcacugcccgcccacaggaugugaaccgcagagaccaacagaggaauccaggcaccucuaccacgcccucccagcccaauucugcggguguccaagacacugagauggugcguuuggagcugguagggagcaggaggggugggaagcccuggagacuuccaucugagacugcucccuugggcuuggagacgucuccauugucuguccugggugcuugccuggugggccagaagguuggaauggggagcugggcuggagcgguucuaagcugccuacucucccuuccccagggcccaugccguagacaucuggacucagugcugcagcaacuccagacugaggucuaccgaggggcucaaacacucuacgugcccaauugugaccaucgaggcuucuaccggaagcggcaggugagacuauuuuucuucuccuccugcuccagcagaaggcuccugccagggagugggggcggugcugcuuacaaagcugcauaaauaagacacugccccaucuuuaaggaucuuccaacuuuaggagaacauagagaauauaauuuauuaaacaaacuuagagaauaaucaaccacacacugugagagaaaacccacuuaaggaaugcccuaacucaguggcucuugaacuugaggcaucagaauccuccggagggcuuaugccacacagauagcugagccccaccggcagccuuccugauucaggaggugugggguggggccugacaauaugcauuucuaacauguucccucgugauccggauuugggaacgucacuuugaaaacuacuguuccaggcuagcagaaugcacacaauuuauugguugaagagggggaacuaaagagagggaacacugggccgggugcggugucucaugccuguaaucccagcacuuugggaggccaaggcugguggaucacgaggucaggaguucaagaucagccugaacaaccuggugaaaccccaucuguuuuaaaaauuacaaaaauuagccagaugugguggcaugcaccuguaaucccagcuacucaggaggcugaggcaagagaauugcuugaaccugggagguggagguugcagugagcagagaucaugccaaugcauuccagccagggcgacagagcgagacuccaucucaaaaaaaaaaaaaaaaaaaaaaaaaagagagggaacccccgaggagacgcucagguguuuuuacauccucagacucagauguccccucucauucuccugcuggaagccucuggccucacuccugaccugugugccucucucuccagugccgcuccucccaggggcagcgccgaggucccugcugguguguggaucggaugggcaagucccugccagggucuccagauggcaauggaagcuccuccugccccacugggaguagcggcuaaagcugggggauagaggggcugcagggccacuggaaggaacauggagcugucaucacucaacaaaaaaccgaggcccucaauccaccuucaggccccgccccaugggccccucaccgcugguuggaaagaguguugguguuggcuggggugucaauaaagcugugcuuggggucgcuggcuug

SEQ ID NO: 21535 - RNA, 5382 nt, Homo sapiens
uacggccuucucgagaagcgacggcggagggcccgcuccucccagaaggcggugcagccugcccgggcgagccacgcacgcagaggguuguggggcggauagcuccccuccagauggaggcucacgaaguagggugggcgggggacuccauaucccagcgugccccgcggcgggcccuaccggccgcgacuccgggcuuggccccggcccuagcucgucggcuguguauuggggcgcguggaggcugcagucacgguggcgcccgcggggacggaggagggaaugagugaagaggagcaaggcuccggcacuaccacgggcugcgggcugccuaggugagccgucucguaccgauuccuucagggcgaaaagcguggggccgugcggagggaguagcggcgcggccccagcaugcaccuggccugaggguuguucccggcaagcacuggggcagugggcagugguucccggcgugcaccggggcaguggcugcugccuccagcucuaaauaguuugggguuggcccgguucccagacugcacuggaacacugggcuuuaugcccccacauucagugcauuugguggguacuggguuccuggcuugcacugugucaggggguaugcacuuucaaccugcauuggggcacaggaucgugcccaccuuaacugaggcaggagcaaugcauucuuccccccuugcuuugggguagugggcccuacuuuuccagccugcaccuccacuuggaacccagccaauggaugcuagacugucugggguuccuuggacccuaugucccccauaaugugccuaggucugguauggaagugcuuggcuaggugggugcagagaggggaggugugaugugggucugugccccuucccccaguauagagcaaaugcuggccgccaacccaggcaagaccccgaucagccuucugcaggaguaugggaccagaauagggaagacgccuguguacgaccuucucaaagccgagggccaagcccaccagccuaauuucaccuuccgggucaccguuggcgacaccagcugcacuggugaggaaggcuugggcagccuggcuggggugugcauuugcagguccccauggcuuuguuucuuggagucucucucuucacaguccuuuucuccaaggccagugagggaaggagagauuucaggggaaaagcuacugacuggauugggagaacagggcuguaagaagguggguaggacgugggagaguuagaggagcgagcaggacucccacagugaucuggcagauccccaucacccuagaggaaaaguaagagaagauaacugaaaucccaguggaguauuugggggagugagugccuggcgugcugggcucuguucccggugcuuaaccaaauucccguuuaauuuuaaaccucagucuaaccaaugauuguaggugguaguauccgcccccccgacuccuccccccgcccgcccauguugaauaugaggaaacugaguguuugagauaguaaauggcuggugcauggucacaugccuaguauguggcagaguggggcuuuuacuccagagccuacccucucuuauuccagcucucuguauuuauugagggaaaagaaagugcuuugcaaaggaaauuaaagcauuugcgcucagaaguccacccaaggcguuugagcucagaaguccugcuuggcauggcuuaauucuggaagcuaacggaaagauaagggcucuuccuuccagcaauuagugaaacacuuccagucuucagcagggggagguuggucagaaggggcuugauugauucccucuggcuacgaggagagaggcugugggaugcugguuucuuucccguccuuucagugaccuccaguauugcccaugcccccucucucaggucagggccccagcaagaaggcagccaagcacaaggcagcugagguggcccucaaacaccucaaaggggggagcaugcuggagccggcccuggaggacagcaggugagggaggaaccgaggcaucccagaagcccuucaaggaacccaggcccugcaccacccacucugccccgaggccuggccaggugacacuuagccacccugaccuggccucuuccugagagucccucuggaccugaacaggguuuuccagggcuucugcugcuaugaagaauucuugggguggagggguugguuagccccauagagggguuguggcaguagguuggggccuggguuagggagggagagggguagaggcuugaggcuaaagggaguuacuccccaacauaccuccuuguucuagcaagauguccuuccuucacgcgcagguuggaguuuguugcuccucugguucuuggguacaaagauacccucuucucugagacucucuuuucucagucuuuucgccgguguuuggcagcaaaggauccgaggaggaagcuguugguugagccucccugauucuuuggcucaauuuggaaguucucuuaggggauugggaggucaggaggacgugggucccccaccccucucuucccccuauacaugggugugaaucaaaggcccccuuccccucgggaaguucuuuuucuccccuagacucuucacugccugaggacauuccgguuuuuacugcugcagcagcugcuaccccaguuccaucuguaguccuaaccagguaucuguguccccugacugccugagguggguggaggaagggguucugguuuuuggucccucaguccuuggacccaagcuggucaggcaugaggaagucugagaauaaacagaauggaauaguugggaaccagaacuugaagaaaucacagcagcugguaagcucuugggacaagaggucauuugugauuuucagacagccuuaugaaugauguccgaccauguuuaagggucuugcaggccccauuuucuucuggguugaccacaugucaguucuguguuugaggcccaucaggcacuucugggacuggaaauacagcucuucucccacuguccuggcuuagaugauacccaaguguuccagaauggaaaugggcuggggccuggagaaggccucccuugagugggagggggaaggaagccggcuagagcaggaggagcaggcuagauguguggacagacagcuccccacccgguggaaucgggagaugguagucaggaaucuaaaguagugguuagguuuggagcucaugggcaggcucagauggaacccuucaccucaacuuuggcccugugccuuuuccuucaggagcccccccauggaacugcagcccccugucuccccucagcagucugagugcaaccccguuggugcucugcaggugugucccauccucauuucccaugcaugccugucuucccuugagccaggggccaugagggaaggcuauguguguuugggggugggggcgguuccuuguacugaggcccuuuccaccccccucucuccuuccucucaccuagagucugaggcuccugcguggggaccagcgugggugugagaagccuuuuuucacucagccucaugcacccugugucucccuuccaaggagcugguggugcagaaaggcuggcgguugccggaguacacagugacccaggagucugggccagcccaccgcaaagaauucaccaugaccugucgaguggagcguuucauugagauugguaacugggcaagaagggguucucacaacuccucucccgcagcacucuggccccagccacaaagcagcuccuggccucacucugcuacacccccugcucucuuagcuucacagucccuagcucagccccuuccuuuuagcuucuuggcacccuauuuguccccuucucucuggcugaccagguucucacgugcaugggcaggucuugaguuccccuuuccaguugacauucuggggggacccucaauccaaguaugaccuggguggaagcacugggucuguggggaaucauaacccagcagcccucucuccacaugcagggaguggcacuuccaaaaaauuggcaaagcggaaugcggcggccaaaaugcugcuucgagugcacacggugccucuggaugcccgggauggcaaugagguggagccugaugaugaccacuucuccauugugaguggcucaugugggccgggcaccguggcccauccuccaugccagggcagggcuccagggacuugggucugugacucagcagugagccucucugggcccuaggucugcuucugccacaguuuuccuaccagacccaggguuccuggggccgacucagccuugacuguaggcccgcucuguagcucuguuacuggggugaggagggaucccuggccaucuggcccagggccugguaguuagaaggggccacccagggauugacuggggggaggcaagcuggaggaagcauucuuugugcuuuguucuccuuugacguugaaugucucaaugccugggucccacagucucucgcuucaucuuucucacuguucccaucuugacagggugugggcucccgccuggauggucuucgaaaccggggcccagguugcaccugggauucucuacgaaauucaguaggagagaagauccugucccuccgcaguugcucccugggcucccugggugcccugggcccugccugcugccguguccucagugagcucucugaggagcaggccuuucacgucagcuaccuggauauugguauggcuagcuggggagcgagccaggggauggugggggcuggaccggagcaaguagaagggggugaugauaacgugaacgcaccccuccccagggcuaccucccccaacauugccucccuccucucucuugcucuccagaggagcugagccugaguggacucugccagugccugguggaacuguccacccagccggccacugugugucauggcucugcaaccaccagggaggcagcccguggugaggcugcccgccgugcccugcaguaccucaagaucauggcaggcagcaagugaagccccagcuggacucauggaugugcacccuuugcucccugcucuuucugccucugggcucauguaucugcgcagcucugguacccucugugggugccaucucuaccucugacacagacugccugccuugaagcugagaaggcacagggcaaggagccaaggaccacagagccucagccagcccaggauccguccucauuuuauuggugaugaugaaugggaaugaaaucagggggcugucuacuagagccuggaauaaauaugcugcuuuguggauuuuuaagcccuucucuucuguuuccuugagcaguguggauagcagaggaggucaccacauuacuuuugugugccuucccugag

SEQ ID NO: 21536 - RNA, 24175 nt, Homo sapiens
ucuggucagugggggcacugggucagauuuauugcacuugcaacagaguuuaaauaaguccugggugucuggugccaaggugagggaaggguugggcagagagaugaggggcagcaucagugcagcuggcaggcagaacccaaauucugcaggcccaggacagugggcuccccuuucucuggggaacagggagggccugugucuggccaggcugagguuccagaucuguugccaucauggccccuucaggguccugggaaauuccuggcuucuccuaaaucagggugaacugggccuccaggaucaggucuggagcaggcccaaauauaguccuggaucugccuggauuaggugccaaugucugagucuggguuccagaucaacuccagaccccaggcuggaucuggccccauuugaguucugauuccccuuggagcugggcucugggcccugggccagcaucuauccuuguguggcaucuguccugagcugguccuggggcaccaugcauaguuaguguucuuuguuggcccaccaggguggggcuguccagagcugccaggucuuaacuccccaaguuccagguucuuagcugggggcuucuuuuggaucucuggcaaggcugaggacagaucuuugcagguuggagcuggacaggaaguccuuguggcaugucuggcccaaagaacugugaauggauuuccuaguuaucuuuccaaguuguuucaggaaacucuccaaaaugcaaaggcuucagggaggcuggggccucugucccuggaucugaguucccccauccaugaagaggguauguguaaacaaggguccuucacagugcaugggggggagggauccccagcuccucaccccccuggcucuggcccuucaaguaugucucugggcuggggagaggagcuucucccuggccgucagcaccuucaagaaguacccagaccccuccuuuucaguagaaugaggguggggggacugguucuucaggaaugggagucugaaauugggaggacucaggcaucagagguggcuggaggcuugagcugagcuuuuuccauggcggugccauaugggagggagcguuugaagaauccaagcugauaaaggggaaaagagggagaguuuagguacuauggcugccauuucuccacagcucuuauuccaagaaguaauaaggaggacucuagugccuccaaccucuacauccugcaaaaguggccucugaauucaggcuaggacuaccccucuaaguugugcaauggacccaggaggaccaaacuugggggugauuuuguaugggggguaucuuuuaccagugccuuuaaaauuccccaguuaagccagaaauggcagauagguuugaacucaaaugccaagucugauugcuuaguaguggcugcuucuguuuguuuguuuguuuuugagacagggucucacucuguugaccagccuggagugcaguggcaugaucauggcucacuguagccucaaacuccugggcucaagcgauccucccaccucagccuccagaguagcugggacuauaggcacgcaccaccaaaccuggcuaaucuuuguguuuuuuuuguagagacaagguccuaguguguuacccaggcuggucuugaauuccugggcucaagcugucuucccacccuggccucccaaaauguugggauuacaggugugagccaccacaccuggccauggcugccucuugagagagauucugaagccacuucuaggagaugaucaguagccauuucuagguuagugauggcugccauggauuuuuggagaaauugacagcacaaaugccacguauuugucaucuuuggguuccaaugauuuugcaaguauaggcaaacuuaucaucuugagucaagaggacccuuucuaagcuaggggcuauagaaugaagggggggaucuuauaggaaggguuaggaugggaugcauguagccaggacagaggugggggcacauggcuggugaacuggucuagagguagauacuugggacugugccaggucaagggcagagccugaugagaggguggccaagucacaagcaggauguggcugaccuuguagaggauguagaugaguagaccuaggagcaggaggccaaacaggauggcuaggaugaugauccacagugggacgccauagcugccuucugccuugguccauugcacagcuguggccaccuggggagcaaguugggugaagucaaugaaagcucagaaguucuuucuacccuauacuuggcccccacuugucauuggaucugcagagcccagugggcuccccuuucucuggggaacagggagggccugugucuggccaggcugagguuccagaucuguugccaucauggccccuucaggguccugggaaauuccuggcuucuccuaaaucagggugaacugggccuccaggaucaggucuggagcaggcccaaauauaguccuggaucugccuggauuaggugccaaugucugagucuggguuccagaucaacuccaccucuuauuuugaacuaacagcauucugaacuuaaaaauugaaguuccuaaaauguacaauauugucucuuacuuucgggcuuucauaucauauccauuuuuuuuuuuuuuugacagagucucacucugucacucaggcuggagugcaguggugugaucucagcuuacuacaaccucugcauccuggucucaagcgauccuccugccucagccucccgaguagcugggaccacagauaugcgccaccacaucuggcuaauuuuuguauuuuuuguagagacaggaucucacuauguugcccagguugaucuugaacuucugagcucaagcaauccacuugccuuggccuuccaaagugcugggauuacaggugugagccacugcgcucagccucauaucuguuauucaccucuccccaggauaucccuuuccugaauggcuagccugguuaguuccuauuuauucuucaggucucagcuugaacaucacuucuuccaggaagccuucccugacccaguuagacuggguucagguguuccuauuauguguuuucauaaauaucaccacacuuggaacacuguguuguuccacgagacugugaacaccaggagcaaagauaccauguugaucuugcuuaccacucugucucuggcaucugcacagugcuuggcacauaguacauucucaacaguuguuaacaauaccaaggccagcccucacccaagucccagcccuguuccagcacucugagcccuguauucccucauccaguccucuggcccuagacucaccugacgcucuuuuuggggcagcugccgaggcaggauucgguagggcaucuucagggcuuuguacacagccucacacugcaggcuaaauggcuggugcucccgcuguggguaggggaaaguugguuagcacauccucucuugggauccagaggacauaggguuccccaucgucuggcugggguugugaucuuucccuauuuugggcucauucuuccugagucucucucucucucucucucuuuuuuuuuuuuuuuuuuuuuugagacuaggucucacucugucccccaggcuggagugcaguggugugggcuuaggucacugcaaccuccaccuccugggcucaagcaauccuccugccucagccucccaaguagcugagacuacaggcaugugccaucaugcccagcuaauuuuuguuuuguuuuguuuuuguagaaguggaguuuugccauguugcccaggcuggucucaaacuucugggcucaagggauccgccaaccuuggccucccaaagugcugggauuacuggugugagccacugugccuggcccgugagcuucucuugauguuccuuauaugagauaauaaauguguaacugaauaauuguaacuugauaauauauaauuagaugacuacguguucaauaaaaauuuuuuuaaaauuauuaaugugcuuugacaccaggacagugccuagccugcagugugugcucaagaagugacugcucuuuacuauuccuacauguguuuaccucuccacuauggauucaucuuccaucuuacuguuuuucuaucauucuuugcacacuggucucccuccagcccucccuccucugaaugggccaggaaagggaagcugcugcucccacuguggccacuagauggcgccaaggacauacagccuggucuagacaagggcaaggaaggggagcuggagugcugggucccauucaccaaaggagagguggcuacugcaguggagaaaggggugggucagucuaagcaggcccaaaggucaggggucagggcugagguaaggcucccucaccugcaagaaagucuuggcccagacucggaaaugcaacugcagacuuuggcucucuuguuggugcaggggcccgagcucacagcgcagccugaaacacucagccuccgggcauuucuaggaagaaagaagcuugaaccugguguucugcccuugugauggcccugagaaccccagaguacucaacacuuugguccacaccucauucccugccugacuuaccaggaucugaggucccgaggaagcagagcugcggcuuggagcuucccguuuuugcugguggugcagggaacccucgggauccaacuauaaaagaaaguguugggccccuuucccaucucauuacagcuucuaagucagcuugcaccuggguuccagagcagcuucaaccuauucuuucaucuaucucuuuauugauucauccaacuguccaccuccuaugcgcaaggcacugagcucaggguuaaaauauggaaaugaggaaaacuugguucuuggagaucacacuggaggagaugcuuaaguaaauaauuaggucuguguuccuguuuuugcacuggauguucccuugguuuggaaugcucaucccugagucuuauagacagguucaaccuuaucuuucaggccucaguucagcugugacgucuucaagagguuuuucuaugauccaauuuaaauagugucccuacagcuuauuaacucuucacuucaucaccuuucaaucccuguuaauuuuucuccuucucuuuuucuuuucuaugucuaucacccuucacuagaauguaaguuccaugaacguggagaccuugucaguucuguuuggugcaauauuuccugggccuaacaguguucaguacagucacuuauuuaauuagauguuaaugaguaaaugaacuauaaaacaggcauucgggcccagaggaaaagguuugaagaaggcuuccuagaggagguggcacauaacugggcccuagggguaugccgggaaacaaagaagggauaguucaggcagaaagaaacacaguggaugaaaguccuuuuuccuccagaggauuuugagguaacuuugggccuugugacccucaacccuagcuauaggcacauccucauugccucuugcaggcccccagcaaccuuccccaaccccucagccuugguccucugaaucugcuccucuuccccaugccaguguucaggaucucaccuccaggcccuuuggguuaauggggugauugguggugcaguugagucccguaacucuggucacauauaggagcugcugaccuuccagagccuggggacagcugaguuccagcacacccuggcuaauggagcuggggccuugguugaugagcugaggagggaagagcacaaucaucaugagaaggaagggaaugcuucugccccauugagacccuggaucaccauggcuccacuauacccugcugucaggcuccuaucucagagaugaagcagggaagcaaugggcagaggugaaauccucucuagccaacacuuuuggagggggcuccaucuuucuuuccaagccacucaauuggccugucucuccucuggcuguuucucacaggacucugccucaugccuuugcauaucacuuacuccucccuccucucuuucucucagucccucacauggguuccagccaucugucacucauauuagcuccuccuuucccaucauucauucuggcccugccccuuccccccuuaccucauagacaugguggacagcaggucccagguccuccuccuucugaggcuggucucggggaugccagucgcuuacugggaauagcacugccucaggcuuggagacacuaaggaggagggugguuuagaggaggguggaaggaaccccauaugcauccuucccuagaagucuguguccccucucagaaagaccccauuuugccuggcacugacccguucagggugaccugggccugagccuccacggagagccgaaaggaaaccacgucgcuuugcgaguuguugagauucuugcugugggauggaggcaagacugaggugcuggagugcagccagugagaauggcgcccagcccucccuuccguccccagcucagccccagccuagacacacucacucccuaccugaggaucuggaagucaaacuggaugguuuucuuagugucccggagaugagggacuguaaaccgaaggccaccccacagcuggggacagaaaaagaggaaaagagggcaguuagacuguguauuucacccucccuccgcaccucacagcugugcucucggcuggcugguuaccgcccucaggucugcucucccucugucccauccucuuucaucccaaacuuacacuggcuccugccuucaugggguugcccaggucacacaccagcaggcggcucugguucacggcaaaguagucacagcucaggcuggagaaguucuggagauggggugggcacuggucagguuuugguguccccucuagagggguauccucccaaaucccacucgagagucucaucucaccccugggugucugacgaguccugaguacucagccucuggaggggcggugacccgaagcucagccucauaggcgccacccucacccacauucugggcauggaaagugagguucagggcauucuugucacccagguacacaugguucugcucccuggaagggacacagaggguaagggacauuggugaauuaauccucaaaccaggacaaaggaccauuauaagaguaguaauacgaggccgggugugguggcucacaccuguaaucccagcacuuugggaggcugaggcggguggaucacgaggucaggaguucaagacaagccuggccaagaugaugaaacccugucucuacuaaaaauaauaauaaaaaaauuagcccggcaugguggcaggcaccuguaaucccagcuacuugggacgcugaggcagagaaucgcuugaaccugggaggcggagguugcagugagccgagauugcgccacugcacuccagccugggugacaagggcaugacuccgucucaaaaaaaaaaaaagaguaauaauaaaguaacaauagacacugcuuacugaguucuaacucuauggcaggcacuaggcuagauuuuuuauguagauuauuucauuuaaucuuuccaaaaagucugagaaauaaaugcuacuauucccacuauacagacaaaggaguuaaagcucagagcagcucagcaacuucccaaggcgacacagcuaguaugucccuagcugauuuuuucaggugccaggugcaccuggagcucccuagcuuaccgucagcccuacuuacccaaacacuuccagcugcaggucaggcacacagauguugucuucuccacaguccagcaagaucugagccuggggagcagggcagccuugagaggggaaguuuagacccauuccugggcuguaggcucuucucuuuccauggcccugcccccccaauacccaggccucugucuucccaggucccuucucccugcccuguccucaccuuguccucuauccggcucuugcucugauaauguagggcuggccugaggccguggcuguccacuggggcuuggggguccaaggagaaguugagagcgaugugaaucggcgagaguuugucucgaaauucugacucguucuggggccagaggagagaguucacggagucaggggacucuggagacuuaguggcccugcuccucagccucucucaucucccuuugucugcuuagggcccaauuccgaccauccucauuguuucagaggcccuggcagccugcuucccagcuccucugacagaaggucucccuuucucagccccuacaagagucccaagcccuucacuggagucccccagucuuuuucccuucaggaggugcccucaguucuguguggccacccucccuggccaguccacaccccgcccucugggccauacccugagguagaucuucaucucucugcaauccucucgagccccauucuggaugagcagggucugggucaggguugccugccuggaggccaggaacagugcccgccguaccccucccuucugcuucugccaguccagcugaaguuccacugugaaaccugaagccagggacauauaaagggaaacugccugucuuuccucaucuuuucagagagaagaaauguccccagguccccagucccuucauucucuguccuagggccugagagauccaggcagucucccucaccaauggagucagcaacguguuuuccagaagcauugaggcagaagcuaagguugaugcuggagagagaccaagaagaaagcuggugaauccaacuggaacagacauccuauccucuaccuaucucccagccagacccagacuaggacaccaccauuuuccccuuuuuaaggcagacuuggugccccugcccacucccaggcucaggucucugcaauuuccugggcaccagcucaccaggccacaggguuccccucuaagcugcagcuccgcuccucuggguugaacauggcggggaagauggugagggaggcacuagcggacacgauggggcggccccugccaagagugaauguggggucaauagaauuaggacuccucuguaaccuggacacaggaaacugaugcccaagcgccagaauguguguccucugcauugauuuucccaaccucagcucuguugagaaauuuccaguuccaguccacccagguuguccccucaucucccuuuggagcucauaccuguauaccacagccuuguccacaccaaaggaccccacaaucagaucuguaagaagucaagaaaucaccucuuacagcaagccccagaucaggauccuuucuuccuaaccccuccugguuucaacgcucagggagguugaagugagaagacagcgcccucuguuggaauuagccagaacugcacccaggaacuuaaggaaaggugcagaagagagaguaggggucagugaccagggaauuuuaaggugaaaaggggccucaggcacaacucaccaggauauccauugccauccaggucucggccuccucgaagggcagagccaaagaagucugggguguggcuggcugcccacaggggcugcagaaccugggaaggcuuagagcccagcccuccugggcccccaggaaauacaaacacuacucccugcugggucuccccaccaaagggagccccgauggccacaucuggaagacacagaacacacacuagucagcaggccaggaauccaugggcucuaaucucuacuaccagaccccaggaccuaggauccuauuuuuucccaucugucagucccuauauucuaaucuucaaaucccaagacccagacagugggauuuuaaccccucgggaagucguggaggucuggguaucuuagcugacagaugcccucuccccaaaucccuucugacuugggccccugccuccucuuucacucucugagcccaugguacucaccauuguagccauccugguccaggucccccaggggggucaaggagcugccaaaucggccaaacucaucauggccagugaggguaagggugggcgugggcucuaugccggcugggugcugcagguagacguagacccugcccaccuccugaggccgcccgucagggguccgauccaugagcaggggugcccccaccagcaagucauccagccugaggggaagggcaaacccaggcaucucgauacccugucuugccaccccaccccaauccuagugcuagaaaucccggacacucugaauuccaucacgucagaagaccugaggucucugaucaucagcucucagcucuuuccuugucccugagcaaggggaaugcagguaugagcgagagucuagagaaaaagcccuggagaaacucuccuugcauuuucugucccauucccacucuucccucuugguucugggaggguaucacagugcgcucauuucccaccacucacccauccccauugacgucuguggcggccacugcauagccaaaguaggaggccaucuggggaggacaaaggggcagcgcugggucagaacuagaagguucaauccacaggaucaagaggggcugggaaguugggcugacauuauuaggucagggcuggggcuucguugacagaggccaagcuggggugggguugagggguauccuuaccuguuccccugagaaguuguagagggaucgaaugucugagccauuaaggauggugaccugggagaugaagagauaggcccauugguccuggacucccagaauaucccaugguuaaagaacagauguguacaggacacccaggggcaggcauuccuuagagacgcagaccacugucccuagcucccucuucagcuuugcccucauauucccaccucuaugccagguaguuccacccuaugucugcuucacuauuuuucucccuaucaaucaccaaccacugacagauuuuguauuuaucuguucguugucccucucuacccacuagaauguaagaucaauaggggcaggaacuugauuuuguucuuugcuuucuccucagaaccuaaagucaugcuuggugaguaguaggcacucaauaauaauuaugacugaaugugugcuggugccucaaacccaucacguucaaaaccuaagucauccucauccuccagucccccgaaccacaaacaccauuucuccccuauauucccuuagugacuggccccaccaggccucuugaauccuggugugagcccuuucccaggacugcuggacagaugucuugacaaugucccugccuccagcucucccagcagaucuaggaggcuaccucuggcuuggaaauccaguggcccccugcagucacugcccaaagucucaacuucuuggcugguccuccaaagcucuggagaaucuggcccuaaccuaucuguuuuugcucaaccuuuccauauucuacucauccucaaucagcucaugagucugcuaaguugggcugaaauuguuuccuuuucuuccaccucauucaugcuccugcacaggaugcccuccugccucaucucugcugaaccuucauagaaccuucucucaucuguccucuuccuuuuuaaaaauuuaaaauuuuuauuuccugacuccccaaacuuguuaccauccuuuuccuagaaaggagauuauucuuuccccuaaacugcuaugccacuguauccacuuugcugaaguuuaccaaaaugcagaaagaaugcugauuuuggauuaagagagaccugauuuuaaaccuacuuacuaacugggugaucuuaagcaacuuacuuggucucuuagaaccucaguguucucauaugcaaaauacagaugauaauaucuaccccauaggcuuguugugaagaauagaaaucaugaauagauagugccugaugcacugaguagagaaugaauaguugcuccacuuuagaucauaauuguaugugugucuuaucuaacauacuugauuagaagcaucuuauaagaugggguaugauaccuuauucaucuuaucucuuaccuugccuuaauaaauguuguuaauugaaugaaauccgauggcacucuuaucuguaucuuuuaaaaagcacuuguccuggucuaauaauaacaucugccaguuguacauugccuaacaauucacugaguacuuucacaugcauuuucucauuucauccuugccagagccucgugaggucagaacgauuguuaucccaguauacagagaagaagaaggcucagagagguucagcaggaagcagaguaugaauaaagagcagaaugauucugccagaguaagugccagaacuugaaugccagucugccuccagagcccauguucugauccaccuuuuugagcccuugcaaacugccaugcacgguucuuugugauuaggcaggggaggagaggaagugaggggucaggcugggucuuacauagccguaagugagguucccuuugggcacaccagcaacaaagucugcaaagagaagagaaaguugugaccuaaggguggggaaagggaagcagauaaugguaaguggccaaguucaugggcucucuggcccugugccucuaaccaucccccucccuuggccccagccuggggacacacucaccuucugugucaucaccacugaauucaccaacagccacagaguauccugggggacaggguggguggauguuaggauuccugcuuugaggaccccucugcucuggccuauccaccaaucccuuccccaccccuacugggccuucauagucagcaggcacaugacaaguauggcaggggugcuggggaugccugaguaggagaggggaggcgagggggugaguggggacaggagcacuugagguucucccucugccaucccuuccccacuugcuugcucaccuagguagcugucaucauagauggaacuggccuggcgagucugcagcugccccugaaccagguugaucagguacucgggguaauaagauucugcaaucugcuccugaguggcagacaggaucuggccuggagagaguaugaagagggaguagauggagaggaaguggcagagggggcuugggacucugggggcugacuggguaguauuucagaagucugguucaagaaagggaagcauggggagggugguggcauguaagcuucaggaaaggaagaggagaauugggaguagggugggaggcuaugugccaggggacuuaaagaauggcagaaacaggcagggcgcggcggcucaugccuauaaucccagcacuuugagaggccaagagggguggaucacgaggucaggaguccaagaccagccuggccaagauggugaaaccccuucucuacuaaaauuacaaaaauuagccaggcgcgguggcaggcgccuguaaucccagcuacuugggaggcugaggcaggagaaucgcuugaaccugggcagcagagguugugccacugcacuccagccugggugacagagugagacuucgucucaaaaaaaaaaaaaaaaaaaaaaaagaauggcagagacaggacuuaccuugccagaaauagcuuccugguccaccuaaaaccacacggccagucugugggugaaaggaggggaguccaacaucuggucccaauccccccauguccaccacccacggccccuucucucccagaccacucucucaccuuggugaacucggcacugaagccuccuuggcaguaacccuguccugcugcccagcugaaaucugugaggggagaagguggugaaaaugagcccugcauagaugggucauccaggaaagaagagagggcauagggaaggaggugggagagagaaccagagaaagggccuuccuggaccagacaguaagcauaaaggcuaacgaacuggguuagccuuuaucuuaagcaaccuagaaccucaugggggcacaugguaggugcgagucaacccuaaguaugugagacacuucaaguauaugagaaggcagacauggggcacaggcccccucuugccccuaccugagcggcagggugcauacuccagaauucgggugaaguuaucuguggagagguagcaggugcccacggggucgcucaguggcuccuucucugugcgccagcuguacaguggagcgcaugccugggagggcccaggaggaggggccuucagauucaguccaauaaggcccuuccucccucccuccaggcccggccuuacccaaccacugcccauccccuggccaccacaccacugagcuugcuggccccucaccaagauggaggagccaugggcucgaacuguugccccgaaccacugcaaggacuuguacuccacaggcuccucucccucugagcuggacagugaggacuccaggagccgagagccuuguggaagugagaagggggagucuuacugagccauggacauuugagcucuagggcagccccuacccucagccuggggauacccaacaaacgcuuccaagcccugagacuccaugacucgcugggaguguggaauugguaaggagcuuaauucugcuuuguguagucuguuuguguagccugacuuaucucuccacuacacacauacacauacacacacacacauacauacacacgcacgcacacgcacacagaaccugggcuuucuuuuuuuuuugagauggagucucacucugucacccaggcuggagugcaguagcaugaucucggcucagugcaaccuccgccucccugguucaagggauucuccugccucagccuccucaguagcugggauuacaggugcgcgucaccacaccuggcuaauuuuuguauuuuuaguagagacgggguuucaucauguuggucaggcugaucucgaacuccugaccucaugaccugcccgccucagccucccaaagugcugggauuacaagcgugagccacugcgcccgcguagaaccugggcuuucuagaguugccuccccaagguuccugcuuucucacccaacugagacaaggaugccugcuguggagcaggggcaggaggaugguggggaacaguggcuauuucccaagagaguaacccuuuggcugcacuucuuugucuauacuuggacugugucucuaacaccaucuuguuccaccuccuuuuuuuuuuuuuuuugagauagggucucacucuguugcccaggcuggagugcaguggcgugauuauggcucacugcaaccuugaccuccugggugcaagugauccucccacaucagccccccaaguggguggaaacuauacccaacuaauuuuuguguuuuuuguacagaugggguuuugccauguugaccagguuuauuuuaauuuuuuuuuuuuuuuaaacagggucuugcucugucacucaggcuacagggcaguggggcaaguagcacucauugcagccuuggcugcagugacggagaaucacucaagugauucucccaccucaaccucccgaguagcugggacuacaagugcucaccacuaugccuggcuaauuuuuuuuuuuuuuuucuugagacagagucuuucucuguagcccacgcuggagugcagugacaugauuucagcucacugcaaucucugccuccugaguucaagcaauucuugugccucagcuucccaaguagcugggauuacaggcaagugccaccaugcccggcuaauuuuuguauuuucaguagagacgggguuuugccaugauggccagucuggucucaaacuccuggccucaggugauccaccugccuuggccucccaaagugcugggauuacaagcaugagccaccacacccagcucugucuaauguuuuugguagagacagggucucacuauguuggccaggauggucuugaacuccugggaccaagugauccuccugccucggccucccaaagugcugggauuacaggcacaugccaccgugcccagccuguccaguuuuuauuucuggagacagauggcccuaguucauauccucucuccaauguuugcuagcuguauaaccuuggauaagcuacuuacccucugucuccucacuuagaaaauggggauaauaauaccuuauacaguuguugaaaagauuaagugaacuaauauauguaaaguguucacaacugggccuggcacagagcaacugauagcuguuagucuccaucuuccucccauccaucugugucuacucagaccuugagcuccuugagggcaguggcuuagucaucuuucagucccugcagcaccagcacagugccugucaugcacugucacuuagucaguacuuaguuaaaggaacugaauaguuugugcaacauucccugucuuugucuguguuacggcccuggccucccagaauugugggugauucaggggaaaugagagccacauguuucugaaucaugcccguccuccuugggcugggcuggaugggagaguggagugagugccauggggauccacuguaagcaguuggagcaccagagcuggugcugagaggucacguggccgggguuccagcaggcuccaccccucgccccaggccccacccaggccuugcccccaggcugcagucccaccccccagucccucccugaauuucacuggccuaccuuugcugucaaauucaaugggggugcacuguguggggcuggcaccccaaggacagagguagacagcaccacccugcagcacuccuggcuggcugguauuagccuugggugcucccaccagcacacugacccugugggggggaaaagcgaggcaguugaggauggcuccuagcuuuucauuggugucuggaggcaggaaggacccaggccucuaggcuggggcuggcuggggguggaguagaugcccccugcguuguauuuauaucucagaagaugccacagaugccagaggcacaggcuggagucaggcgguccccaugugccgcugucacuaacacaacccuccccuccucccgccauucucuguccucuccuaccuuauccuguucauaaagagaggaggaaccacagucaauuucuagaaggggaagaggggccagagccuguaccccuggcuucucccucuccucuacguaccugcugagauuagauguauagcuucuggagcgccaagguccuguggagccucagggucucucaucuagccuauauacucuccucccaagccaaauccccucccugggccaagacccaggcauccggcugcccagccacccagccuuggggcguguaggaggaaaaugugagucuuggaaaucaggcagcaggaguggagagaggagcuggaggacagugaaaacagauuguuccacugggccugggccugcccucaccccggcccuggugugggccuccccuuccuggcugggucuguguuucagcccuugaaccccuuucccauagaccacccccagcugacugaauucagagucugcucuaccggggucccaguucuggacacagugcuucuguucccccugauaugaggggaaguuugcccuguguaaugggguggucauagcuaagggccugggcaguccuccugccgucagcucugccucauucaucccuaggucucuugccuccaagaccuccacaccgcucuuggcucucuugguuuccccuaagggucuccugccaggacuuguaucuggcagccugggcaacucgacccagccucuggaccagugcuccugccagccuuggccucugcucugcucugugucugccucuggcacugcuucucaaucccucugucccucugccccuaugacugcuugcucucuugguuuugguuuuugaauccuaucucucuaucucagauuuuacauuucuccaucucuauugguuucuguucacuuucagcuuucaacccguccaauaccuacccuuucccugauauuugaauaccuuccucagcuuucucacuaggcaagaaggcccaaagugaaggauuaugguagaggucacaagagcuggggguauuuuccaagaagaccagguauacugaggcggggaggaguggcccaggagguauaggggauggaagcagcagagaggacagguccgaggggacggaagaggagagugaggaggggucugugagggccaguggugagaauggaggggagagaaggcaggguccagaggaauaggagauggguaggcugaagagggagagcuccugaaguuaggagggguggggaggggaggugccagucuccguuacucuggggacaggaaauguuuacugccuguggcuuccugucuguuuccaaccucucacuucuccguuugucucccacacccccaccuccgugccaggccccacccuucucacuuaggcaugacauccacuuguggggucuggcugcaccgcccuagggcugggugaugugagagaaggagaccccucucucagcaggggcagcccccagagaacuugguugcugccuucaggcucuagaaagcagaaagggccaccaaccugaacuagaccagaacagcagagguacaggaagcagugaaaggagcacuggaccaggagccaagaguucugguucaggcacuaacuguggacuugggcaauacccucucccucuuccucugggugaagaagagguucucucaaaguuuccuggagcacagggcuaaggccaagggacccuauuccugcugccaauuucuccaacacccacugcucuuggagaggagcugagccugacacuccugggguggccugaggaaguagccuggaguuuagcaggguugcaagacagagaguuuacaaagcuuguaaagcccacaagccaggggcauauccauuccggcugugcgaugguucaggauaccuggcaugcaggcaagggacacagaccuaggccuccuuuccucccggcacacuacccauggcuuauuccuggacaggcaguggcccuuccaucccagcaaccuaaagucaauccaauaaauagugccuccccugccaacacgccaagugaggugacuggugccauggauggcaugcaagcuaguuuguccuuauuuucccacaucuuuuuccugcuuccuaaauccugcagcaguugggcacuuuuaggggucuaagaagguaacaauggaggguccgugugcuauuuucaauauuucagaaagccuaacggaaaucaugcauuuaccagauaagguggccuaggcuaauuaaaaccucaaguguauuugcuuuuggcuggaauuauaucaacuuaugugggaaccugguuaucucaugcuggucagaaacucugauuggcagcuauagauguuuuugguuaauaaaaaaugagaaaagcgccaggugcgguggcucacgccuguaaucccagcacuuugggaggccgagacgggcagaucacgaggucaggagaucgagaccauccuggcuaacauggugaaacuccgucucuacuaaaaauacaaaaaaauuauccgggcgugguggcgggcgcuuguagucccaccuacuagggaggcugaggcaggagaauggcaugaaccugggaggcggagcuugcagggagccgagaucacgccacuacacuccaguccagagacagagcgagacuccuucucaacaacaacaacaacaacaacggccaggcgugguggcucacgcuuguaaucccagcacuuugggaggcugagacaggcagaucaccugaggucgggaguuugagaccagcuugaccaacauggcgaaaccccgucucuacuaaaaauacaaaauuagcugggcgugguggcacaugccuguaauuccagcuacucaggaggcugaggcaggagaaucgcuugaaccagggagguggggguugcggugagccgagauugcgccauugcaucccagacugggcaacaagagcgaaacuccgucucaaaaaaauaaaaaauaaaaauaaaaagaaugagaaaaggaauucauuauuucuuacuaaaugcagguuggcagguacacuuuucugaaauagagucugagagaagaaauaacugccagaauuuauucugaagccucagaaauggaaggguugguccuuggagacacagacuaccacagcuagaaggcacuguagagagcauccacugguuuuaagacuucacuguaggugccugaggccacauggcauaaaggcagacuggccucguucugacacucccuaagaaaaaguucaaagcugcucaccucgucccauguucucauucugcagaugggaaaacuaucucagaggaguuaaguaaugggcuuaggucacucauaaucccucccagaauaugaagcagaaaucaggaauccugauuucuacgacagcauucuagucuaccccauugccaacuuauucccuccucucauaucugcuaucuccccagcuuuugauuaaccaagucccaguucaauacuggguuacuguuugacucuguuggccugacaaggucagggguggagagcagcaaguggaccagcgcccagcuccuacagguccuacagcagcaugggccaggccagaggaggacaccugguuugggguccccuagugcauucacaagggauauguaugauuggcuggggaagaacagcugucuccacuuguggcaguugcagaagggaacaaggagcugagcugagacuggccugccucucaagcuuucaaguguccugggccaagucacugccucucuucaagcuuuggauucucuggcauaaaaugauggauuucccuugaauguuuccuaaacuaacuucugguucaaaauuucuaugacuccugaagccucaguuguuuuuauuuuuuguuuguuuguuguuguuuuuuugagauggagucucacucugucgcccagucuggggucgcucaguacagaugugaucucagcucacugcaaucucugccucccagguucaagggauucuccugccucaguuucccgaguagcugggauuacaggugcgugccagcacgcucggcuaauuuuuuuauuuuuaguagagaugggguuucaccauguuggccaggcuggucucgaacuccugaccucaggugauccacccaccuccgccucccaaagugcuggcauuacaggcgugagccacugcaccuggccagccucaguuuuuguauaucuaaaaauggggcaauaaugcuuccuuugcuuuaacacaaggauuuuuguuacaauccaauggaaaaaucgauaugaaagugcuaaaggaauaugacagacuauuguuacuaucacuaguauaagcaaauacucaaagcaaguaagaaaugagggaacuaggcgguagccaggaaggagagaaccagaaacagaaacagcuaccccauaaaaaccaugccgcccauguauugaucacucucuguggaccagguuccuuuuguauauguuuucucauuuaguccucagaacuccguuagucaggugucugauuuucacgggaagaccaggcuccaagagcuuaaauaccucucccuagguacuaggguaccacgcaaaaaacuaguaaguaguggggacucacaccuaccucugucugacugaaagcuuugcccuuuccuaccaucuaacugcuuuggugcucgcccuguccuuuaauacuauuuugguguucaccacaagaggugaugcaggaagaacaagaacacugaggcucucccucuuuggcaauggcuguaggugaggggcuguguuugucuuguguugugggaaagggggugaaggccuagcuguggugggaggaggucacuggggagguagaauguuccacuguaagaggguauuguaaauaggaaaugagagggaaggagugcaagcuggacaccuggguucucuugggaggggagaugagcagaaggggagggggaagggaugagagagcuagguccuguuuuagaagaggacuuuagggacuacaggaucaggccaggggccagacagacaccuaggggaccaggaaugugugaaguccagauguuuuagaggaguguuuuaaagggaaauuuaggggaggggggaguaaagagaagguuaaaugccagacaacuagauacucugaucugcgggaggagaccucauccccuuccuccuucccucuuuucuacuccauuagggcugugauaagaaguuugagggaaccugggggagaccaggccuggcagaggcuccaggccagggugaugaugcaaugggguuugggcaaaaggccaggggggugggguggggguuggguggggaccuugaauagcccagaacaacagucggggccuaaucauuuuucuuuucucccauccccaaguccuccagacaaaggagaauuugccuuucuccccaguuguauuagcuagauuaaccccuuuucuccaaaaacuauagggacugaguagagaucaguuaacugucucauguguaaaaacaggucgcuucugacagaauuccccucaaacccugagauccugggguuggggugggggugagcaguaggaagcucccagcucagagauguagaagaaaaaggauuacaccagucauuguggaggaccaggaaucuggcaucuauggccuagcccaggagcaaccaccuaccucucuugcuucccaaucuccccgccaucccacauuuaaacagacacccuugguucuaauguugcuuccacucuaacuccuguuucccaagccugucaguaccccauuuucuaggcacucgggguccgggucugcuuaucacugugcugaguugggaauaaggauccuccuuugagauuuccaggguccugaguccuucauucugacguucuuggccccacggagcccccgucuccccagcuuccgaccccagccccagaagucccggucucagcacagcuccagccgaccagcuacaggaaaccagcuuuucucuuccucccaagagccagaggaagagggaaaccgcccaccccccuucacgcgcgcacacaccccucccgacacaucccagcacccgcccuuggcugaguucgcccccagccccagggccccagugccaggguccccgcacucgcccccaguucucggauccccucgccugaacagagauugggggcggagggaggaguaggagacagaggagaaaggagagggagccgccguccucucucgggucuuuccccggucugaguugaggggggaggggaggaugaggcuggcccccauuuaaccuuccgacccccucagucuuugacuuuccuccuacuacacguagcucauucggcuucuacccguucucucgccgcacaauggccccuacggaucccgaggucuccuggagcccccaaaagcccuucccggccucugcgcccccucugcgcccccacccgccccaggucccagcagcccacagacuucagccagagacccucagcucuccauucacgcgcucuccucucccuuggcccggagaccccugcccagacuucuccagcuccguguccucuccccaccggacacaugucuccccacugaucucaaacgccagggccccuccucacccgccacggugcccucccuacuccagcgcgggcccccaacucuagccagggcccccaacugcagcucuauuccuuacaaacuccacccucaaacuuaagcccugguccccuccagaccccagccgcgcccccagucuccaggcggcucccccacccccaucccgucuccagcccuccucacucacccgucuguucccggccgguaaaacuccacugagaauccgaagaaggagcccgggggccccgagaguacugcuggggccuccgcgucuaaguugaagcccccgacccuggguggcggcggcagcagcagcaacagcagcggcagcagcgggggucggcgccgggggccccagcgcagcugcacggcguggagaggggacucuggcguccggcuccccauagcgcccgcucuucccuguccuggggccaccgacccggagccgcuuccuaaaccucccagaggcgaaugacucaacgcggggaggaguuugccaaacucccggcugagcccuccccccgccugccgagggggcuggcgggggggcauuccugggucccuggaacucugagcccgcgucccccaccccuaaggggcguggggggggggcgcaccccuccaacccccuuuccccagccccagcugg

SEQ ID NO: 21537 - RNA, 24175 nt, Homo sapiens
ccagcuggggcuggggaaaggggguuggaggggugcgccccccccccacgccccuuaggggugggggacgcgggcucagaguuccagggacccaggaaugcccccccgccagcccccucggcaggcggggggagggcucagccgggaguuuggcaaacuccuccccgcguugagucauucgccucugggagguuuaggaagcggcuccgggucgguggccccaggacagggaagagcgggcgcuauggggagccggacgccagaguccccucuccacgccgugcagcugcgcuggggcccccggcgccgacccccgcugcugccgcugcuguugcugcugcugccgccgccacccagggucgggggcuucaacuuagacgcggaggccccagcaguacucucggggcccccgggcuccuucuucggauucucaguggaguuuuaccggccgggaacagacgggugagugaggagggcuggagacgggaugggggugggggagccgccuggagacugggggcgcggcuggggucuggaggggaccagggcuuaaguuugaggguggaguuuguaaggaauagagcugcaguugggggcccuggcuagaguugggggcccgcgcuggaguagggagggcaccguggcgggugaggaggggcccuggcguuugagaucaguggggagacauguguccgguggggagaggacacggagcuggagaagucugggcaggggucuccgggccaagggagaggagagcgcgugaauggagagcugagggucucuggcugaagucugugggcugcugggaccuggggcgggugggggcgcagagggggcgcagaggccgggaagggcuuuugggggcuccaggagaccucgggauccguaggggccauugugcggcgagagaacggguagaagccgaaugagcuacguguaguaggaggaaagucaaagacugagggggucggaagguuaaaugggggccagccucauccuccccuccccccucaacucagaccggggaaagacccgagagaggacggcggcucccucuccuuucuccucugucuccuacuccucccuccgcccccaaucucuguucaggcgaggggauccgagaacugggggcgagugcggggacccuggcacuggggcccuggggcugggggcgaacucagccaagggcgggugcugggaugugucgggaggggugugugcgcgcgugaaggggggugggcgguuucccucuuccucuggcucuugggaggaagagaaaagcugguuuccuguagcuggucggcuggagcugugcugagaccgggacuucuggggcuggggucggaagcuggggagacgggggcuccguggggccaagaacgucagaaugaaggacucaggacccuggaaaucucaaaggaggauccuuauucccaacucagcacagugauaagcagacccggaccccgagugccuagaaaaugggguacugacaggcuugggaaacaggaguuagaguggaagcaacauuagaaccaagggugucuguuuaaaugugggauggcggggagauugggaagcaagagagguaggugguugcuccugggcuaggccauagaugccagauuccugguccuccacaaugacugguguaauccuuuuucuucuacaucucugagcugggagcuuccuacugcucacccccaccccaaccccaggaucucaggguuugaggggaauucugucagaagcgaccuguuuuuacacaugagacaguuaacugaucucuacucagucccuauaguuuuuggagaaaagggguuaaucuagcuaauacaacuggggagaaaggcaaauucuccuuugucuggaggacuuggggaugggagaaaagaaaaaugauuaggccccgacuguuguucugggcuauucaagguccccacccaacccccaccccaccccccuggccuuuugcccaaaccccauugcaucaucacccuggccuggagccucugccaggccuggucucccccagguucccucaaacuucuuaucacagcccuaauggaguagaaaagagggaaggaggaaggggaugaggucuccucccgcagaucagaguaucuaguugucuggcauuuaaccuucucuuuacuccccccuccccuaaauuucccuuuaaaacacuccucuaaaacaucuggacuucacacauuccugguccccuaggugucugucuggccccuggccugauccuguagucccuaaaguccucuucuaaaacaggaccuagcucucucaucccuucccccuccccuucugcucaucuccccucccaagagaacccagguguccagcuugcacuccuucccucucauuuccuauuuacaauacccucuuacaguggaacauucuaccuccccagugaccuccucccaccacagcuaggccuucacccccuuucccacaacacaagacaaacacagccccucaccuacagccauugccaaagagggagagccucaguguucuuguucuuccugcaucaccucuuguggugaacaccaaaauaguauuaaaggacagggcgagcaccaaagcaguuagaugguaggaaagggcaaagcuuucagucagacagagguaggugugaguccccacuacuuacuaguuuuuugcgugguacccuaguaccuagggagagguauuuaagcucuuggagccuggucuucccgugaaaaucagacaccugacuaacggaguucugaggacuaaaugagaaaacauauacaaaaggaaccugguccacagagagugaucaauacaugggcggcaugguuuuuaugggguagcuguuucuguuucugguucucuccuuccuggcuaccgccuaguucccucauuucuuacuugcuuugaguauuugcuuauacuagugauaguaacaauagucugucauauuccuuuagcacuuucauaucgauuuuuccauuggauuguaacaaaaauccuuguguuaaagcaaaggaagcauuauugccccauuuuuagauauacaaaaacugaggcuggccaggugcaguggcucacgccuguaaugccagcacuuugggaggcggagguggguggaucaccugaggucaggaguucgagaccagccuggccaacauggugaaaccccaucucuacuaaaaauaaaaaaauuagccgagcgugcuggcacgcaccuguaaucccagcuacucgggaaacugaggcaggagaaucccuugaaccugggaggcagagauugcagugagcugagaucacaucuguacugagcgaccccagacugggcgacagagugagacuccaucucaaaaaaacaacaacaaacaaacaaaaaauaaaaacaacugaggcuucaggagucauagaaauuuugaaccagaaguuaguuuaggaaacauucaagggaaauccaucauuuuaugccagagaauccaaagcuugaagagaggcagugacuuggcccaggacacuugaaagcuugagaggcaggccagucucagcucagcuccuuguucccuucugcaacugccacaaguggagacagcuguucuuccccagccaaucauacauaucccuugugaaugcacuaggggaccccaaaccagguguccuccucuggccuggcccaugcugcuguaggaccuguaggagcugggcgcugguccacuugcugcucuccaccccugaccuugucaggccaacagagucaaacaguaacccaguauugaacugggacuugguuaaucaaaagcuggggagauagcagauaugagaggagggaauaaguuggcaaugggguagacuagaaugcugucguagaaaucaggauuccugauuucugcuucauauucugggagggauuaugagugaccuaagcccauuacuuaacuccucugagauaguuuucccaucugcagaaugagaacaugggacgaggugagcagcuuugaacuuuuucuuagggagugucagaacgaggccagucugccuuuaugccauguggccucaggcaccuacagugaagucuuaaaaccaguggaugcucucuacagugccuucuagcugugguagucugugucuccaaggaccaacccuuccauuucugaggcuucagaauaaauucuggcaguuauuucuucucucagacucuauuucagaaaaguguaccugccaaccugcauuuaguaagaaauaaugaauuccuuuucucauucuuuuuauuuuuauuuuuuauuuuuuugagacggaguuucgcucuuguugcccagucugggaugcaauggcgcaaucucggcucaccgcaacccccaccucccugguucaagcgauucuccugccucagccuccugaguagcuggaauuacaggcaugugccaccacgcccagcuaauuuuguauuuuuaguagagacgggguuucgccauguuggucaagcuggucucaaacucccgaccucaggugaucugccugucucagccucccaaagugcugggauuacaagcgugagccaccacgccuggccguuguuguuguuguuguuguugagaaggagucucgcucugucucuggacuggaguguaguggcgugaucucggcucccugcaagcuccgccucccagguucaugccauucuccugccucagccucccuaguaggugggacuacaagcgcccgccaccacgcccggauaauuuuuuuguauuuuuaguagagacggaguuucaccauguuagccaggauggucucgaucuccugaccucgugaucugcccgucucggccucccaaagugcugggauuacaggcgugagccaccgcaccuggcgcuuuucucauuuuuuauuaaccaaaaacaucuauagcugccaaucagaguuucugaccagcaugagauaaccagguucccacauaaguugauauaauuccagccaaaagcaaauacacuugagguuuuaauuagccuaggccaccuuaucugguaaaugcaugauuuccguuaggcuuucugaaauauugaaaauagcacacggacccuccauuguuaccuucuuagaccccuaaaagugcccaacugcugcaggauuuaggaagcaggaaaaagaugugggaaaauaaggacaaacuagcuugcaugccauccauggcaccagucaccucacuuggcguguuggcaggggaggcacuauuuauuggauugacuuuagguugcugggauggaagggccacugccuguccaggaauaagccauggguagugugccgggaggaaaggaggccuaggucugugucccuugccugcaugccagguauccugaaccaucgcacagccggaauggauaugccccuggcuugugggcuuuacaagcuuuguaaacucucugucuugcaacccugcuaaacuccaggcuacuuccucaggccaccccaggagugucaggcucagcuccucuccaagagcaguggguguuggagaaauuggcagcaggaauagggucccuuggccuuagcccugugcuccaggaaacuuugagagaaccucuucuucacccagaggaagagggagaggguauugcccaaguccacaguuagugccugaaccagaacucuuggcuccugguccagugcuccuuucacugcuuccuguaccucugcuguucuggucuaguucagguugguggcccuuucugcuuucuagagccugaaggcagcaaccaaguucucugggggcugccccugcugagagaggggucuccuucucucacaucacccagcccuagggcggugcagccagaccccacaaguggaugucaugccuaagugagaaggguggggccuggcacggaggugggggugugggagacaaacggagaagugagagguuggaaacagacaggaagccacaggcaguaaacauuuccuguccccagaguaacggagacuggcaccuccccuccccaccccuccuaacuucaggagcucucccucuucagccuacccaucuccuauuccucuggacccugccuucucuccccuccauucucaccacuggcccucacagaccccuccucacucuccucuuccguccccucggaccuguccucucugcugcuuccauccccuauaccuccugggccacuccuccccgccucaguauaccuggucuucuuggaaaauacccccagcucuugugaccucuaccauaauccuucacuuugggccuucuugccuagugagaaagcugaggaagguauucaaauaucagggaaaggguagguauuggacggguugaaagcugaaagugaacagaaaccaauagagauggagaaauguaaaaucugagauagagagauaggauucaaaaaccaaaaccaagagagcaagcagucauaggggcagagggacagagggauugagaagcagugccagaggcagacacagagcagagcagaggccaaggcuggcaggagcacugguccagaggcugggucgaguugcccaggcugccagauacaaguccuggcaggagacccuuaggggaaaccaagagagccaagagcgguguggaggucuuggaggcaagagaccuagggaugaaugaggcagagcugacggcaggaggacugcccaggcccuuagcuaugaccaccccauuacacagggcaaacuuccccucauaucagggggaacagaagcacuguguccagaacugggaccccgguagagcagacucugaauucagucagcuggggguggucuaugggaaagggguucaagggcugaaacacagacccagccaggaaggggaggcccacaccagggccggggugagggcaggcccaggcccaguggaacaaucuguuuucacuguccuccagcuccucucuccacuccugcugccugauuuccaagacucacauuuuccuccuacacgccccaaggcuggguggcugggcagccggaugccugggucuuggcccagggaggggauuuggcuugggaggagaguauauaggcuagaugagagacccugaggcuccacaggaccuuggcgcuccagaagcuauacaucuaaucucagcagguacguagaggagagggagaagccagggguacaggcucuggccccucuuccccuucuagaaauugacugugguuccuccucucuuuaugaacaggauaagguaggagaggacagagaauggcgggaggaggggaggguuguguuagugacagcggcacauggggaccgccugacuccagccugugccucuggcaucuguggcaucuucugagauauaaauacaacgcagggggcaucuacuccacccccagccagccccagccuagaggccuggguccuuccugccuccagacaccaaugaaaagcuaggagccauccucaacugccucgcuuuucccccccacagggucagugugcuggugggagcacccaaggcuaauaccagccagccaggagugcugcaggguggugcugucuaccucuguccuuggggugccagccccacacagugcacccccauugaauuugacagcaaagguaggccagugaaauucagggagggacuggggggugggacugcagccugggggcaaggccuggguggggccuggggcgagggguggagccugcuggaaccccggccacgugaccucucagcaccagcucuggugcuccaacugcuuacaguggauccccauggcacucacuccacucucccauccagcccagcccaaggaggacgggcaugauucagaaacauguggcucucauuuccccugaaucacccacaauucugggaggccagggccguaacacagacaaagacagggaauguugcacaaacuauucaguuccuuuaacuaaguacugacuaagugacagugcaugacaggcacugugcuggugcugcagggacugaaagaugacuaagccacugcccucaaggagcucaaggucugaguagacacagauggaugggaggaagauggagacuaacagcuaucaguugcucugugccaggcccaguugugaacacuuuacauauauuaguucacuuaaucuuuucaacaacuguauaagguauuauuauccccauuuucuaagugaggagacagaggguaaguagcuuauccaagguuauacagcuagcaaacauuggagagaggauaugaacuagggccaucugucuccagaaauaaaaacuggacaggcugggcacgguggcaugugccuguaaucccagcacuuugggaggccgaggcaggaggaucacuuggucccaggaguucaagaccauccuggccaacauagugagacccugucucuaccaaaaacauuagacagagcugggugugguggcucaugcuuguaaucccagcacuuugggaggccaaggcagguggaucaccugaggccaggaguuugagaccagacuggccaucauggcaaaaccccgucucuacugaaaauacaaaaauuagccgggcaugguggcacuugccuguaaucccagcuacuugggaagcugaggcacaagaauugcuugaacucaggaggcagagauugcagugagcugaaaucaugucacugcacuccagcgugggcuacagagaaagacucugucucaagaaaaaaaaaaaaaaaauuagccaggcauaguggugagcacuuguagucccagcuacucgggagguugaggugggagaaucacuugagugauucuccgucacugcagccaaggcugcaaugagugcuacuugccccacugcccuguagccugagugacagagcaagacccuguuuaaaaaaaaaaaaaaauuaaaauaaaccuggucaacauggcaaaaccccaucuguacaaaaaacacaaaaauuaguuggguauaguuuccacccacuuggggggcugaugugggaggaucacuugcacccaggaggucaagguugcagugagccauaaucacgccacugcacuccagccugggcaacagagugagacccuaucucaaaaaaaaaaaaaaaaggagguggaacaagaugguguuagagacacaguccaaguauagacaaagaagugcagccaaaggguuacucucuugggaaauagccacuguuccccaccauccuccugccccugcuccacagcaggcauccuugucucaguugggugagaaagcaggaaccuuggggaggcaacucuagaaagcccagguucuacgcgggcgcaguggcucacgcuuguaaucccagcacuuugggaggcugaggcgggcaggucaugaggucaggaguucgagaucagccugaccaacaugaugaaaccccgucucuacuaaaaauacaaaaauuagccagguguggugacgcgcaccuguaaucccagcuacugaggaggcugaggcaggagaaucccuugaaccagggaggcggagguugcacugagccgagaucaugcuacugcacuccagccugggugacagagugagacuccaucucaaaaaaaaaagaaagcccagguucugugugcgugugcgugcguguguauguauguguguguguguauguguauguguguaguggagagauaagucaggcuacacaaacagacuacacaaagcagaauuaagcuccuuaccaauuccacacucccagcgagucauggagucucagggcuuggaagcguuuguuggguauccccaggcugaggguaggggcugcccuagagcucaaauguccauggcucaguaagacucccccuucucacuuccacaaggcucucggcuccuggaguccucacuguccagcucagagggagaggagccuguggaguacaaguccuugcagugguucggggcaacaguucgagcccauggcuccuccaucuuggugaggggccagcaagcucaguggugugguggccaggggaugggcagugguuggguaaggccgggccuggagggagggaggaagggccuuauuggacugaaucugaaggccccuccuccugggcccucccaggcaugcgcuccacuguacagcuggcgcacagagaaggagccacugagcgaccccgugggcaccugcuaccucuccacagauaacuucacccgaauucuggaguaugcacccugccgcucagguaggggcaagagggggccugugccccaugucugccuucucauauacuugaagugucucacauacuuaggguugacucgcaccuaccaugugcccccaugagguucuagguugcuuaagauaaaggcuaacccaguucguuagccuuuaugcuuacugucugguccaggaaggcccuuucucugguucucucucccaccuccuucccuaugcccucucuucuuuccuggaugacccaucuaugcagggcucauuuucaccaccuucuccccucacagauuucagcugggcagcaggacaggguuacugccaaggaggcuucagugccgaguucaccaaggugagagaguggucugggagagaaggggccgugggugguggacauggggggauugggaccagauguuggacuccccuccuuucacccacagacuggccgugugguuuuagguggaccaggaagcuauuucuggcaagguaaguccugucucugccauucuuuuuuuuuuuuuuuuuuuuuuuugagacgaagucucacucugucacccaggcuggagugcaguggcacaaccucugcugcccagguucaagcgauucuccugccucagccucccaaguagcugggauuacaggcgccugccaccgcgccuggcuaauuuuuguaauuuuaguagagaagggguuucaccaucuuggccaggcuggucuuggacuccugaccucgugauccaccccucuuggccucucaaagugcugggauuauaggcaugagccgccgcgcccugccuguuucugccauucuuuaaguccccuggcacauagccucccacccuacucccaauucuccucuuccuuuccugaagcuuacaugccaccacccuccccaugcuucccuuucuugaaccagacuucugaaauacuacccagucagcccccagagucccaagcccccucugccacuuccucuccaucuacucccucuucauacucucuccaggccagauccugucugccacucaggagcagauugcagaaucuuauuaccccgaguaccugaucaaccugguucaggggcagcugcagacucgccaggccaguuccaucuaugaugacagcuaccuaggugagcaagcaaguggggaagggauggcagagggagaaccucaagugcuccuguccccacucacccccucgccuccccucuccuacucaggcauccccagcaccccugccauacuugucaugugccugcugacuaugaaggcccaguagggguggggaagggauugguggauaggccagagcagagggguccucaaagcaggaauccuaacauccacccacccugucccccaggauacucuguggcuguuggugaauucaguggugaugacacagaaggugaguguguccccaggcuggggccaagggagggggaugguuagaggcacagggccagagagcccaugaacuuggccacuuaccauuaucugcuucccuuuccccacccuuaggucacaacuuucucuucucuuugcagacuuuguugcuggugugcccaaagggaaccucacuuacggcuauguaagacccagccugaccccucacuuccucuccuccccugccuaaucacaaagaaccgugcauggcaguuugcaagggcucaaaaagguggaucagaacaugggcucuggaggcagacuggcauucaaguucuggcacuuacucuggcagaaucauucugcucuuuauucauacucugcuuccugcugaaccucucugagccuucuucuucucuguauacugggauaacaaucguucugaccucacgaggcucuggcaaggaugaaaugagaaaaugcaugugaaaguacucagugaauuguuaggcaauguacaacuggcagauguuauuauuagaccaggacaagugcuuuuuaaaagauacagauaagagugccaucggauuucauucaauuaacaacauuuauuaaggcaagguaagagauaagaugaauaagguaucauaccccaucuuauaagaugcuucuaaucaaguauguuagauaagacacacauacaauuaugaucuaaaguggagcaacuauucauucucuacucagugcaucaggcacuaucuauucaugauuucuauucuucacaacaagccuaugggguagauauuaucaucuguauuuugcauaugagaacacugagguucuaagagaccaaguaaguugcuuaagaucacccaguuaguaaguagguuuaaaaucaggucucucuuaauccaaaaucagcauucuuucugcauuuugguaaacuucagcaaaguggauacaguggcauagcaguuuaggggaaagaauaaucuccuuucuaggaaaaggaugguaacaaguuuggggagucaggaaauaaaaauuuuaaauuuuuaaaaaggaagaggacagaugagagaagguucuaugaagguucagcagagaugaggcaggagggcauccugugcaggagcaugaaugagguggaagaaaaggaaacaauuucagcccaacuuagcagacucaugagcugauugaggaugaguagaauauggaaagguugagcaaaaacagauagguuagggccagauucuccagagcuuuggaggaccagccaagaaguugagacuuugggcagugacugcagggggccacuggauuuccaagccagagguagccuccuagaucugcugggagagcuggaggcagggacauugucaagacaucuguccagcaguccugggaaagggcucacaccaggauucaagaggccugguggggccagucacuaagggaauauaggggagaaaugguguuugugguucgggggacuggaggaugaggaugacuuagguuuugaacgugauggguuugaggcaccagcacacauucagucauaauuauuauugagugccuacuacucaccaagcaugacuuuagguucugaggagaaagcaaagaacaaaaucaaguuccugccccuauugaucuuacauucuaguggguagagagggacaacgaacagauaaauacaaaaucugucagugguuggugauugauagggagaaaaauagugaagcagacauaggguggaacuaccuggcauagaggugggaauaugagggcaaagcugaagagggagcuagggacaguggucugcgucucuaaggaaugccugccccuggguguccuguacacaucuguucuuuaaccaugggauauucugggaguccaggaccaaugggccuaucucuucaucucccaggucaccauccuuaauggcucagacauucgaucccucuacaacuucucaggggaacagguaaggauaccccucaaccccaccccagcuuggccucugucaacgaagccccagcccugaccuaauaaugucagcccaacuucccagccccucuugauccuguggauugaaccuucuaguucugacccagcgcugccccuuuguccuccccagauggccuccuacuuuggcuaugcaguggccgccacagacgucaauggggaugggugaguggugggaaaugagcgcacugugauacccucccagaaccaagagggaagagugggaaugggacagaaaaugcaaggagaguuucuccagggcuuuuucucuagacucucgcucauaccugcauuccccuugcucagggacaaggaaagagcugagagcugaugaucagagaccucaggucuucugacgugauggaauucagaguguccgggauuucuagcacuaggauuggggugggguggcaagacaggguaucgagaugccuggguuugcccuuccccucaggcuggaugacuugcuggugggggcaccccugcucauggaucggaccccugacgggcggccucaggaggugggcagggucuacgucuaccugcagcacccagccggcauagagcccacgcccacccuuacccucacuggccaugaugaguuuggccgauuuggcagcuccuugaccccccugggggaccuggaccaggauggcuacaauggugaguaccaugggcucagagagugaaagaggaggcaggggcccaagucagaagggauuuggggagagggcaucugucagcuaagauacccagaccuccacgacuucccgagggguuaaaaucccacugucugggucuugggauuugaagauuagaauauagggacugacagaugggaaaaaauaggauccuagguccuggggucugguaguagagauuagagcccauggauuccuggccugcugacuaguguguguucugugucuuccagauguggccaucggggcucccuuugguggggagacccagcagggaguaguguuuguauuuccugggggcccaggagggcugggcucuaagccuucccagguucugcagccccugugggcagccagccacaccccagacuucuuuggcucugcccuucgaggaggccgagaccuggauggcaauggauauccuggugaguugugccugaggccccuuuucaccuuaaaauucccuggucacugaccccuacucucucuucugcaccuuuccuuaaguuccugggugcaguucuggcuaauuccaacagagggcgcugucuucucacuucaaccucccugagcguugaaaccaggagggguuaggaagaaaggauccugaucuggggcuugcuguaagaggugauuucuugacuucuuacagaucugauugugggguccuuugguguggacaaggcugugguauacagguaugagcuccaaagggagaugaggggacaaccuggguggacuggaacuggaaauuucucaacagagcugagguugggaaaaucaaugcagaggacacacauucuggcgcuugggcaucaguuuccuguguccagguuacagaggaguccuaauucuauugaccccacauucacucuuggcaggggccgccccaucguguccgcuagugccucccucaccaucuuccccgccauguucaacccagaggagcggagcugcagcuuagaggggaacccuguggccuggugagcuggugcccaggaaauugcagagaccugagccugggagugggcaggggcaccaagucugccuuaaaaaggggaaaauggugguguccuagucugggucuggcugggagauagguagaggauaggaugucuguuccaguuggauucaccagcuuucuucuuggucucucuccagcaucaaccuuagcuucugccucaaugcuucuggaaaacacguugcugacuccauuggugagggagacugccuggaucucucaggcccuaggacagagaaugaagggacuggggaccuggggacauuucuucucucugaaaagaugaggaaagacaggcaguuucccuuuauaugucccuggcuucagguuucacaguggaacuucagcuggacuggcagaagcagaagggagggguacggcgggcacuguuccuggccuccaggcaggcaacccugacccagacccugcucauccagaauggggcucgagaggauugcagagagaugaagaucuaccucaggguauggcccagagggcgggguguggacuggccagggaggguggccacacagaacugagggcaccuccugaagggaaaaagacugggggacuccagugaagggcuugggacucuuguaggggcugagaaagggagaccuucugucagaggagcugggaagcaggcugccagggccucugaaacaaugaggauggucggaauugggcccuaagcagacaaagggagaugagagaggcugaggagcagggccacuaagucuccagaguccccugacuccgugaacucucuccucuggccccagaacgagucagaauuucgagacaaacucucgccgauucacaucgcucucaacuucuccuuggacccccaagccccaguggacagccacggccucaggccagcccuacauuaucagagcaagagccggauagaggacaaggugaggacagggcagggagaagggaccugggaagacagaggccuggguauugggggggcagggccauggaaagagaagagccuacagcccaggaaugggucuaaacuuccccucucaaggcugcccugcuccccaggcucagaucuugcuggacuguggagaagacaacaucugugugccugaccugcagcuggaaguguuuggguaaguagggcugacgguaagcuagggagcuccaggugcaccuggcaccugaaaaaaucagcuagggacauacuagcugugucgccuugggaaguugcugagcugcucugagcuuuaacuccuuugucuguauagugggaauaguagcauuuauuucucagacuuuuuggaaagauuaaaugaaauaaucuacauaaaaaaucuagccuagugccugccauagaguuagaacucaguaagcagugucuauuguuacuuuauuauuacucuuuuuuuuuuuuugagacggagucaugcccuugucacccaggcuggagugcaguggcgcaaucucggcucacugcaaccuccgccucccagguucaagcgauucucugccucagcgucccaaguagcugggauuacaggugccugccaccaugccgggcuaauuuuuuuauuauuauuuuuaguagagacaggguuucaucaucuuggccaggcuugucuugaacuccugaccucgugauccacccgccucagccucccaaagugcugggauuacaggugugagccaccacacccggccucguauuacuacucuuauaaugguccuuuguccugguuugaggauuaauucaccaaugucccuuacccucugugucccuuccagggagcagaaccauguguaccugggugacaagaaugcccugaaccucacuuuccaugcccagaaugugggugaggguggcgccuaugaggcugagcuucgggucaccgccccuccagaggcugaguacucaggacucgucagacacccaggggugagaugagacucucgagugggauuugggaggauaccccucuagaggggacaccaaaaccugaccagugcccaccccaucuccagaacuucuccagccugagcugugacuacuuugccgugaaccagagccgccugcuggugugugaccugggcaaccccaugaaggcaggagccaguguaaguuugggaugaaagaggaugggacagagggagagcagaccugagggcgguaaccagccagccgagagcacagcugugaggugcggagggagggugaaauacacagucuaacugcccucuuuuccucuuuuucuguccccagcugugggguggccuucgguuuacagucccucaucuccgggacacuaagaaaaccauccaguuugacuuccagauccucagguagggagugagugugucuaggcuggggcugagcuggggacggaagggagggcugggcgccauucucacuggcugcacuccagcaccucagucuugccuccaucccacagcaagaaucucaacaacucgcaaagcgacgugguuuccuuucggcucuccguggaggcucaggcccaggucacccugaacgggucagugccaggcaaaauggggucuuucugagaggggacacagacuucuagggaaggaugcauaugggguuccuuccacccuccucuaaaccacccuccuccuuagugucuccaagccugaggcagugcuauucccaguaagcgacuggcauccccgagaccagccucagaaggaggaggaccugggaccugcuguccaccaugucuaugagguaaggggggaaggggcagggccagaaugaaugaugggaaaggaggagcuaauaugagugacagauggcuggaacccaugugagggacugagagaaagagaggagggaggaguaagugauaugcaaaggcaugaggcagaguccugugagaaacagccagaggagagacaggccaauugaguggcuuggaaagaaagauggagcccccuccaaaaguguuggcuagagaggauuucaccucugcccauugcuucccugcuucaucucugagauaggagccugacagcaggguauaguggagccauggugauccagggucucaauggggcagaagcauucccuuccuucucaugaugauugugcucuucccuccucagcucaucaaccaaggccccagcuccauuagccagggugugcuggaacucagcuguccccaggcucuggaaggucagcagcuccuauaugugaccagaguuacgggacucaacugcaccaccaaucaccccauuaacccaaagggccuggaggugagauccugaacacuggcauggggaagaggagcagauucagaggaccaaggcugagggguuggggaagguugcugggggccugcaagaggcaaugaggaugugccuauagcuaggguugagggucacaaggcccaaaguuaccucaaaauccucuggaggaaaaaggacuuucauccacuguguuucuuucugccugaacuaucccuucuuuguuucccggcauaccccuagggcccaguuaugugccaccuccucuaggaagccuucuucaaaccuuuuccucugggcccgaaugccuguuuuauaguucauuuacucauuaacaucuaauuaaauaagugacuguacugaacacuguuaggcccaggaaauauugcaccaaacagaacugacaaggucuccacguucauggaacuuacauucuagugaagggugauagacauagaaaagaaaaagagaaggagaaaaauuaacagggauugaaaggugaugaagugaagaguuaauaagcuguagggacacuauuuaaauuggaucauagaaaaaccucuugaagacgucacagcugaacugaggccugaaagauaagguugaaccugucuauaagacucagggaugagcauuccaaaccaagggaacauccagugcaaaaacaggaacacagaccuaauuauuuacuuaagcaucuccuccagugugaucuccaagaaccaaguuuuccucauuuccauauuuuaacccugagcucagugccuugcgcauaggagguggacaguuggaugaaucaauaaagagauagaugaaagaauagguugaagcugcucuggaacccaggugcaagcugacuuagaagcuguaaugagaugggaaaggggcccaacacuuucuuuuauaguuggaucccgaggguucccugcaccaccagcaaaaacgggaagcuccaagccgcagcucugcuuccucgggaccucagauccugguaagucaggcagggaaugagguguggaccaaaguguugaguacucugggguucucagggccaucacaagggcagaacaccagguucaagcuucuuucuuccuagaaaugcccggaggcugaguguuucaggcugcgcugugagcucgggccccugcaccaacaagagagccaaagucugcaguugcauuuccgagucugggccaagacuuucuugcaggugagggagccuuaccucagcccugaccccugaccuuugggccugcuuagacugacccaccccuuucuccacugcaguagccaccucuccuuuggugaaugggacccagcacuccagcuccccuuccuugcccuugucuagaccaggcuguauguccuuggcgccaucuaguggccacagugggagcagcagcuucccuuuccuggcccauucagaggagggagggcuggagggagaccagugugcaaagaaugauagaaaaacaguaagauggaagaugaauccauaguggagagguaaacacauguaggaauaguaaagagcagucacuucuugagcacacacugcaggcuaggcacuguccuggugucaaagcacauuaauaauuuuaaaaaaauuuuuauugaacacguagucaucuaauuauauauuaucaaguuacaauuauucaguuacacauuuauuaucucauauaaggaacaucaagagaagcucacgggccaggcacaguggcucacaccaguaaucccagcacuuugggaggccaagguuggcggaucccuugagcccagaaguuugagaccagccugggcaacauggcaaaacuccacuucuacaaaaacaaaacaaaacaaaaauuagcugggcaugauggcacaugccuguagucucagcuacuugggaggcugaggcaggaggauugcuugagcccaggagguggagguugcagugaccuaagcccacaccacugcacuccagccugggggacagagugagaccuagucucaaaaaaaaaaaaaaaaaaaaaagagagagagagagagagagacucaggaagaaugagcccaaaauagggaaagaucacaaccccagccagacgauggggaacccuauguccucuggaucccaagagaggaugugcuaaccaacuuuccccuacccacagcgggagcaccagccauuuagccugcagugugaggcuguguacaaagcccugaagaugcccuaccgaauccugccucggcagcugccccaaaaagagcgucaggugagucuagggccagaggacuggaugagggaauacagggcucagagugcuggaacagggcugggacuugggugagggcuggccuugguauuguuaacaacuguugagaauguacuaugugccaagcacugugcagaugccagagacagagugguaagcaagaucaacaugguaucuuugcuccugguguucacagucucguggaacaacacaguguuccaaguguggugauauuuaugaaaacacauaauaggaacaccugaacccagucuaacugggucagggaaggcuuccuggaagaagugauguucaagcugagaccugaagaauaaauaggaacuaaccaggcuagccauucaggaaagggauauccuggggagaggugaauaacagauaugaggcugagcgcaguggcucacaccuguaaucccagcacuuuggaaggccaaggcaaguggauugcuugagcucagaaguucaagaucaaccugggcaacauagugagauccugucucuacaaaaaauacaaaaauuagccagaugugguggcgcauaucuguggucccagcuacucgggaggcugaggcaggaggaucgcuugagaccaggaugcagagguuguaguaagcugagaucacaccacugcacuccagccugagugacagagugagacucugucaaaaaaaaaaaaaaauggauaugauaugaaagcccgaaaguaagagacaauauuguacauuuuaggaacuucaauuuuuaaguucagaaugcuguuaguucaaaauaagagguggaguugaucuggaacccagacucagacauuggcaccuaauccaggcagauccaggacuauauuugggccugcuccagaccugauccuggaggcccaguucacccugauuuaggagaagccaggaauuucccaggacccugaaggggccaugauggcaacagaucuggaaccucagccuggccagacacaggcccucccuguuccccagagaaaggggagcccacugggcucugcagauccaaugacaagugggggccaaguauaggguagaaagaacuucugagcuuucauugacuucacccaacuugcuccccagguggccacagcugugcaauggaccaaggcagaaggcagcuauggcgucccacuguggaucaucauccuagccauccuguuuggccuccugcuccuaggucuacucaucuacauccucuacaaggucagccacauccugcuugugacuuggccacccucucaucaggcucugcccuugaccuggcacagucccaaguaucuaccucuagaccaguucaccagccaugugcccccaccucuguccuggcuacaugcaucccauccuaacccuuccuauaagaucccccccuucauucuauagccccuagcuuagaaaggguccucuugacucaagaugauaaguuugccuauacuugcaaaaucauuggaacccaaagaugacaaauacguggcauuugugcugucaauuucuccaaaaauccauggcagccaucacuaaccuagaaauggcuacugaucaucuccuagaaguggcuucagaaucucucucaagaggcagccauggccaggugugguggcucacaccuguaaucccaacauuuugggaggccagggugggaagacagcuugagcccaggaauucaagaccagccuggguaacacacuaggaccuugucucuacaaaaaaaacacaaagauuagccagguuugguggugcgugccuauagucccagcuacucuggaggcugaggugggaggaucgcuugagcccaggaguuugaggcuacagugagccaugaucaugccacugcacuccaggcuggucaacagagugagacccugucucaaaaacaaacaaacaaacagaagcagccacuacuaagcaaucagacuuggcauuugaguucaaaccuaucugccauuucuggcuuaacuggggaauuuuaaaggcacugguaaaagauaccccccauacaaaaucacccccaaguuugguccuccuggguccauugcacaacuuagagggguaguccuagccugaauucagaggccacuuuugcaggauguagagguuggaggcacuagaguccuccuuauuacuucuuggaauaagagcuguggagaaauggcagccauaguaccuaaacucucccucuuuuccccuuuaucagcuuggauucuucaaacgcucccucccauauggcaccgccauggaaaaagcucagcucaagccuccagccaccucugaugccugaguccucccaauuucagacucccauuccugaagaaccaguccccccacccucauucuacugaaaaggaggggucuggguacuucuugaaggugcugacggccagggagaagcuccucuccccagcccagagacauacuugaagggccagagccaggggggugaggagcuggggaucccucccccccaugcacugugaaggacccuuguuuacacauacccucuucauggaugggggaacucagauccagggacagaggccccagccucccugaagccuuugcauuuuggagaguuuccugaaacaacuuggaaagauaacuaggaaauccauucacaguucuuugggccagacaugccacaaggacuuccuguccagcuccaaccugcaaagaucuguccucagccuugccagagauccaaaagaagcccccagcuaagaaccuggaacuuggggaguuaagaccuggcagcucuggacagccccacccuggugggccaacaaagaacacuaacuaugcauggugccccaggaccagcucaggacagaugccacacaaggauagaugcuggcccagggcccagagcccagcuccaaggggaaucagaacucaaauggggccagauccagccuggggucuggaguugaucuggaacccagacucagacauuggcaccuaauccaggcagauccaggacuauauuugggccugcuccagaccugauccuggaggcccaguucacccugauuuaggagaagccaggaauuucccaggacccugaaggggccaugauggcaacagaucuggaaccucagccuggccagacacaggcccucccuguuccccagagaaaggggagcccacuguccugggccugcagaauuuggguucugccugccagcugcacugaugcugccccucaucucucugcccaacccuucccucaccuuggcaccagacacccaggacuuauuuaaacucuguugcaagugcaauaaaucugacccagugcccccacugaccaga

SEQ ID NO: 21538 - RNA, 1799 nt, Homo sapiens
uuauuuuuuuuuaaaaaaaaaacuuucauaauaaaguuuauuaccuaaacugacuuuaaaaaauauaaaauaggauucugcacagcagaaaaauaaagccagagacccucccccaaccccugguuugugcaaagauacuggguauauguaaacaugaagagguaggaggugcgaguucagguccuggcuccagauacaguuaagcugcuacaacaaccagggggacccagagggagcaccaggagggggaggacccccucaagaggugagaaggggucugcggccucgucuccagccgagggcgggaggcgccucgccccuacacccauccgcucccuccaacccaggccggggaggguacccacaugguuccaggcaaguaauaacaaaauaacacggcaucccaguuaaugcugcgugcacggcgggcgcugccggucaaaucuggaaggggaaggagcucagguagucgcggaggacgggguugagggggaugcgagccagguucucgcggcccacgguggccacgaugcgcuggcggcacagcuccugcagcggccgcacgcggcgcuggcgcagcggggcccccagcaugcggcgcggcgccgccacguagugcuccagcagcucgaagaggcagucgaagcucucgcggcugccauccaggugaaagcggccggccugaaagugcacgcggaugcucgugggucccgaggccaucuucacgcuaagggcgaaaaagcaguuccgcuggcggcugucgcgcaccaggaaggugcccacgggcucggcgcgcagccgcucgugcgccccgugcacgcucaggggcccccaguagaauccgcaggcguccaggagcgcgcuggcgcgcgugaugcgccgguaaucggcgugcgaacggaaugugcggaagugcgugucgccgggggccggggccgggaccgcggggcacggccgcgggcgcgcgggggccgcgggcgaggaggaggaagaggaggaagguucuggccgccgucggggcucugcugcuguggagacugcauugucggcugccaccugguugugugcuaccauccuacagaaggggccagccggaggggugggccauagcguccgggggugcgcugcgggagagacaaagaggugagcuggggcgcugcggggccgggcaggugugcgccggccggacaacuccggagggcggcgcucccggcggacccggcccuagggggcgagcacggagcaccaaguccgcgcggauccguucagccucaguggacacagcuagaaaaugggcucuguacuccgcggagcucuucccggcgggugggggcucgguggaggcggaguccggccuccgggcagcaccgagaggggggcguggagagcagccgguucuggcuccagccguccggccccggcucgccgccccgcgcccgccgccugcuggccaggcugggauccgcgccuggucugggcgauuugggcuagggccggagaaaggcugugcugcgggagccccgcgcgcggggggcggccuggguggggccggcgagggucaggggcaucgcggccgcgaccccauucugcagcccccgaggcucgcccgacuccuggcugcccuggacuccccucccuccucccucccgccuccucgcccagggcccggcucaccuggcggcggggcgcgggacgccgcgggcgggacggcggggggcuccggggcgcuccggggcggcucucgcgcaugcuccggggccaggagccgugcagcugccacggccgcagcucgcucuguu

SEQ ID NO: 21539 - RNA, 2574 nt, Homo sapiens
ggggaaauguucagauacaguuuugugaacuguaaaucaaaauaccuuuuucuacaguuuaucuuuuauuuucugcaaauuuaggaacauauuuacucguuuucacauugaaucuuaaguuuaagcucuucauuugguauuuaggcaauauaugagaaaaaaauuuuuuuuguucauuuguaauuuuaacaaguugaacauuuuaccaugauugaacauguuuuuauuacaguauuuaacauucccccaaagaauacccugcaaaguguaaaccuuugucccauacugugauauuacuguucugcuacaauaaaugucaaaccuaagcacuuugcaguucacuacuuuugggaaaauguucuagggaacuguaucacaggugaaacuguuacccauaaaguguagcucucugaacuggugugaucgugucucugcugaauggugguggggauagcuggcuccaccacacacaccuguuuuaauuaggcuggguaaugugcacggagagcaaagaucacagacuaaggagcagucagucggauauuugcuuugcuggcaaagauuuaaaccaagaauuaauuaucuuuggacacuauaaagauuuuguucccuuccuuauagcaauauaaucaugacaggccaugguuaacuacaucagauacacguagcagccgugaccaagacauggugcccuaauaccaaguguucuuggguuaaaggcaggcggcuuuuuaauuaaaucuuaaagcacugcaauuacuggcaagacagcuggucuuaagcaguuuugugacugcccuuuucauccacuacaugacuauuccggccuuucuggagcacuuuugaaaaucuacuugacucuguccacaagacugaggaaagugaaagcaaagucccgggaaagcgggagaugauucagcccgggguucugccccucgccccuccagcagccucuacaguuagggagcucuugaacuguucucagcaggggcccccaaaaagucaacccuuccccaggucugcguucuucgggagaacaccuucugcuggaaagcugcuagcuuaccugagcucagccgugcuccaccuagcuuaggcaaguuaaauaaggccaggagagagccuuuaaugcguuuuaaaagcgacagacccucucuccugaguagcucgggccugcgccccauccccccgccccccccacacacacaccuggcgcccgggcucccuggugcucgcuggcugcggguccggaacgcacccuucccgagccggguccugcgccaccggcgggcgggcgggagucacugcgaauauaggaagcaggggcgauuucaaaugcugcuuuauucuuacaaauacuguaaaaauuaauauaaaaaagugagcaugcucagucuuuuccucuuaucuacaauacaaaggguuugucugaaaagucugguuuuuuuucuuuuuacaaauguaccuuagcugcaucaacaggaguaagauguagaaaaagcuaccauuacaaaaauaauuuaagggaaaauaaacacguuuagcuucucucgcaguuuaguggugguaaguccaggcuguagcuucuuugcgcuccuaugucccaagaaacugcagcgggcacccggcggcucuggcugcgccagggcagggcgcgcuccgcuccgggccgucgggucugagguaugggucguugcugagucucucccgccccggccgcgcguuaccggcagucugcugucccggcggccggcaggaagggcgggcugggcagcugcuugaagaacugccggaggccggccaggucccgcgugagcugcuccacgcgcuggugcagcuucucguucucagccgacagcuccaccaacuucugcugcaucuccugguugcgccgcuuggccuugucgcggcucuugcgcacggcgauguuguugcgcucgcgccgcugccgguacucggggcugccgcgguccgggccccucuugccggcgcucuucucccgggcggggccgggcgcgggggucugccuggggcugcugcgcggcggcuccggcgacgugggcggggugggcugcccugcggccgccaagcucaccacggucugugcgcacgcggccaccugcgcgggcaacagcgagccgggcgcgucgccgucgccccagucgggcucgcgcuugagcaggcggggagcggcagggcccgggcccaaggggcgcgcggggccgccgggaagaagcuccaggggccccgcgccgcccgccuugugauugcuguugaagaggucggcgaagagcucgucguggcacagcuccagggugggcacggcggccauggagucgauguaggcgcugaagucgauggcgcucucgucgucguacauggcgggggcggcggcgccuggcucgccuagggccccuggcucggccccgcggcccggcuugcccgcccggcccgguucguagaagggcgcaggcuccgcaggccagggcgcgccgcgcgccgggccguccaggcugaagagcgcggcgcucauggcggcgucgggccgggcucugcguccaagcgaggcuguca

SEQ ID NO: 21540 - RNA, 45585 nt, Homo sapiens
uaacauaaaauagaaacuaacuuuauuucucuggaagaagcagguacugaaugccggagcagcaacuucgccaacaggcuggugggaaaacauggaaccgcgugggggaauuggguggaagaggaagcacugaugucccuccagggcggcugccccuuggucuccuuccagcccuggggccuugggcccugguccccgccagagaauggucuggcacccuuucuccgcuuccugagccaccucaggcuauuuccaggcacaagauccugaggccagccaagucccauucaaguccaugguaaggccacaagucacauucugcccgacaccccagcugcugccaggggcccccuggaagaaggcccaguccuaggaggucccaccgggugccgguccgccucucccuguggccaacacaucccgccugcccagguccagccugguuuccucccagucugucacccagggcagggccuggggguacuacuccacccacaggccccgcccaggaccagggccagaggcaggucauacccagagccugcuggggcagcccucaagccugucuucacccggccccuuccacaucuuggcaggggcaccgggacugaaccaaagugugcagggacagcgcuggugcaggagggaugggcagggcagggcucccagccucccgcagccuuggccuugcuccauccccgggagcagcaggagcagcggguccuccaggacuggaugggggcaucuccccacuccugguggacggacaggcucaggugauuccuucaggcaggcccucuggcucuccagacgcaucucagcgccuagagaaugggaaaccaccagcacaguuaaacaguuuacagaagguucagcggggcaggcaccgggggucacacuggugccaggcaacaccacuggaagcuggcaguccccggcaaggacuguaaaauuuaucauccuggaugucuuuucucuguacuuuaauaaacuaugaguaaacuaacagaagagcacuccugcguauuagagaauccgaagacgacaggugggauagagcccaaagccuauguggaugcaaaucaguaagaaccacccgagacagcgacagacaggugacacggagugccugcaucccagcugcaaaucaguaagaaccaccccagacagcgacagacaggugacacggagugccugcauccuagaugcaaaucaguaagaaccacccgagacagugacagacaggugacacggagugccugcaucccagaugcaaaucaguaagaaccaccugagacagugacagacaggugacagcgagugccugcgucccagaugcaaaucaguaagaaccacccgagacagugacagacaggugacagcgagugccugcgucccaggugcaaaucaguaagaaccacccgagacagugacagacaggugacacggagugccugcgucccaggugcaaaucaguaagaaacacccgagacagugacagacaggugacagcaagugccugcgucccgggugcaaaucaguaagaaccacccgagacagcgacagacaggugacacggagugccugcaucccagaugcaaaucaguaagaaccacccgagacagcgacagacaggugacagcgagugccugcgucccgggugcaaaucaguaagaaccacccgagacagugacagacaggugacacggagugccugcgucccaggugcaaaucaguaagaaccacccgagacagugacagacaggugacagcgagugccugcgucccagaugcaaaucaguaagaaccacccgagacagugacagacaggugacagcgagugccugcgucccagaugcaaaucaguaagaaccacccgagacagugacagacaggugacagcgagugccugcgucccaggugcaaaucaguaagaaccacccgagacagugacagacaggugacagcgagugccugcgucccgggugcaaaucaguaagaaccacccgagacagugacagacaggugacacagagugccugcgucccgggugcaaaucaguuaagaaugacccgagacaggaugggacagacaggugacaccgagugccugcaucccaggugcaaaucaguaagaaccacccgagacugggacagacaagugacacggagugccugcaucccaggugcaaaucaguaagaaccacccgagacagugacagacaggugacagcgaaugccugcgucccaggugcaaaucaguaagaaccacccgagacaaugacagacaggugacacagagugccugcgucccaggugcaaaucaguuaagaacgacccgagacaguaugggacagacaggugacagggagugccugcaucccagcugcaaaucaguaagaaccacccgagacaguaugggacagacaggugacacggagugccugcauccuggcgccaggcgugcugggcgcaauaagacagacaugucccccauccaucgcgccagucccuuccacggggugagcacuauuaucuacacgcuuuauauguggagaaacuccgcaccgugcacagggccacgcugcugggacaagggcagcagguaucuccagggccuggcccgugucagccccuccucccgccagugccuccugccauggugcuggcuccagccaugugaccucaguucacuucuuuuugacuugacagcgcucucauauauauauuuacauaauauauaaaguguguuuauauauguauauauuuuaaaugucuauauauuuuguuaaacuauaauauaaaccuuuuacaggaaagacaauauauuuucuuuuuagagaaaauuuuuuuuuuuggagacagucucccucugucgcccaggauggagugcaguggugcaaucucagcucacagcaaccuccgccucccagguugaagcgauucuccugccucagccuccccagcaggugggauuacaggugcccaccaccauacccgguuaauuuuuguauuuuuaguagagaccuggucucgccauguuggccaggcuggucucgaacuccugaccucaggugauccucccuccuuggccucccacagugcuggggauuacagccaugagccacggugcccagccaacacugaaauuuuaaauguuacuuuaaacagaaauauggaaacacagaggugagaaagaggugugcaaaucaugggguccuaaaaagugccauuccuggagccgcucagggucacugcaggugcuagggaagcaagccuccuucaaccagagaggcuccaauucccucuuguacucauuugaaaaccaaguggcuaaaauguccaaauaaacacauuuaggaaaaacgauuugcugggcccugugagcgccucccucccgcagcuggagagcugugucucccuggccgggagcggccugcgagguguugggcuuccucccaguguggcaggcucugggacagcccuccuggggcacggagcggggcagacuguggggcucacucacuuguggugggcagggccccaggagcccagaagguggcagccggccugcuccagguuccagucgaacaucuccagcacuuuguggcacuccccucugggccgcagacccagcccgaagagcugcuccaccuggggguaaggguggcgccauggacacgcgggcccagggcaccgacuaggguggggaagaggggagucggagccagggggcguggggcugggggcagcagaaccaggcuucagggucccugagagccagagugagcaggagguggcgguaccuucagauacugggcagcccucugcacgcuccagccguggcacugcagggccgccuggcacuccucuguggucaccccaugcaccauggccugcagcugggcacacccaccccugucagcaccacuagggcccacugcuccaggccccuugggcccugccccgcuucgcccacagccaggcugggugcucaccaucuggaucuugucugcuggccggcccgccucuggcccaucgccagggcagccccucuguggcagccgagcaguggcccucgggggugguggccgggccccuggguugcuguuguugguggagaaguuggccuugggguccaaggcagccuggggcaucggccgcacgguggccgugggggcggcgggggcuggggugcugggugggggcagcagcagaggcacaggcagggggguaggcuccucggggcucugggccucacgcaggaagcgcugguagcgcuccagguaggauggucgcucgggcagcaaguaauagugggugcugcugaccuucuugccaucccggacgaugggcaggaugcagggaccagcccgcgggccaggggccuggaucaccugggggguggcguacuuggggucugaggcaaagcucuggguggugggcauggucuucccaggugagcuugagagccgggguggcagcggggagcugccaggugguaccagggggcuggguguccucgagccuugaggggacaggggcucccgcggaggcacccggggaggggaagcagguccaggccacuggcuggucuccuccucgcccgggggggcuggagacagcuggacgugugggcgcgugggccgaggggggauggguacccgaggaggcaccuggggcuugucgucaccccccgggcugggagagggggccggggagccggccggagccugcaguugccucaugcacuccugcuguagcgccuggaagaucucugcggucugugcggagcugggcggcuugcccccacccuggggcgggaggaacagguuguccuccaggggagggggcggccgcgccugcucaggcacaaaggcguaguuggucuggcccuggcugggcccggcagggacccccgcgcccacgagggugcuguugauggagcagaucucaaagucauccucauccugggccacgucgucauaggcgggcggggggggcagcgggcgugcgucccaguccaccacaggcguggggugcaggggccggggcagugcccgcguggggcucugaggcggggucucguccagcagggagcaggcguccauggccagcugcgccagggagggcgcgcagggccguagggccgggaccacgggcuccucaccgaagucgaugagcgugaccucagccccgcugccucggcuggccuuggugcccggcacccgcgccgagggcuucgccagccacagcccucggggcaggccuggcuuccgcaggcccagccucuugaagucgcuggacaaggggucuugguccucgcucacagggucauagguugguucugugauggaaagggagagcccaacaggaaggcagucaggcagggucugggacacgaggggagguggcacgugggagagaaagccaagugucccccagcaacccuccacucccaacuccccccgaggucugaggucagccaccggcggccagguucucagcgcaccuccgaccacuccaucaggagggcggaaccugcucugcccggcagccccaugugggccggugagccccgccucgcuccgucuaagcugcagcaagcaacacuggcuccugccugacgcugccuccaccagcacaagaccccggcggcccugcuccugcgcccuggcgaguuagugagcccucauccccgccccugucacggcacaccauuagugcaggcacggagccgccuccugccaucaggggcuauaaggacuauccuuggagaggacaguacuccugaccaacggccacaaagcccagacagcgccugcaggucugggaggcagcgaggccaaggcagaagccagggccacacucgugcuccagaagcucagacaggucugggagggagugaggccgaggcggaagccagggccacacucgugagcagaagcccaggcuccggggggcgggcucgagggggggcaggcaugcuaggccagggcagccgcggaagcucacagcacacacccacccaccuccccuccggcccagccgcccaggcucuguaccuuccaggagaggagugagagagagggggcgggggcgggggccaaggcaucggaagcagccccacuuacucugagugaagaaggcaggcugaggugggcgagguggaggcuccccugcaagaaaggccaugcggacagggggagagagacggagcaggacagaggacaaaggagggagacggccggacgagagggcagaguguagagagacgaagggagagaagugaaugggggcgagugaauguacaagcccccagcaaacgggaggccgcaggcggcaggaugaggaacacggcgguccaguaugauaggcagaggaccgggagauggaggaggccccaggcagagccggagccguggggugguuuuggcuugggacaggagagcaggauuagggggaagugaggaaagccaggaucugagcucggccguggaaggagggaggagggacgccggggcggacgggccugcugcagacccagcccgaggaggcccaccucggcggauacagcugccugucuuccaccccacgcccagccggagccagggacacagcugucccgccugcugcccugaccccacuguccccaaaaacagaacagcagccuuaggguggccugugaagacagugccccuuccugaguagccgaugaguuagggacaccagggagcagaggggcucuuacuuuucaccccuccuagaugcugggggggccgggaggugcucaguuccacgcucaggaggucggggggguccaugggguuucccagauacagucugugggggagagagcugggucaagagagcaggggaagcguguggagggguggcagaaucucaucagagccccuucguccuggaggaaaccggguguagucuugggucugaagcacaggccucccgccucccaguccacagaaccugaccgcacgucucagcugggggguguccuggagagaaggcagagaaaggacaccugaccccaggauggaaagccuaggaccucagggacuccaacuacacccuacaagggcagaggugguccuccacaaccccccaggcccccagcccacaccaggcagcggccagagggcagacacuccugucccgcaggccacgauggagggccuaagaacggggcaucccagcuauggugcccagccagggugggcaggaggcacccuucugccacauggccaggaggugcgggagaggcugggccaccuguccugcuccggauccacccuccgucccugcaccaacugucaguaucugagacuuagucacuggggcugauuaaagccuggaggaauggggcugggcuggccacagcaugccaggaguggggcagagggcaccagccucuccuggaggugucugcagucuuucaccccaacucucaggcccuugcuggguucuuuuuaggcaaaacacaugggcugagcccugugagcuugggguuccagugugugugggcccgcuguguggguucuggugugugggggcccgcuguguggguucugguguggggggacucgcugugugggguucuggugugugggggcccgcuguguggguucuggugugugggggcccgcugugugggguucugguguguggggcccggugggugaaggccccugcuuuccacgccucucagggcagaccagaguaucagaagucagcaggagaagggcugcagaggccaggggccuggaaucccccugcggccagcagagaggcuuggaggccuggcgcaagaagcuucggggggugggggguggcaucccggaagugacugauucugcguguccuucccagaugccccucgguggccuuauccucuuacauaggagacagggccucucccagguauggagugagcuccguagaguacugugugguggggaggcggagcugccaccuaacguucccucugcaguccccaagguccccagucccacucugguucuggaaagcaggcucacucccauguggaccugcauacauccccagggccugagccagcagguucacgucuccaggacucuggcaccaccagcaggagaaggaaaaccacugcucgugugcaggggucacagggucacagggucacagggggccacaggggggucaugggagaagcucuccuccucagcagcucccaccggguuccucccaaguucauuuuccuaaggcccgaguaccaagagggguuacagcuguggcuccggggaccuuuccaccaaacaggaguccauccucagaagcuccugacccuacuuucaucuacagugagugggaaagcuucucucaggaccccugcaucugagcagcaagugcuaauucagagugcauuuacagccuuccccuuauugggggggugaaccuguuucacagaugaagugucucagaguuaggagaucggccccccaaagcuugaaaauggcagggacagcauuccccuggagaacgcuccccggagaacccuccccuggagaacccuccccuggagaacauuccccuggagaacccuccccuggagaacccuccccuggagaacccuccccuggagaacauuccccuggagaacccuccccuggagaacccuccccuggagaacacuccccuggagaacauuccccuggagaacccccaccaggcugggcuuccuaggguuccacagcuucccgagaguaaggccagggugaggaggggagaguggcgggucgggggcugaagcccgggcgaaagggugaagagcagauuccgcccacgcgugccgugcugagggcccuggagucccgagcggggccaggucagcauccauccccgcccaguacucacucgucaauccuguccgggaagccccagcaguggcgggggucacugucgccaugcccuguguggaugaagcuguucugcaggggcuggcugauguccugggccgacaggccggccacggaggucaccacguugcgagggaagggccccacacacagcguccguguguucuggccacgccaccaguaguucucggcccugcgcgacagagauggcacggugaacgccaggcguggcggggcagccccggcacugggacccuccucacacccuggccacuguggcagaagggggauggagcucaggccucaggaccaggcugugugccaccggcccuccuccccaacagcccccgugacccaccaugccccguacaggccuguuugcacacggccuuacccacaacucucuaggugggucaggcagcuuucccuaugguuugcaaauaaggaggcacgcuggaagcugcugcagcaggcaacaugaccuguccacgguuaccagaaagaucccagcagaccugggacccaacgccagcuuucaggucuguggggccagcgccccgcccacaccuccuccucaccccucaguucccuggcaaggccggggccccaguccucuucuggccacuugauuucacuccucggcuggguuccaggaguucugagaggugcgggggugccgggggacaccuagggccuugcacuaggcugggggccaggccuccagcuacaaccugccucccgaaugcagacgcgggagagucuaggagcacucgggcaacucagucccucccuccaccgcuucaccugcuuccggagcuuuccaccaccucccggaaggccugcgggagccuccccgucuccucaggaggggcucuaccuguguccaaaagggaacucagcucucccacagugaccagacaguagggcugccagucccccucugaccucagacacgaaaccucugcugauguggccuaagccggggccugggcaggggcaggggcaggggcaggggcaggcaggccaggaagcacagggcucccgcaagacacuccugacucccgaaggcucucacagguugugaggcucccgcgucugcugcuggacuugucauacgugaugccgugagcagagucugggcaggcgggggcggugagagccccgugggcagugucugggcaggcgggggcggugagagccccgugggcagugucugggcaggcgggggcggugacagccccgugggcagagucugggcacgcgggggcggugacagcccagagcugcuaggguggacacguguggcaccacacugcacgcccuccccaccaacccccacuucuccugucccagggccaaagcgugaagaagggcuccucugaaacccagccaggccggggagagaggacggaggagguggcgacgccugggcacccagacccacagccuuguaaggugacgaggccuggcuggagcggggugacuccggaacagcccaucccagagaccaaagucaaacccgagagcaccacggucggcggggaggcggggggcgcggggcgcggggagacggggcugugcucccccugcccagccuccucauacacagggccacuggccuggccccaccacacacagccacccugugauucccacccugccugcagggagggaaggaaggagagaggacaguaccccgagacgagacgagucccaucugaaaaauagcagggccacucgaaggagcagagccccggcuccccagcacgcacacagccucccacggcggcccguagaggaggaaccccggcaccggcugggcugcggcucucccgcuacacccacgggcuccccgguggcugccgcgggccagacgccggacucugcucuccacaccucuucagaggcgcucaguaacugggugagaaugccgcugaggccgagaccuugcucagagcagcgugacucgugcccaaggcaggucacuccgucuggccucucccuuccgccaacacugcccagcuccaggcacagaagccuccuuugggacccacuucugagagggaaaggagacaucaagcccaccucccuuagugcagguauggccgaggcaagagcccccauggcugcugggaguccugacaccacucgagaaaacaugcuugcuccugggggaaggagaguaagagugcggaggacgugugcaagaagcuccccucgggauggcgcccacgcacacuccgaggcacaagaaacucccccucgggauggcgcccacgcacgcuccgaggcacaagaagcucccccucgggauggcgcccacgcacacuccgaggcacaagaagcuccccucgggauggcgcccacgcacacuccgaggcacaagaagcuccccucgggauggcgcccacgcacgcuccgaggcacaagaaacucucccucgggauggcgcccacgcacgcuccgaggcacaggaagcuccccucgggauggcgcccacgcacgcuccgaggcacaggaagcuccccucgggauggcgcccacgcacacuccgaggcacaagaagcuccccucgggauggcgcccacgcacgcuccgaggcacaagaaacucccccucgggauggcgcccacgcacgcuccgaggcacaagaagcuccccucgggauggcgcccacgcacacuccgaggcacaagaagcuccccucgggauggcgcccacgcacgcuccgaggcacaagaaacucccccucgggauggcgcccacgcacgcucggaggcacaggaagcucccccucgggauggcgcccacgcacacuccgaggcacaagaagcuccccucgggauggcgcccacgcacacuccgaggcacaagaagcuccccucgggauggcgcccacgcacgcuccgaggcacaagaaacucccccucgggauggcgcccacgcacgcuccgaggcacaggaagcuccccucgggauggcgcccacgcacgcuccgaggcacacgaagcuccccucgggauggcgcccacgcacgcuccgaggcacaagaaacucccccucgggauggcgcccacgcacgcuccgaggcacaagaaacucccccucgggauggcgcccacgcacgcuccgaggcacaagaagcucccccucgggauggcgcccacgcacgcucggaggcacaggaagcucccccucgggauggcgcccacgcacacuccaaggcagcuucaucccaaggcuccagugggacuuccaagaggaccgugucacuucucgcagcccacacgcacccgugugaggcucaguguggccgaggcaccagcaguccagaggggacugaggccagcccuuccuuccaggcccgcccuguccgcgcccucucucucccgccaugaacaggccggaguccccguggccaugggagggccagggcugcuacccggccgugacugaagcaggggcggaugaggacuuccugggggagcaggaaaagggcccaacaccuccgcaugaaccuucuaccuccugcugcccccgggccucuggucaacaucucugggguagacaagauggaaaacagaggccggugcugagaacugccuaaggcugccccagcucuggaaaucucagcaccacguucccguccgggccgaagguaguccagaaauggcucaacuaaugccggacauucuguucaaaacgcccgcccgcucuucucccuaggggucccaggcgcccaggccuggagggauaacccggaugccuggcucccacccaccacaggaagccgaggcuccagggccagaccaggccaaggacccgcaauggauuccaacacccgcucuguaugcggaacaaaagugcugccagccaccccuuccuccaaacgagccccugggaaagaccagucaucauuugugucuccaaaucuagacacagcacgaaacaucuaggugucuccccucugcccacagccugguacccugagaaggacugagccuagacucagucagagcugcggcagguggccucccagacuccgcaccaggaaacaaauacuggacacagcuucgcaagugggaagccacggcgaagagaaggccaggcuaggagggaacuccaaacacagacccacagaugcacacccaggcccaaagacucacacagagccauccgccuggagacauggagacggaggcagccaaacaaacauggagauauucagggacugaagaaacaagggggcagagucaagcucugccaccaccgacacccaggcccgcucccaagccucaccggcuguuguggccuccugccccucaccucccaccuccugagcagcuccaggcacggagggcaggugcugugguuccaagccagggcugguggcccagggggaaggagcccccagagccccaccagcagcagccacagggaaccagcggcuggggccaacgggggccuucgacggaagggcggggcggggcacacccacaacccucccaggagcagccgcucccggccccucccacugcccgccuugcccgggcggugaccuaaaacaccagcuccagagacacacgccccaaacacaggccacucugagucaccccuggggacacuggcaggcacacaggcuccugcugagagcaagggaagcaggugguaaagaucuggggcuccggcagcagcacaagaggggccaggcccacggcuuuccagcucguggagguggacacggucaugaggcuggacuucgggcuggaggcccugccagguacuuccaggggacccccccacccuuaaucuuccuauuuccagaaugcuccccggagcgccacgcuugcaaucccaucccuggccccucagcuccaaaccugcagacuguuugccuccuguccccaggccucucuuucuagaaccuucugcauucuuccccagcauaacaccccuaaccacaggcccugcagucucaguaugucauuccuauucccagacccugggcccaagggugagggagccgggccugggaaggcucggggugucggggccacagcggugcaggucacacuccacacagccccccaggucuccuccacccacccccaagaggcacaggauugcaccgaaggccgcagacuccaaaagcugcagugcagguggaagaggcucccugggaagcagcccuagccccauccuugccuggccugagucaggagcugcgagcacaggggauuuccuccacuucacucuucuuccugguccucaauacugccccugccucaaagguaccugaaaccugcccugccccagccaguugcucagacacccuggggaucagccagcacaaggcagggccagcagugguggggccucagggcaggcgcuagaacugcgggggcucagguggaagacagggacucccgagaggcugugggaggaggguuagguauagagaggguccucccaaggggagaugggaagagaggaccagaggcuggaggcaggccugggaggggguggugggcucagcaggaaggauggaaagcugcaagagggcaggcugggcugcuucagcuacugaaacgcacccagguggauggcugagucccugugccaggaagaagcagggagagaagcggggaggagcagaggaggaagcacgggaguccagaacucugcugccaccgaggccaggccacucccuaccccuccauaaaggcagccuggcccaaccacacagccagggcugcagcccagugggaaagggugguggagggaagcugggcagggaaaggcacuaggaagacggaggcaggccuguccuccccucacacugcaggguucaggcccaaccgccagccuguauguggccaagggaaucuuggaggccaaacagaucuguccacaggucccuccgaccugugcccuucaagcgaucccagggcggggcccagcccugcacucccuaccuucccucgaugacggugaugacaucauucaucuggaugugcagcuuguccgguuccucaaaguccugaagggcccgcaugucugugggcugggccuggaggaagaggaaggucguggccaacucugggacugacgccuggguagccccucagcuugaacaccccagcucuccugggcugaccugucccucaccuccagcaggaagucccgcagggccacaaacgugggucuguccucuggcuugugagcccagcacuggaccaugacguuguagauguccuggggacaguccucgggccggggcagccgcucccccuccuugucgaucuuaugcaggaucugaaggugaggaggugcagaguuugacgacaaacagagcgcccagcccuucacuucccgccuucccuccagcccauccacagcugcagcggcugcugccaugccuggccuccaaagaagggaucugccugccugggaggggcccucuccagagccccagucccuucuucccaggucuggagccucggaacaaguggauguggcaagggcuagagaaggagggcaggccccagcuuuucccuccccgucucuuugcugggcucucccugaggccauacagauacggggcgugagaggagacacggggcguggugggaggcacgggaaguggggggaggcacggggcgugggaggagggaguccauuggugagaggcaguuccagcagggccaggcugcaagcagggaauggaauucaccccaccagcccuaugggggcccgucucccagcccucaccugacugccguugaggccgauccagggcuccuggccguaggugaacauuucccacagugucaccccgaacauccaggugucgcuggcaugggagaaggugcgugucuucaggcucucgggggcacaccuggcagaggcaggggucaaagagaagcccucucaaacacccuaccugcguccgccccagggacuuaaaacacucaugcagcaaacacuuguugugacccccugugccagguucaacagugggucucaggggcgccgugugaagcgggcaggaccccuugacgacacgaugcagggacuuggggaaaucgucuaagcccaggccucuuauucacuugcagccuggugggggaagaggaaaggaaguuucccagccagagaagcauggaaaggaaggaggucagaggcucugggauggggcagggagagaagaucacaggcuguuuucugacuguggugggagaaugacaauucccagauuuggggcgggauccucggauuuggguccuuuggcaggaagcagugggugggaaauucggguagggccuggggaagaaccaaaauggguagaaacagucauacuggcuucacccaaauacacccauucguucugggcacccccgguugagggggaagugccacugcagugaggucagaaaggacaucccggcguggacugaggugcagagaggaggguggugcccagacagggaagcagagcgagcccugccccucaaaggggauggggccgggaaagucacucgagaucgcuaagguucauuauccuccuuggugaaaugagaacaauaacccgcccacuucaucgugcuguuuaaaggcaacuauauucauaccuuaccaugcaaaccaggaugccugaauacaaaagaggcugcucuaaauuacuccaggacaacgggcauaauuuaagaccucugcucgcccuggguguaaagccagcugcucguuaagaugaccaugcguccuggaucauaaggguugcccacagccaccgcuugggaaagcagaacuggaacaacccuucccgccucaaagcaggcagaucacagaccucugggugccucuggcaccagagaaccacaauggucucagcagaggauaagcccacacaggggccagggcagggccaaguaccaccccuagugcacagguaagcagcccuggcccaucuacaaggccugcuguggccugggccugucuaccacuagcucucccuagaacaugcuuaccaacgagucuuucccuggcgaacuucccugauguuuuaggaaaccuuugaauaccuccccacagaaaugccccuuggagaggacacagcaucuaucccuguaacacccccccagcaaugccccuugaagaggacacagcauauaucccuguaucaccuaacucagcagugacccucggagaggacacagcaucuaucccuguaacacccccccccccagcaaugccccuuggagaggacacagcaucuaacccuguaacacccgccccccagcaaugccccucggagaggacacagcaucuaucccuguaacacccccccagcaaugccccuugaagaggacacagcauauaucccuguaucaccuaacucagcaaugacccucggagaggacacagcaucuaucccuguaacacccccccagcaaugccccuuggagaggacacagcaucuaucccuguaacaccccccccagcaaugccccuuggagaggacacagcaucuaucccuguaacaccccccccagcaaugccccuuggagaggacacagcaucuaacccuguaacacccgccccccagcaaugccccuuggagaggacacagcaucuaucccuguaacacccccccagcaaugccccuuggagaggacacagcgucuaucccuguaacacccgcccccagcgaugccccuuggagaggacacagugucuaucccucuaacaccacccgccagcaaugccccuugaagaggacacaggaucugucccucuaacacccccccagcagugccccuuggagaggacacagcaucuaucccuguaacacccccccagcagugccccuuggagaggacacagcaucuaucccuguaacacccccccagcaaugccccuuggagaggacacagcgucuaucccuguaacacccgcccccagcgaugccccuuggagaggacacagugucuaucccucuaacaccacccgccagcaaugccccuugaagaggacacaggaucugucccucuaacacccccccagcagugccccuuggagaggacacagcaucuaucccuguaacacccccccagcagugccccuuggagaggacacagcaucuaucccuguaacacccgcccccagcgaugccccuuggagaggacacaggaucugucccucuaacaccccccccagcaacgccccuuggagaggacacggcaucuaucccuguaacaccccccccagcaaugccccuugaagaggacacagcaucuaucccuguaacacccccccagcgaugccccuugaagaggacacagcaucuauccuuguaacaccccccccccagcaacgcccuuuggagaggacacagcauuuaucccuauaacacccccccgccagcaaugccccuuggagaggacacaggaucuaucccugaaacacgacccccaacaaugccccuuggagaggacacagcaucuauccccguaucaccccacccagcaaagccccuuggagagucccacagcauguaucccugugauuuccagcacccagacccuggcacgugggcccucaagaauuccuagauggauggugagcgaaugggugcaaaggagggcaccccaggcuuagaacagacaagggcaggcccaagcaaaaccaggggcugugguggguccagaaagccccagaagcuuugaggccugggucugcagggacucugugagcuggcagcaccugccccucaccaggcgaagggcaccuugcgauguuccugcaugacguaauggucgucauucugagguagugcucgcaucagcccaaaguccccgaucuugaccaggucgcggguagccaacagcagauugcgggcagccaggucacggugaauaaagcgcuuggacuccagguagcccaugcccucagccaccugcacagcguagcggcucagaguccccaggaggaaguggcccuggugcuuacguagccgguccaacaacgaucccagaggugccagcucugucaccugaggccacggaggaggcaggaggaaugagcuggaggacccugccccuucucagcagcccacgcugggcccccaguccccuuccugaaggcuuuccagagccaggcugcacgcaccuuccuggccugcugucuggggaccucuaggaguccugcaguuucucaggccucucccucgaggcaauuugggaaacugaugccuagagagaaggagcccaaagaggcaguggcuagaaauuccaaaacucagcuggacgugguggcucacgccuguaaucccagcacuuugggaggccgagguggguggaucauuugaggucaggaguuugagaccagccuggccaacauggugaaaccccgucucuacuaaaaauacaaaaauuagccaggcaugguagcgcacggcuguaaucccagcuacuuggaagccugaggcaggaauaucgcgugaacccaggaggccgagguugcagugagccuagaucaugccauugcacuccagccugggcgacaaagugagacuccaucucaaaauaaauagauaaauaaaacauaaauuccccaaauuaaacucaguggccagccccucccaugggaguaacucucuugacacugagcaccagcaaaauccagagacagacccggacuggaccgcagcagacacagcccguaccaggcugggccccuguggaccccuuuacuccaucagguugggggaccaaaguaggaucuagggcgccucugaccuuaggauggagagaggaaccgaaccacacauaugggaccggagcccucucccugcccgcccccucccgcccgcaguacucaccaucuucaugggcggcgugagcaccaccccguagaggcggaugagguuucgguggucgagcgagugcauggcauugaccucccggaugaagucguccauggcuucuggcuggcucaggacaucgggcuucaggcacuucacagccacacucaccugcccagagcgggauuugcaaggacucaggacuugccaggucccagacacgcggagccaaccugcuccacccuccaacucggcucaacgaucccugccugugagcuccucaucuggguggguaagcaugucaccagugccugggcuuacgugcucugcgugaggccuggcuggagaagggcagacggcuggcccucaggagccaucgucggccacaccuccccuuccugggggaaugccgggcuuaaauaccaaccaaaaaguaagagauaaccaguaugaugagagaauauucaaauguuauaaaauggaauuuuuuuuuuugagacagucucgcucuugucgcccaggcuggaaugcagugacgugaucucagcucacugcaaccucugccucccggguucaagugauucuccugccucagccuccugaguagcugggauuacaggcaggugccaccacgccuggcuaauuuuguauuuuuaguagagaugggguuucuccauauugcucaggcuggucauaaaauggaauauuaaaagguguuuugcuguagaaggaaaaugcuguaaauguaaugccaaaaacaaagcuguggagcuggaagucugcacagcggcuuccccgggagaaggaugcacugagugacagcggcuuccccgggagaaggacgcacugaguggacggagaaugaggagcccucugaggugcugggaaugcaccgcacgugaucugagcaguaaggacacggcugcugcacaggaaacagucacaccagaacuguaugcuguggugacacguuaucccugaggggaaaauguuaaaugcaacgccgagaagaaagaacaagauuuuaaaagcuguauccagaauuuguaucuuaacuaaauccaacaaaauaccuaaagugggaggaagaggcucggcuuccucugaguggugggauuacaggcgauuuuuuuuuucuuguuuuucaaauacuuuccaaacuuuuauaauaaauuauuuuuauaguugaaauaauaaaugugcuuaguuaaaccugagcaugggcuggacgugguggcucacaccuguaauccaagcacuuugggaggcuaaagugggcagaucaucugaggucaggaguucgagaccagccuggccaacauggugaaaccccgucucuacuaaaaauacaaaaauuaacugagugugguggugcaugccuguaaucccagcuacucaggaggcugaggcaggaggauugcuugaacccggaaaguggagguugcaggaagccgagaucgugccuacugcacuccagccugggcgacagagcgagacuccaucucaaaaauaaauaaauaaauaaaaccccaaaaauccugagcacggacucugggaugagccacacugugacgcauccccagucccauccacacccugguugggggcagaagagccacuaccagccccgggucccaugccucugcugcgcuggcaggacacagagagcucaccgucuucccugagggcgcgucccacucgccccugcgcaccacgccaaaggaaccaucacccagcuucuccaggaggcgcagguccuucuccccaaugaggcaggugaggcucugcaggggccccuccccugcugggcccccaggggcgggcgaggucuuccggaaggugcucugagagugaugaggugggaacucagccuccagucgcuuuccacugaacaccuguuugaaggcagccgggggccagauggaauccaacaccccagggucagucacucagucccaccccgcuggguccaccuggugauccccggcuucggcuuccagauagguccugguuuugccaaacugucaguggggcagccuggcuggaggcccacacuccguccagggcacacccccaaacaugaacccaaagccugaugcuggccucaaggagggugccagaaagagaccgacaggcaugcagccuguggcugagcggccccacacccagcuguguggagagggagggcaccgcccagccaaggucggagucuccucccaguccugccccacccucccuuccugcacccgccaccccgcagacuccagcccuaacccgcaucgauggagccgcaggggcccuccacagacaccuccuuguccauuuuuagcccuggccccuucucuggccugaccauuuggugcugucugucuccacccucaccagggagucggcugcccuucauccugcccaggggagaggauaauuuuagucugagguugaaccgugagugugugugugguucagaugaagcuaguccuugcugggaaggggccugggaagacagcugggucucuggaggggcgccuagagcugagggcugagacggaaggaaaaguggaggagacucggaggccaggguggacagggaggagccgaaggucaagggacagaagaaaggaggccaugagggucaaagcuggccacgucggucugacucggccuccacugaggcacccacagccuuggcuccagauugcagauucuugccagcuugggucucacgcccccagagcugguggauccuuauccgucugggcuagggugccucaaaucugagggccucuucuggccucugcccugugcuuccucccaguaacuagaauuccuuauguuugcaagcaauguucagguuacaagacccucuacagccauuaucuccggugccuccugcagccccgggaggugagcugggcaguggggaccgguaucauuucacugaagacacaacaaaaaucuggaggccacugaccgcccagggaccuaucaggagccaguggcagauccaagaccccuaaaucucagcaaaccacgcugcucucuucuccugccuccaccaucccgacacuacucauccuucccuaaaacccgggcaaaggaccaggacaguguuuccaggaaaagccaaaggaucccaagagacagccccuuugccggauugcagccaggaaaaucucugcugcccaaucccacugcagcuguucggcccugcccaccccccaacccagcccugaagccagaaguggggaggaaagaccacggcuggcucacuuccucucucauugucuuccagacaaugggcaaaguuccacugagucagaccagggacucacuacaccacagacccaaauuaggacaagguguggggagagguggggacaggcuguggggaaggaagcugucagcagggacagaugaccagagaaacccagagauuagagagggucagggaggagggaagccaagcaaagacguucuggguccagacagguccaccaccccacgcuggacacuggccccaacgcucagacacagcagggcuaaguuaaggcacacuugucaaugagguccuguuccaggcgugccgagaggggcugugaaggccucaccgcacacaggcugcucacguguccguaucuggcggagacagacacuuagcccagcagcucuacaagugcccugcccgauaagacccuggacgaggggguccuguacaaagugccggcagaacggcgagauucgaccugccggggagcuggggaagguucccaggaccagaagcggaggggggcguucgaggcugccccccucccaccuccucacccaccuccucacccaccuuacucauccacgacuugcguuugcacaaggccuuccuccucuucacagccucccacagccgccgcuggccugcagggagagcggggaaccgcgugcugugaaggccgccguagcccgagagaggcugcugccugugguccccuugggggugagccugucacuagacaccgcccacccgaugauagcaaugaaaucaaccccaacuaacccggagccucaacugaccgacggucucugcacuccacuuccuggcacuggcucucaaacugggugaagguguuuaaccaaaaacuugaagcgaugggcuucucccaguucucaggaaaaaucaagguaaugaacagaauuuucucaauguugagguuuuuuucccuccguaaaauuuuuuuaugcuacuggcaucagacaccaacuauccaggccuaaaguagcauaaaucaaugucuaacuuagcacauuacuaccuauuuagcuauuuuaacuaagucagugucuaacuugacacguuauuaccuauuuagcuauuuuaacuaagucagugucuaacuugacacauuauuaccuauuuagcuauuuuaacuaagucagugucuaacuugacacauuauuaccuauuuagcuauuuuaacuugaaagcccuaauacguuucuaauguucuaugaagaacaucaugacuuuuagaugcuacaacccccacuuuuaggaaaaauaugaagauaaggguugaacucaaaucagagcaaaccuguguguaugugcgugugugugcacacgcgugugcgcacgugugugcgucugcgcgcguguguguacauguguguaugccgugcgugugcaugcgggugugcgcacacacgugugugugugugugcgugucugugugcgcaggcgugugagcgcgugcguacgcacgugcaugcgugugugcacgugcaugcgugcgugcacgugugugcgcaugugcgugugugccugcguguguguguguguguguguaugccugugcgugugcaugcgugugugcgugugagagagcaagaaagagagcgugagcacgaaucagcaaaccaucugagaguuagcguucucccuacagaucucugcacauggaccccccgguagucagaaugaugagaacagacucaauucgaugcuuaugaaggaggggcaauggaggacauacacucuacgugagaacaaucacaacggggcauggagugacuccuguguagccagcuuuagggaaggccucacucuccucaaacuccaauucaccuuuauaacugccaacuguucucaucacacaucagcaccuacugaugucccuccugcucccucagggcucugggacagaguucucagcugccacccgugcaccgagugguccugaggacagaggacggaaagggucaggggcaagacaagccaggccaacaucccaccuaccaggccgacccaugccgaucuucuccagguccucauucuugacguacucaaagugggacaggcgggugacguugaggucaucucggagccgcaggaaguacuguugcagcugcaccucggacagcagcuccagcagccagccugugcccuccucuggcugcauucugccgccucccagccucuguggggggaggaguggcucagggacaaggguuguggggggacaacaggggccugcccgagugaccugggcucaccuucaucccacuacacggccacccggaagggcucacaccaccuucugacucccgagggaagcuaccgagaaccgccuggacccacguccccuauuccugccagccacagggcacaauuagggcggcggagauacagcccuggcccuggagucaggagucagggucuugcucccgaaaugugaucugugacugagugacccaagaucaaccugugcucacauuccugcucuaaguuucuaggggucgaaaguccuugaaaaucuuuuaaaaacuaacaguggucucuccgggaacaccgacguguucuuacuccuaauauuugauaaaaaucucuagggugcaaugugccccgagacccaucuaugggcuccuuagaugugacggagaaaacucucagggucagaugagcucuaagcuaaguuccucccagcgccugaccaccccagccucuccuaacaauccaaagaccacuccacgggccaccacucaagugccuacagggccacagcaagcggaagacaggagggagggguggggccugcggugggcucgcagacaccccugucaacagggagcucagaucccaucaaugguugucagaagaaacuguggcccaguguugucaaagcuuuccauuuuuucaagaaauaaaucccaauuuacaugugaaaucucaccauuaaaguuuggaaaagguaauauaugcacgugguaaaauauucagaaggcacacugagccacgaaucucauucccuccccagcugcacagccacccggcuccccaggaguugccagugaugucuucugcggacgcuucagacucuguugucccuacacgaauauucacgcauuaaccauaccauucuguucccugauuucacuuaauauucgucuuucuccugacuuuuuaacaaugcugaauaguucagaucugaaaagcaugcacacgcacacacagcgugcuggccaaagcacacugcaggccgcaaucagccagugguaccggagagugaccucugaccuacacuauccugggcccagauaaagaagcugguggcaccuucaaagcuaagcaagcggacccaccgcacagcaaacccaucccugucugcguaaggugugucagagcugagggcguggccaggcuagccccggacccaugcucaauccccaaagaggaacaggcgagagaaaaaaggccagcugcccggcuggggaccaagccaucccccucccccacucagcgguggccuccuccccagcucccaucacagugagcagcacugagaagcaggcacacacagccugggcccagcgugagccuccugcccccacaguucccaguggcccugccaacacagugccaguuccgacuuuuucaggcagcucagggaaguacaaagaguaacaaaggggaaugagaaacucucaguucaaauccuggcucuuccaccucggcgaccgggccaggcagcugggccagccgggugguuuccaaacuuaaagcuguaacccuuuacuggaaugguucucaugaggcugcacagcccccuaugggacaguucugguugccacaacauuugggggggccuuagugacauucagugggugguugggggacaagagcgugagcuagccugcaaugcguaggacauucucgcacugucccaaaucccacacaacucaauucaugaagguguuuaugaucaugcaaaccuagaauaugaucccacuuuauauauaaauaagaaaguacuuuuauaguuuuuugguuuuuuuuuuuuuuuuuuuugagacagagugagacucccaggcuggaguacaaugguaugaucuuggcucauugcaaacucagccucccggguucaggcaauucucccgccucagccucccaagaagcugggaucacaggcgcccggcuaauuuuuguauuuuuaguggagacaggguuccuccauguuggccaggcuggucucgaacuccugagcucaagugauccaccugcccuggccucccaaagugcuggggagccacugcuccuggccuuacaguuuuaauauaaaauaaauuuuccuggaaugaaacuacuguguaaacuuaagggaaaauggacuuugcuuuauucagaacauagcagaaguccacuauuugcaaaaaugucagugaaggcaacccccucucauuauuucaaaacuccccucucggucagcacuugcagaugcugccuucacgguguuuccaccugaggucucaagaucugacuccucacuacauugucuagguuacuaacguauuaggauacauaaaauauuauuaccuuccucuuaugucucuuuauauuagaguucccacuguguugcuuguuucacuguacacagguuaacauguuaauauaacagguuauauauuucuauuaacuuuauuuaagacaaguaacaauaaaaauaacaucuaggccaagcacaguggcucacagcuguaaucccagcacuuaggcugaggugggcggaucaccugaguucgagaccagccugaccaacauggagaaaccccaucucuacugaaaauagaaaauuagccgggccugguggcacaugccuguaaucucagcuacucaggaggcugaggcaggagaaucacuugaacccgggaggcggaggcuguggugagccaagaucgugccauugcacuccagccugggcaacaagagcaaaacuccaucucaaaauaaaauaaaaucuaacacuucaacugcacuuacuauaugcgaggaacaguucuaaguauuaagcuguauucauuuauccucaacaaaaucaucuguuuacaaaacaagaggcgugggguuuaagaggaccaggcgucguggcuuuccggaagcaagcccagaggcacacuaggagucacgggccuaggcagcgucuccucuccacccggccacggccaccgcugcccugucccuggagcaaagugacccccccccuccagggcucagccucaggauggaggcuccuagucucccgcagggagagcagucuccagggcuccucuucuuuuucccaccaccaacucccaaggauccaggcccccuccucuaggcuccugaaaacagcucaaagccaugcccgggguggucagggcugggggagacccagaggccccuccccugaagcucuucagaaagcacagcccggccuguucccucucccugaaacaccagcuaaugcaccucuguucagcugugcacuccaugcucccugacccagcaacagcgcagcucugcacaggggaugcaugugggaggacgggaaggaacuccgggaugcuggugaggcaagcggucagggucucaguccagggugacuccgcagggguccgccuccccucuaagucccccuccagcccaagguucuuugugcagcacagggcauggcugcagcuccuccagaguucaaacacucuccaauucugcaugguccuggcccccgcaccucauggagucugcacaccuguguccgucacuacucuguggccggcgugcaaacacacaggccaagaagaaggaaugcagcagccgcaggagaggccacuuggcccggacuccccgucaagcccucacuggcggggucccucagccgcucccagucuugcuuucugccucucagucaagugcuggugcugaggagcccaaccaguccccagcaguccagccccugccccccacucacuguguacaggcgucgccgcagucuggccaggagagggaaggagagcuccaggccagggaaccgacgugcugccggcaucuccacgcagcgggacccccccgagcagucacuggggauccaguggccucggcuccggagcuucgcacucugcccaggagccccccaaaucccacaccaggggugggaaaugaggaagaacggggugggccccuccgcucugcugcaagccccgcuggguuuccacagcuggccggucuggcagggagcagagcuuuccucacgcuggcugcagccgggauccucuguccuguuucugucuucucuccagggcaguggucacaguccagcccuacuccccggcuuccccacccaacugcccgcccggccgcccucccucuugccugccucucucucucccucucucccucccuccccagcugagcagcucugacacuggcugaaaaaggaccuuucugaaucacugccaagagggcggcaggaaugggggggacucuuccucccagccacccgcgcuggccccccugccuccccauacacaaagcuccugucucuggcuucuaccccagcccucacaguugcagacaacuccugggacuuuaggguggcggcuaugugacucaaacagcacguaugaagcagggcuguggacucccucauggaccuguguggggacguggggacuaacacacagccugagugggaggcuuggaccccagaggcuccgcugggcccugcgaugacuccucagagacccucccccacccccgagucccagccuuggcugggugucuccuggcucagacccugauguggcccuguuacccuggugcccgacggaaauaggcggccggcagccugccagaguggggcaguccagccaagagcaaggguaggguggggugaggauccucacccccuccccugggguggcccugucugcugcccaaacacccagggugccuccuacucagaccagguggccaaguucccaaacccgcucaaaacaaacaaauaugcccugagacuccugcugggacgcccccaccccaaagcuguaggaugucuccuguauaaccccugacacagaccacggccucagauuaaggggccuagagacacuccaucaagcccccguggggcccucauguuucuagaacugacaaaugaucucucuggcccuccucaaagggugccagcugcucuuacaccccccucgcuacggcccccagacacaccugacagcugcaggaagcccucuccagcuccccaggcaccccccucccugcugagccaugccuagggagccccuguuucuugcacacugcucucuugucccuguccagcuggccaccagcucagggagccucagcuggcuggaggggugggcagcuggggagcagggcuuuggggacucagcaucccaggcucccuucccagggccucucccagcacuugaccucccugaugaugccaaaagggacagccauuuccuggucuaacuccaggagguggggagaaggacacccccaacuucagucccucuuccucaucccccugccauccagcccacaaagcuuguggagauggcagguguggauggagugggggcugaggucagguggacaagaucaggccugcguuacacuggagcugacuuuuccccaaaccuuggcugacugugcccuugcaucagagaagccuacagccuuacccuggcaccaagcacaccuggaaggagacccagggaccgggggccggggaacaauuuaagcaggguuauucccucuauuucaaaaugggucugcuggaucagaauggccagauuaaaaacucuagcguccccagaaauaugugucucaaagucaccagaaccccaugccugaccuuggauguccaguaagaacaagaccuguaacuggcccaguaauccagcugcgggaagaagcaaaguaugugugggucagcgccaggccggcuccuggaacccccacccccuuuuuuuuuuugagagucuugcucuaucgcccaggcuugagugcaguggcgcgaucccggguucaagugauucuccugccucagccucccgaguagcugggauuacaggcccccgccaccgugcccagcuauuuuuuuuuuuuccgccauguuggccaggcuggucccgaauuccugaccucagcguccucgucucaggugaucugcccgccucggccucccaaagugcugagaugacaggcgugagccaccgcgcccggcccggcccggcccccuuucuccucgcccaggaaaacagcccgaccuuaagccccaacgcuccuaccgagucccccuuucuccugucagcuacugcccucugccggucgggagaggaagugcguucucuccaaggggaagggaagcuaccccauccaucaacaccgugaccauauuuucaaaagcaaacaaggacaucuggcuugauauucauauucagaagccuaguaaacgggaaugcccaggacauacagacucaguucuccuaaaagacugaaccccaauccuagcaguacuuccuggacucccuuggggcauggaagaaagcccaacgggcagcuuuuuggggucccaggggauccaugcacacacaggcagaugccagcaucacuaagucaccaccgccacacccacauaaacacaccgcucucuguccccuggcccaggagcagacacucucacuccugaggccgccgcagggggcagggcugagcccggcucacagcagacgaaggggucuggggcccagguaucuggcuauccccuagccuuccccauuaccugcggucccuccucgcccccagccaggcgcugguaagcagaucucucccccauggagccccaaaucccagcggcugcggucagggagagaagcagcgcccgcagcccccgccccgcagcggcaccggcagcgucacugcccugcguccuggggggccgggccucgagcauccuccagaagugcagggccgcuacugcgucucagcccccauagccucauccgccaucggccggcggccggguggucgcgccccuccuccugccggccugcggccauucccuccugcagcccgucccagcuccguuccuccucuccggggcgcggcucccacccucucccagugagccagcugugccagccccgggcugacccccaccgagagccggggcucugccuucgccggccgcggaaccgggcuccacucagcccucagcccgccuccagggccccagagccaccaacuggggccuuggggauucacgagucccccguauucacgguaaggggccauccgagaagcccacagcagaggggccuccguccgacuccaucugagacccccuccuccgaggcaucccggggcugcagcccaccccgcccccagccugccccggcggccacucugcucccagaacgccgggcgcccaccugccccgcagcucggcccugcgcucagccggcuccgcgccgccucccagcgcccgccucccgcgcaggccacgcccccgccccgaggcccccgcggccgguuccccgcgcgccacucccgcaacgccgcacgcgcugugcgcugggcacgcacugaccuccuugacuucagagcggugacacgagggcccggacuccugcucaaaagccgcccaacacaggcccacgcgggggugccgcgcccagcacuggcgcgaggccaucgccggcacaggaagucccagggcagaggcucuuccucucccccggggccccaaggcaccgcuucucauucugguggcaucugaagcagccacugacucuuuaguaccagguauuuagggcugagcucagggcaccuucccuggguuggggcagaggagagacagaugcugugaccucuccuccccacgcagcgucaaggcugagccagacccuggaaggucacuaggugaggcucccucuacggcccacucuccucacacagccccuuccacaccccaagcacaccaggguagguggaugacugccggcgaggcccccgaacgccugcuucuaugcuguacagaagcuccucggcaucuuacugcagcuaaaggcacauacuagucuugggaguagcugcaaagccgggagacuguagaaggcaaggcagaaaauaccaggccccucccuucuugcccuggcuggauaaaggaucugauccaaaccagugcccuuuccugcuuucucccugccucaccucccccuguaaaucucuggcguccuaguaccauccuaucguaagacauccacaggaucuaaacuaccucuaggaguucgagaauccaccccacguguacacccccucugcucuucacuugucucuuuauaucuccacucugcagagcuaaaggaaacaagaggcuggaaaccagcccagcucugcuguccauuccccucuccagccucuccaacugcaugcgaagugacaaauccacaccaaggcgcagacaugacaggcaauuuccggccaagaggauuuuuccaaaacaaucuaccguauucucaggaauauaugccaacccuaccucccagcccgcccucucccaccuccaccuaccucuucuccaagcccugaaggaaaaaagaacauacugaugaggagaggggggcuuacagcuccucccccagccagaggauuaucuugcuuccacaugucagccccaccaaguuuagucagccuuaacucaccccucugugcgcagagcccaggcuucuggagcaaggccaggcugggugcccucagaaccucaucccagaggaaccugcaccaggcaacccugcaccuucaggucggcugggccugacaucacacuggucuggggaggaggcuggccagggcccaagaaagaaaagggagugauucagacacacgccaugacuguccauagucucuccaucuccaggacacgggggcccacucccucccaggggggccuggcagcugagguccugagggcaggcaaggcugugucugcuggcagugcuaggcccaugguccagcccugaagccucuucaccccacauguuuuuuguuuguuuguuugagauaggaucucacugugcccuagacuggagugcaguggugcgaucuuggcucacugcaaccucugccucgcaggcucaagcaauccuccugccuccaucuccugaguagcugggauuacaggcgugcacuaucacacccagcuaauuuuuguauuuuuuguagagaugagguuucgucauguugcccagguuggucucaaacuccugggcucaagcauucuaccagccuugcucucucaaagugcugggauuacaggcaugagccacugcgccugcccacccccucacccccccaccccccccccaccccccgcccccagcuucuuaacuguugguauuuccuaagacuuuugaacucauguuuccuucuauucuccacugaugcugugcucccuggggucaccuaugccuccagggacuccuauuaccaccuugugcuaucuccauuccugaauuccuguggcuccagacccgcauuuccagacauuuacagggcagcuccaccaggaggcugcacagguaccacacauugcauauccaaacugggcucagcaucaccccuuaaacucugcuucugcgcuccuguaucccgcugaaaacaucacaagccaacacuagccacccgagguagaaaccacaccccaccacggacccccaaccaagacuccuccuccguccuccaccuucuccaccagacacaccggucgggcugcuucaaccgccucagacuuccucccaacggugacaaugagaucaggagucaggcagaugggggcugaaauccugacuccaucacgcuccagcugggcaacuuuugagcaaacaaccucuaagccucaauuuccucaucuguaaagaggggaaaaauggaauccccaucauaaaacugucaugaagaguccaccacggcaccuggcugccugcuguuacuaugggcccuucccucaguccucgagggcccaauccuggcuggcacgcacgcccucugggcugcacuccucaccuaguuccccaccucucucucuuagcauucccuucaaaugucucuaugucccagccaagccaaguguuugcccuucccuagacauacucugggguucuucuuguuuuuuguuuuuaagagacugggucuugcucuguugcccaggcuggagugcaguggugugaccauggcucauuuuaauuuugaacuccugggcucaagugacccucccaccucagccuccugaguagcugggaugacaagcaccagccaccauguccggaugcccuuuaauuuuaaugucugcggcugggcccgguggcucacgucuguaaucccagcacuuugggaggccaaggcaggcggaucaccugaggucaggaguucgagaccagccuggccaauauggugaaaccccaucucuacuaaaaaauauaaaaauuagccgggcgugguggcgggcaccugcagucccagcuacucgggaggcugaggcaggagaauggcgugaacccgggaggcggagguugcagugagccaagaucguaccacugcacuccagccugggcgacagagagacuccgucucaauaaauaaauaauaaaaaaauaauuuuaaugucugagcuauuuuuugucugugacacuucuacugugucuacaugauaaacucccacacacuccucaagauccaagucaaaugccaucucuucuguaaauucccauuuccuagccacaaaugguuaucucugcuguuuuguuggagggaugcuugaaaacaugaguaguaaaacuacacaauaauacaugugaaaaauagccaaaauaauuuuuuuuuuuugagauggagucuugcucuguugccaggcuggagugccauggcgcgaucucggcugacugcaaccucugccucccggguuuaagcgauucuccugccucagccucccaaguagcugagauuacaagugugcgccaccacgcccagcuaauuuuuauauuuuuaguagaguugagacgggguuucacccuguuggccaggauggucucgaucuccugaccucaugauccgcccaccucagccgcccacagggcugagauuauaggcgugagccacugcgcccggccaagaauuuuaaaaaguuuaaauuauccaucacguuccuauccuuaaagggucacuauuccuguaacucuuuguaucagcacauaauugugcugaaggagcggucuguauaccucugcuguggucuguacaucguaagggaaccaucuguccacaucugucgcccugaagggagaaccuggcaggggcccugggugugucugcugagaaggacucagucuuugugaggaacacuggagaacgguggcugcuucuucccccgugagcugcugccagguugcuuucccagugggugccaggaacaagccugguugcccucucccagccccggcuuugccuccccccaugauuucuaauccagagacgccagcaccuuucugggaagaggggcuguccaugucaucacaaccacuccgaccccagacccacuaagcaacucagucccccaaagccaucucagaaccagaacaacucagccagucccucaggcagagggagagccugacauuggucuuaaggaaggugccuucucaucggacugcgaaggggugcuggggcgcgggcugccacacagggugaugggaagggggccugggucugucaggaucccagcucaccgagagagaggaggggaacaggcaggugccagggugggagggcagagcacagaggcagaggcagacacaccaggcagggcccugcuaugccucguccccuccaacuccaguggagaagggaaugucacuugagagaggaggggugaggaucugacuaaacagcgugacccaguccacacugaaccugaggcugacuggacuugguggggcugacacguggagacaagagcauccaucuguaucaagucuugaaaguacugugaaaccguuucaugcuccgccagcugaagaccggagugucaacgccgacacaaagagacaguacacugagggcccuaaugugcuccuggaccaucgcuccccaacacagacaccagcagcaguggguggcagaggacacauugcugcagcugucugggucucacucccaugcacgccacacaugcccaggugccgaggccaggacacgagugccgcagagagcugccucucguugccuguccugcccaugcacugucacggcacgggggcccagagggaaggauguggucuagcucccagcagcuagccacucccagagagagcucuuccagggcugggcagaggcugcccggcucgucauccugccugcugccagcucaggccauaccccacccccaagcccuacgcaagaguccagagcugaaggggccuauuguuggcccuggagguggaguguggaaagaaggaguggagaggagaugccagagcugggaagugaacauucagucuacaagauacacugcucauucccucaggaccaugucuacaccaagacccaggagcugggaacaugucaccuagagcaggccgcagggcccaggagagccugggagccagagaaauguccggugcuucaagacauacaccuuaaaucccacuggacccugcucaccaucugaccuugaagagcccgggacccucaaaggggaaggggcgugccugguccaagguaccaggaagcugucaucgggaauggaggcucauggaggcucaggaucugggggagggcaaauguuagcggaagggugacucucuucuggccacaggguagggggagagcccugccaaggucaggguaccagagaagaggcccugcuucauuggcagacacaguguacaggggacagagagaaacagaggaguccaauguuggcagacacaguauacaggggacagagggaaacagaagaguccaauguuguuacauccagcuggggggcccaggagguacagcugcugaggaggaagagagggaccaggaaaaccucccuccccucucaccuuccuuagacacccaccaugcaccccacaugcccacccgaugcugguuucugggagaauaugaaggggcagaagucauagccuggguccucaggaagacacuaugcgccagcucuucacugagaguguaccuucacuggcugaccaaaaaccugccuuacuaccccagauuauccccacuuuacaaauauggaaaccagcucuggagagguggccaagagcacccagagaguaaaagguaaagccagcauucagcccauucacgacuguacugcuuggcacaaggaugcgggcccauggagguccccgcggaagucuuaugacccacauuggacucgcugaguggauaccaugucauucacugacgcugagugaaugcauggauucugugaggaagucugaagaagggacagggguuccaggaaaaaacaguagauuccacacagugucacuccuuccugaaaccucaccagaacaacaauuaaaaaaggauguucugaaugccauaggccccuagggagggggagaaugguagaggaaaaaccaccacagaacuuuggaagcuggaaagcagaugggcugguggcaguugagagcugacccaagaaaaucacaaaucccagcgugagagacacuugacugaccgccugcaauccucaaaagcccaggaacuggcagccccggaaaccucuggaagaagaggugagugucagaagggcaaugcuaaaauacaggggauuacugaaaaguuauuuaagagacaguaagggccgggcgcgggggcucacgccuguaaucccagcacugugggaggccgaggugggcgaaucacuugaggucaggaguucaugaccagccuggccaacauggugaaaccccaucucuacuaaaaauacaaaaguuagccaggcgugguggcaugugccuguaaccccagcuacucaggaggcugaggcaggacaauugcuugaacccaggaggcagaaguugcagugagccgagauugcaccacugcacuccagccugggcaacagagcaagacuccgucucaaaaaaaaaaaacaaaaaaaaacaaacauaaaaaaaaaaaaaaacaccucucagcaaaguaggaauaaaagagagcuuuuugcaaccugguaaaggucagauaugaaaaaccuauagcuaauaccacuuuuuuuuguuuuguuuugucuugugagacaguuuugcucugucacccagacuggagugcaguggcgcaaucucggcucgcugcaaccuccaccuccuggguucaagcgauucuugugccucggccucccaaguagcuggaauuacaugagcauaccaucacacccggcuaauuuuuguauucuggguagagacaagguuucaccauguugcccaggcuggucuugaacucgugaccucaggugauccacccaccucggccucccaaaguacugggauuacaggcgugagccaccgcacccggccagcuaacaccacuuuuuuuuuuucuuuugugacagagucggaaugcaguggcgccaucucggcuuacugcaaccuccaccucccagguucaagcaauucucccaccucagccucccaaguagcugggacuacaggcaugugccaccacacccagcuaauuuuuuguauuuuuaguggaggcgggguuucaccauguuagccaggauggucucaaucuccugaccucgugaucugcacaucucggccucccaaaguauugggauuacaggcgugagccaccgcgcccggccagcuaacaccacucuuaauggugagagacuaaaugcauccccuggaagaucagaaacaagguaucuacccuucuauucaacauuauauuagaugaggcugggcuugguggcccacccccauaaucccaggacuuuggcaggccgaggcgggcaggucaccugaggucaggaguuugagaccagccuggccaacauagugaaaccccaucucuacuaaggauacaaaaauuagccgggugugguggugggugccuguaaucccagcugcucaggaggcugaggcaggagaaucgcuugaacccaggaggcagagguugcagugugccaagauugugccacugcacuccagccugggcgacaagcaugaaacuccaucucaaaaaaacaauaacauuauaccagaggauccagccagggcaaucaggcaagaaaaagaagcaacaggcauaaagaucagaaaggaggaaguaaaacuuuauuagcagaugacacggcgcccuauguagaaaauccaaaggaaguuacaaaaaagcuugcuagaauaagucaauuuagcaagacugcaggauucaagcucaaaauacaaaaucaaugguauuuacauauacuagcaacaaacaacuggaaaguaaaguuuaaacaacgguaccaucucauaacagcauuacugacaacagccaaaaggugaaagccgcuugaggccaggaguuggaaaccagccugggcaacaugccaaacucccgucucuacagaaaauuccaaaaaaaaauuagccaggcauggugguacacaccuguagucccagcuacccaggaggcugaggugggacgaucaccugagcccaggaagucgagguugcagugagccaugaucacaccacugcucuccggccugggagacagagugagugagaccuugucuuuaaaaaaaaaaaaaaaaaaggugaaagcaauccaaguaaauggauaaacaaaaagugguauauucauacaauagaauauuauuuacccuuuaaaaagaagaaaauucugacauaugcugcaauguaaaugaaccuugaauacgcuaggccgaggugaaauaagccaggcacaaaagcacaaacacuguaaaauucuacuucuaugaggcaccuacaggagccaaauucauagagucagaagguaaaauggugguucucaggggcugagagaggagggaaugggaaguuacuguuuaauaggugcgguuucaguuucacaagaugagaaaaguccuggagauggaugcuggugacggcugugcaacaguaugaauguauuuaccaccacugcagaugguuacaauggcaguauauuauguauauuuuaccacaauuaaaaguuuuuaaaaauaaaaaaccaauacuaccaggaaaaaccaguaucauuuacaauagcauaaaaauagguacuauuuaaggauauguucaauaaaagauggaaaagacugauauaccaaaaacuacaaaacacugcugagagauaguaaacaaaaccuagacaaauacagagauauacacuguucauggucagaaggcucaauacugcuaaccgaucaauucuccccaaauugaucauaaucccaaucaaaaucccagcaggcuuuuuuguagaaauugacuaacuaauucuaaaauguauauggaagugcaaagaacccagaauagcuaaagcaauuuugaaaagacaaaaccaaguuugagaucuuacccugauuucaagacuuacuauaguuuauaaacccacaguaaucaagauagugugauacugggauaaagacagacaaauagaucaauggaacaaaacagaauccagaauuagacacacacaaacaauugauuuuuuucuuuuucuuuuugagauggagucucacacugucgcccgggcuggaaugcaguggcgcaaucuuggcucacugcaaccuccgccucccggguucaugcgauucuccugacucagccuccugaguagcugggauuacaggugcccgccaccacgccuggcuaauuuuuuguauuuuuaguagagacaggguuccacuacguucaccagcuuggccuugaacuccugaccucaugauccgcccgccucagccucccaaagcacugggauuagaggagugagccaccgugcccagccagcaauugauuuuugacaaagauucaaaggcaauucaguggagagauacaucuuuuuaauaaauggugcuacuagaucaauuagaucucuacaugcaaaaaacuggacauugauucauaccuugcaccacguaacaaaaauuaaccccaaacgaauccuagaucucaauguaaagcccaaaacuauaaaaugucuacaagaaaauacaggggaaaacuguugggacuuugggucaggcaaagauuucuuggacaugacaccaaaaaugcaauccacaaaguaacaaauuaguaaauuaaucaaaauuuacaacuucucuucaaaaacacagcauuuugcacuacugaucaugagaauuuuuuagaagacauuguuaagaggaucaaaauacaaagccacaagcuggaaaaaagauuuguaaaucacauaccugauaaaaggcuuauauccagaauauaucaagaacucuucagaacucaacacgaaaaacccuacacaauuaaaaaugggcaaacgaucugaacagacacagcaccaaagacauacguauggcaaaugagcacaugagaagaugcccgacaacaugagucauuaaggaaauacaaauuaaaauuguaaugagauaccacuacagacaugagagugucuaaaauuagagacugaccacaucgagauguggacauaucaaagacauggacaaaccagaacucucauacacaguggaugaguauauaaaauguacaaccacuuuggaaaacagucuggcaguuucuuaaagguuaaauguguaccuaccacaugacccagccauuccgguccuagggauuuaccuaagauaaauaaaaguguacauccacacaaagacuaacaaacacguucacagcagcuuucucugaaaacccaucaacaggucaauggauaaacagacuuuggcacacguguacaaugacuguugauacgcgcaaccaccuggacaaacuccaaaauacuucuguugaaugaaagacgcgauuccguuuacaguaaaugcugcaaacucagacacagugacagaaaguagaccagccuguuaccugggguaggggauggcagaggagcgggggauggagggguuccacaagaaaacuucuggggacaggggaauaagggggauguucacuaucuugaaggugggggugguuucacggguauauacacaggccacaacuuauuaaauuguguguuuuaaauaugcucaguuuaccauaugucauuauaucucaauaaaacuguuauuuaaaacaaacaaaaagaaacacugcaucuucuagacgaagcacaaggugggggcuaaucccgggcucaggggccagagggaacagucugacccuuccucccuaacaucugccggggcuccggggaggugggcaccaggcuccaaagggccugagguuucuuuacucacgacacugcaggggaaguccuggcccaccgcagacaccaagaaacugaaaccuaaagacauuauguugcccaaggaaguuacacagcuuguaagcgauauaaccagaucaaaagcaaucugugugaugccaaggccuuucucccauucaucuaccacaaguucaaaaacgccgaccugaaauaaguaggugaagauuguguguauguguuuaaaacagaccguucucuccacugaagccagacagugagagccacucuggccauuccagaagcgucaggcaccgugggcacagcagcugaacuuccggugcaugaguguuuggguggcagcgcgacaggcaugggaugaagcugacaggcggguuugaguuugucugaggagcgggcuaaccggcuccuccagcagcugcuaccuccagcaccacucccucugcccccagaggagagcacccagucugguucgggacaggggucuggguccaucugacucacagccacaccucgggcuggggcagaggaggguccucuagcuaaggcccugggcaagcagcaacccugcacccauccccacccaggggcaggggaagcaagcaccugacagugccagguaagaggcgaacagcucuaggagaguaaggcccacaagcagcccgccaagcccccugggggcacgaggcggaaugaguaggucuggcacucaggccacgagggagucaacaagccaaauacagcccccacccuuggccccuacaagcccuaccucuagacugggcugggagcuccuguccugacaggugcagagcccaugauaccacagcggcccaucugcaaaccuccccaggguggggccacagaggcagcccagagcccuggggugcaagugcacccuccucucccgccccucuaacgcugggucgucccacccagagacgagagggcucaccaguugcucucccuccuuccgcccacuaaucauccuuggcucugggcccucaggguaaaucagcugugacaggacggcguggcagaagcgggccaggcucgugccguacccaagccacuagcugucacacucaucucagcucacgugaccaacaggguuacaagauaagguucuguuaaucccacgcugcccucuucccuucugugggacguguuuugaggacuuguguguugacugcaccaugcagagcauauagcauggaggcaccccuacugccaucggggggcagguggaggggggaccguccugcagcuccucccuggggcuaccccucucuucccucugcacagaccuggcagccacccagacgucccgccugcugccuagacucuaagaagaugcccuaucacuccaauuaccauacacaguacuggcgggggagagguccugccuugccgcugaaaacugcacugcuuccucccuccagggaugaaaggccaaaagaacgagggcaguguggagucuacgcucucgccagggaccugcagccucucacuuccaagcacaccaacuccagcuaacaggacugggcuuccuuaccugccgccuuccgcugccuccccgcagacacagcuucagcgacgcccaggcugagacggcagaagagguucccgccggccgcggccugcccucaggcaguggcucccagagcucagcgguuccccgcacucuucugcgcccgacuccccaugccccuacauccugcguccccuucagccccggagguaccguggggcccgggccugccagucaccaccuccuccuccgccggcgccuccggguccugagccccucgccgggucccucucccuccuggggcuccuucccguucagguagguuuccuggacagcccgcaccaccugucccuccugcaccccgggcagccaauucgccucuugcacccccaggcgccccucccccgcaggcccccggggccccaccggccgggcccuccccaccagcucggggcggcuucggggcgccggggccgcucccaggacca

SEQ ID NO: 21541 - RNA, 8169 nt, Homo sapiens
aaaacuuuuagaacaaguagaugaugaaaaugaagacucaaauaugaggucaugagauuuuuugcuugcgagacgcugacccuaucaauugagcuaaaggacucuucaguguaagaaaagggauagauucuggaagaacaggaugagccugaaaaaacugagcuuaaggugcccaagggacuuguuaucucaaaauucccugaguacaagguuaagacucuugacuuuggaaaaacugaaaagaaauagcagaaaaggaaauacacaaaagaagaauccaucagaagugaacaucacgucucccuaaagggaaauuacagugucuucuuuugacccgagagaauauaaagcccuagcugucucuuccagccgguuucuguauucuaguuucucauaguuggagggacucacuccuuuaaaaccauacauaacuccccaccagcagccagcaauggcagcuguagaaucacugucuccaccauggaaaaaggcucggugggcaagcuccuuccaggagucuccugcagcaagaacagcaucguaggcaaucaugggggcaucgugcccacugcugccaccccagccagaguagcucagggagguguagaacugaucccucuccuucacaccgaaagacucagggaagguaggggcugauucuccauccaaaaucccucuaaguuuuagguaauuuucccauuugguuuggaaguaggaccuguagaaaggaaaaaaucuagagucaauugaaaaaaauaaagugaaaagucauaacaaaaagcaccagauggaugugugaacagagaaaaauccaacauaacuucggcuucuugcaguaauaucauaaacuauuuaaacaucaaaauuauuucuauauaaguaccauucauucaauacauuuuucauaaggaucuacauaaauaaggcauugauccuguugcuaaauaaagagauacauaucaaguuaaaggguaagaaauacagguuuguuuucccugggagggucgagaguaaugaccuuuuaaaggggaacuucaagacaucacaacugugggugacuucagcagaaagccucuuuuuauucuaagaaagacaaugugaagugaacucacgagaaggggaagauguggccuuaccacuuauuaguuagcuaguggaaaaacguaucucuggaauuuuaaccaaggauuucaaaauauuauuuguauaccaagacaacacugaaaaagcaaauuccaggaaaguaggaaauaggcaugaaaauucauggcagaauaggauagccacaaaaaugacaggauuccguguaagagggaaacaccacagcugcccuauucauugagguauccacuuggcuacuuuguagaaucauuacuggaagggaacuugaaauccuuagcagauggguagaaagggggcugggggugaaaaccaugaggguugcugugaucucugaauacaagacauauaugugcagguggauguacacgcacagauucaaccguguuugagcagggcgugcgcuuacagacucaccaguguugaagauuuuccucuacaaaguagccugauuggacaauguacuuuuuagcuucugguagcagcuccaucaguccuuuuccccacugcaaggguggucugcuauucacagcauaggcuguaaaaagagcagacgcaagggcccccagguagccuguugggugguggugggucauccgaccacucucgaugcucacuuggaucaguguguccaguuggcuauggugugggaaccugagaccgaugcacauggcccgcauggcagccccacagccgcccucauggcuguugaagggaauccuccagccauugggcuugcccggcuucagcugcauggcguugugcaccgaggcaccaccuggggaagagucggauaagggauggggguuagcauaaccaaagcaaaggccccagcaggaauaaauaacuaaacucugucuccaaguauuuuugauggaaagggagagccaaaaaauaugaugaugcaugccccaaaacuccaaaccccacccaacaaugugccuuucuuuauguauaacccuuggcaagauaacgcuaauaaaggcagcagacucauauagggauccuuggaaucuuuaccagucauuacugagacaucacaaaaaaauuaagaaguaaguauauuguucucuuuuuuaaguaaauaagccuuuuaagcucagagcuuaagaaacuuccucaaaaucacauaaucagcuaguuaguggcuggguaaaauccaucagacuccaaagcccaauuccuuauggaguccaauaagaaccuuacaauuaggccgggagcaguggcucaugccuguaaucccagcacuuugggagguggaggcaggcagaucacgaggucaggagaucgggaccauccuggcuaacacggugaaacuccgucucuacuaaaaauacaaaaaacuagccgggcguggugacacaugccuguagucccagcuauuuggaaggcugaggcaggagaaucguuugaacccgggaggcagagguugcagugagucgagauugcaccacugcacccuggccugggugacagagcgagacuccgucucaaaacaaaaaaccaaaaaacaaaaaacaaaaaccucacaauuggaguuccugaacaucaaaaagaaagaaagcggccaaaaauucuacagugaagcccugggcucagaugaggagcaguggauucagggaaacaaugugucuuuggugagucacugaaccucugggccuuggcuauccccucgugacagugacguaagcaggcuugucccccgaccuguccuacuggggaccugugaauacgcaugcgaaccaagcgauggcagcaacauacgauggaguguggcacugcuguuccuuuacuggucaguguuuucacaaaaauguucauggauggcacagguggacaaaaaaaaguuuccacuugcuaaacugaugagcuaucagaugccgagaaaggaugaacagagauuggcaucuaaagccaauccuuggggugacaagggccccuugguauggugaugggaagcuuucaucaggagguguuaugugcugaauugaguccccccaauucaaaugcuguagcucuaaguaccucgauuuggagauagggccuuuaaagaggugguuaagcuaaaauguggccuuuaggguaggcccuaaucuaaucugccugguguccuuacaugaagaggaaugcaaacacacagaaacaccagggauacaugcacacagaggaaagaccaugugaggacacagcgaggaggcagccaucugcaagccaaggagagaggccucagaagaaaccaggccugucaauaucuugacuuggauuuccaguuuccagagcugugagagacaaauuuccauuguuucagccacucagucuaugccauuuuguuauggcagcccuagcagccucaaauaggagagguaggucagaugggccagagaaaaucaccugguggcccaaguggcucuaacaaguugccgaagugggcaagaaccacuugugagcgaaccuguggccagaagucucuacaaaagccuuugcauuuuuuuuucuugagauggggucucacucugucgcccaggcuggaguccaauggcgcgaucuuggcucacugcaaccuccgccucugggguucaagugauucucgugccucagccuccuggguagcugggauuacaggugugcaccaucacacccagcuaauuuuuuaauuuuuaguagagaugggauuucaccauguuggucaggcuagucucaaacuccugaccucagaugaucugcccgccuuggccucccaaagugcuuggauuacaggcaugagccaccaugccuagccgcauuuuucuuuaaaaauaaaaaauauacauuuuucuuuuuacuuauucaucacagaaaacuuagaaauacaaguaaguaaaaauaaaaaacuauaaauacucccaucacccaaauauaauuaguaacaucuuuguacauguucuucaagaucuuucucaacacagaaauacauaucuauuuuuuaaaaaaaaguuuuuuuuuggccaggcaugguggcucaugccuguaaucccagcacuuugggaggcugaggcagguggaucaacugaggucaggaguucgaaaccagccuggccaacauggugaaaccccaucucuaccaaaaauacaaaaauuagccagacgugguggugcgugccuguaaucccagcuacuugggaggcuggggcaggagaaucgcuugaaccugggaggcagagguugcagugagccgagaucgugccacugcacuccagccugggcaacagagugagacuccaucucaaaaaaaaaaaaauuuuuuuuuaacuggccacucaaaaaaauuuuuuuuaaagacaggcuuuugcuauguugcccaggcuggucucaaacuccuggacucaagcaauccucucaccuuggccuuucacaguguugggauuacagguguaagccacagcacuuggccccacagaucuauuuuuuaaaggacaguagguucauaacauacauacuauuuuauaaccuauuaguguauaauaauacuuuucaauauuaguaaauauuauuugcaaauuuuaaauuuuuauuaauauuuaaauugacaaaucaauuauauacauuuauuuaguauaaugugaugauuugauauauguaaacaaugugggaugaucaggcuaauuagcauaucuauugccucacuuuuuuuuguggugagacauuugaaauuuacucuauugguuauuuugaaauauacgauacauuguuauugaguagagucacccugaauaauuuuaaaugguugcaaaugugucagcuuaauuaauuaugagagauuuagguucuuucuauuuauuucuuuauuuuuuagagucaggguauugcuuugucacucaggcuggaaugcaguggcacgauccuagcucacuguagccucaaccucccgggcucaagcaaucauccuaccucagccccccaaguagcugggacuacagguaugugccaugacaccuggcuaauguuuuaaaaauuuuuuucuggaguuguaguccccagccuuuuuggcaccagcgaccgguuuuacagaagauaauuuuuccauggacgggguugguugggggagguuuugggacaaaacuguuccaccacagaucaucagacauuagauucucauaagaagcccacaaucuagaucccucgcaugugcaguucccaacaggguucaggcuccuaugagaaucuaaugcgccacugaucugauggaggcagagcucaggugaugaugcuccuucgcccaucacucacuuccugcugugugcuccaguuccuaacaagccacggaucaguaccugucucuagaagagggauuggcuaccccauucuagagacagggucuccguauauugcucaggcuugucuugaacuccuggguucaagugauucucucaccuuggccucccaaagagcuggaauuacagguaugagccaccaccauggccguuauuucuauuuuuaucacauuuacaaacacuauugucucuguuauuuaaaucuccaucaacauucuuaaugauuuccucaaggcuguuuuauucuuugcccuccuugcaccucccaccggcugugcucaccuggugcccgcccauccaugucuuccaugcagucuugguaaugcuuagcaaggagguaauacaguugagucaacuuaggggcuuucccagcuuccacaagagcuucugcuguggccaagugcaucacugugucgucacuaacucuccaccuucccacgucuagggcauccaagccgcccagcugggccaacugccgguguaucuucuccccauccuggaggaacucccacuucccauuguaguaccccagggcaucuccagcugcacucagcaccauagcagccacauacuucuccaucagucccucacaauugcugggcucuggagagggugucuuuguggggaaauuaagacaaaggaaauaggaugaggagcaagaagaaucagaaaaaacaacgacucuagcuauguuuuauugagcacucacuacuugcagacauuguaucaguggcaucucauguaauccucaucacugcucuaugaggaauauaaagcccauuuuauguaugaacaaauggaggaccauggagauaaugcaguuugagaaauguucagugacuugucucaggucacagagccaauaaguggcagggcugggaucccaacauagguccaucugacuccaaagucuaucaucauaacuacaacuguaucucuugccucuuggugaguaguaagcccacuaaauucugcaagucaaacccagcucaucauuugcucuucuuagcugggauuuggccuuagaagugcaaggcuuuacacuuccuauuagugucacaauguguaguucacaaagcaccugcacauucauugucucacuaauagggagggauuacaguaugcauuucacagauaagaaaaugaaggcucagauaagcuaaauucacaaaacaagaggaguggaaguacuggaacccaaaucugauuccagccaagccaggaugcuugguaucacaccacucagccucaguccagaucuucuuaccuugggcaaccucuuggugccucagccuccacauuuauaaaauggcacugauuuuaaaaaguaacaaccuccuggauuuguuguuaggaauaaauaaauuaaauuucauaaaguuggcuggacgcgguggcucacgccuguaaucucagcacuuugggaggccgagguggguggcucaucugaggucaggagaucgagaccagccuggccaacagggugaaaccccaucucuacuaaaaauacaaaaauuagccggguaugguggugcaugccuguagucccagcuacucaggaggcugaggcaggagaaucgcuugaacccaggaggcagagguugcagugagccgagauugugccacugcacuccagccugggcgacagaccaagacucugucucaaaaaaaaaaaaaaaaaaaaaguucuuagagugcuuggcacauaguaagcuugauuuuugacauauuuguauuauucauauacaaccagggaaaauggguguucuguuuuagaacuagaacauuuucuccccacaaccuuuccuucgacaguaauguuuaaauauuguuucucuuagaaaugaucagcuucuagagaauucgaaucucuauuaauaauauacccaccaugaaugaaaucccugguaaagcgcuggcuucccuguuggugcauuuccuaagaaccccccucuuucagccaauuccucaggguucccuucucccuguggcuuucaggucaaagcccuccaucccauccaggccaauacuuuuauaagggucuggcagacuagcucauucuccccucaggugaaacuuuucccuccccuccacuuaucuaaacccuauuuacccaaggucuaguucaagucaggaggcuuccagaagugcuucugcagcugcacugcuguuggccauggaaugcaggcuggagagccccuggagaaggaguaaacgacgaagauggaugcguuccacuacccaguuacugguaaugcugaguuucugagcucacaaaggauauuuguaaauguuauuuacauaguuuauuauuuacagugaagccuaggcacugagauucugggcuacuagaccugacagacacccgggacagcgguuugcccaucuguaaacuggagggggaaguggggagguauaggcucucggaaguuccguccugcgcugcgauuuucagacacuaggccaagacacucugcuucuuggccucggaggacuaacuuuaaccccccauacccucccucucaauguccucauuguccuuuccguaauuccuucuggcuccacccuaaugugugcuucugugaauugcaagcugggaugggggaagaagaccggcaucuuuuuucgguuguaaauucccuuuaacguucgcuuucagaacgcuguaauuacuuaacuccucugaacuuucacgggucacauucucguacccgaacuauacauucagaacuaagau

SEQ ID NO: 21542 - RNA, 8169 nt, Homo sapiens
aucuuaguucugaauguauaguucggguacgagaaugugacccgugaaaguucagaggaguuaaguaauuacagcguucugaaagcgaacguuaaagggaauuuacaaccgaaaaaagaugccggucuucuucccccaucccagcuugcaauucacagaagcacacauuaggguggagccagaaggaauuacggaaaggacaaugaggacauugagagggaggguaugggggguuaaaguuaguccuccgaggccaagaagcagagugucuuggccuagugucugaaaaucgcagcgcaggacggaacuuccgagagccuauaccuccccacuucccccuccaguuuacagaugggcaaaccgcugucccgggugucugucaggucuaguagcccagaaucucagugccuaggcuucacuguaaauaauaaacuauguaaauaacauuuacaaauauccuuugugagcucagaaacucagcauuaccaguaacuggguaguggaacgcauccaucuucgucguuuacuccuucuccaggggcucuccagccugcauuccauggccaacagcagugcagcugcagaagcacuucuggaagccuccugacuugaacuagaccuuggguaaauaggguuuagauaaguggaggggagggaaaaguuucaccugaggggagaaugagcuagucugccagacccuuauaaaaguauuggccuggaugggauggagggcuuugaccugaaagccacagggagaagggaacccugaggaauuggcugaaagagggggguucuuaggaaaugcaccaacagggaagccagcgcuuuaccagggauuucauucaugguggguauauuauuaauagagauucgaauucucuagaagcugaucauuucuaagagaaacaauauuuaaacauuacugucgaaggaaagguuguggggagaaaauguucuaguucuaaaacagaacacccauuuucccugguuguauaugaauaauacaaauaugucaaaaaucaagcuuacuaugugccaagcacucuaagaacuuuuuuuuuuuuuuuuuuuuugagacagagucuuggucugucgcccaggcuggagugcaguggcacaaucucggcucacugcaaccucugccuccuggguucaagcgauucuccugccucagccuccugaguagcugggacuacaggcaugcaccaccauacccggcuaauuuuuguauuuuuaguagagaugggguuucacccuguuggccaggcuggucucgaucuccugaccucagaugagccacccaccucggccucccaaagugcugagauuacaggcgugagccaccgcguccagccaacuuuaugaaauuuaauuuauuuauuccuaacaacaaauccaggagguuguuacuuuuuaaaaucagugccauuuuauaaauguggaggcugaggcaccaagagguugcccaagguaagaagaucuggacugaggcugaguggugugauaccaagcauccuggcuuggcuggaaucagauuuggguuccaguacuuccacuccucuuguuuugugaauuuagcuuaucugagccuucauuuucuuaucugugaaaugcauacuguaaucccucccuauuagugagacaaugaaugugcaggugcuuugugaacuacacauugugacacuaauaggaaguguaaagccuugcacuucuaaggccaaaucccagcuaagaagagcaaaugaugagcuggguuugacuugcagaauuuagugggcuuacuacucaccaagaggcaagagauacaguuguaguuaugaugauagacuuuggagucagauggaccuauguugggaucccagcccugccacuuauuggcucugugaccugagacaagucacugaacauuucucaaacugcauuaucuccaugguccuccauuuguucauacauaaaaugggcuuuauauuccucauagagcagugaugaggauuacaugagaugccacugauacaaugucugcaaguagugagugcucaauaaaacauagcuagagucguuguuuuuucugauucuucuugcuccucauccuauuuccuuugucuuaauuuccccacaaagacacccucuccagagcccagcaauugugagggacugauggagaaguauguggcugcuauggugcugagugcagcuggagaugcccugggguacuacaaugggaagugggaguuccuccaggauggggagaagauacaccggcaguuggcccagcugggcggcuuggaugcccuagacgugggaagguggagaguuagugacgacacagugaugcacuuggccacagcagaagcucuuguggaagcugggaaagccccuaaguugacucaacuguauuaccuccuugcuaagcauuaccaagacugcauggaagacauggaugggcgggcaccaggugagcacagccggugggaggugcaaggagggcaaagaauaaaacagccuugaggaaaucauuaagaauguugauggagauuuaaauaacagagacaauaguguuuguaaaugugauaaaaauagaaauaacggccauggugguggcucauaccuguaauuccagcucuuugggaggccaaggugagagaaucacuugaacccaggaguucaagacaagccugagcaauauacggagacccugucucuagaaugggguagccaaucccucuucuagagacagguacugauccguggcuuguuaggaacuggagcacacagcaggaagugagugaugggcgaaggagcaucaucaccugagcucugccuccaucagaucaguggcgcauuagauucucauaggagccugaacccuguugggaacugcacaugcgagggaucuagauugugggcuucuuaugagaaucuaaugucugaugaucugugguggaacaguuuugucccaaaaccucccccaaccaaccccguccauggaaaaauuaucuucuguaaaaccggucgcuggugccaaaaaggcuggggacuacaacuccagaaaaaaauuuuuaaaacauuagccaggugucauggcacauaccuguagucccagcuacuuggggggcugagguaggaugauugcuugagcccgggagguugaggcuacagugagcuaggaucgugccacugcauuccagccugagugacaaagcaauacccugacucuaaaaaauaaagaaauaaauagaaagaaccuaaaucucucauaauuaauuaagcugacacauuugcaaccauuuaaaauuauucagggugacucuacucaauaacaauguaucguauauuucaaaauaaccaauagaguaaauuucaaaugucucaccacaaaaaaaagugaggcaauagauaugcuaauuagccugaucaucccacauuguuuacauauaucaaaucaucacauuauacuaaauaaauguauauaauugauuugucaauuuaaauauuaauaaaaauuuaaaauuugcaaauaauauuuacuaauauugaaaaguauuauuauacacuaauagguuauaaaauaguauguauguuaugaaccuacuguccuuuaaaaaauagaucuguggggccaagugcuguggcuuacaccuguaaucccaacacugugaaaggccaaggugagaggauugcuugaguccaggaguuugagaccagccugggcaacauagcaaaagccugucuuuaaaaaaaauuuuuuugaguggccaguuaaaaaaaaauuuuuuuuuuuuugagauggagucucacucuguugcccaggcuggagugcaguggcacgaucucggcucacugcaaccucugccucccagguucaagcgauucuccugccccagccucccaaguagcugggauuacaggcacgcaccaccacgucuggcuaauuuuuguauuuuugguagagaugggguuucaccauguuggccaggcugguuucgaacuccugaccucaguugauccaccugccucagccucccaaagugcugggauuacaggcaugagccaccaugccuggccaaaaaaaaacuuuuuuuuaaaaaauagauauguauuucuguguugagaaagaucuugaagaacauguacaaagauguuacuaauuauauuugggugaugggaguauuuauaguuuuuuauuuuuacuuacuuguauuucuaaguuuucugugaugaauaaguaaaaagaaaaauguauauuuuuuauuuuuaaagaaaaaugcggcuaggcaugguggcucaugccuguaauccaagcacuuugggaggccaaggcgggcagaucaucugaggucaggaguuugagacuagccugaccaacauggugaaaucccaucucuacuaaaaauuaaaaaauuagcugggugugauggugcacaccuguaaucccagcuacccaggaggcugaggcacgagaaucacuugaaccccagaggcggagguugcagugagccaagaucgcgccauuggacuccagccugggcgacagagugagaccccaucucaagaaaaaaaaaugcaaaggcuuuuguagagacuucuggccacagguucgcucacaagugguucuugcccacuucggcaacuuguuagagccacuugggccaccaggugauuuucucuggcccaucugaccuaccucuccuauuugaggcugcuagggcugccauaacaaaauggcauagacugaguggcugaaacaauggaaauuugucucucacagcucuggaaacuggaaauccaagucaagauauugacaggccugguuucuucugaggccucucuccuuggcuugcagauggcugccuccucgcuguguccucacauggucuuuccucugugugcauguaucccugguguuucuguguguuugcauuccucuucauguaaggacaccaggcagauuagauuagggccuacccuaaaggccacauuuuagcuuaaccaccucuuuaaaggcccuaucuccaaaucgagguacuuagagcuacagcauuugaauuggggggacucaauucagcacauaacaccuccugaugaaagcuucccaucaccauaccaaggggcccuugucaccccaaggauuggcuuuagaugccaaucucuguucauccuuucucggcaucugauagcucaucaguuuagcaaguggaaacuuuuuuuuguccaccugugccauccaugaacauuuuugugaaaacacugaccaguaaaggaacagcagugccacacuccaucguauguugcugccaucgcuugguucgcaugcguauucacagguccccaguaggacaggucgggggacaagccugcuuacgucacugucacgaggggauagccaaggcccagagguucagugacucaccaaagacacauuguuucccugaauccacugcuccucaucugagcccagggcuucacuguagaauuuuuggccgcuuucuuucuuuuugauguucaggaacuccaauugugagguuuuuguuuuuuguuuuuugguuuuuuguuuugagacggagucucgcucugucacccaggccagggugcaguggugcaaucucgacucacugcaaccucugccucccggguucaaacgauucuccugccucagccuuccaaauagcugggacuacaggcaugugucaccacgcccggcuaguuuuuuguauuuuuaguagagacggaguuucaccguguuagccaggauggucccgaucuccugaccucgugaucugccugccuccaccucccaaagugcugggauuacaggcaugagccacugcucccggccuaauuguaagguucuuauuggacuccauaaggaauugggcuuuggagucugauggauuuuacccagccacuaacuagcugauuaugugauuuugaggaaguuucuuaagcucugagcuuaaaaggcuuauuuacuuaaaaaagagaacaauauacuuacuucuuaauuuuuuugugaugucucaguaaugacugguaaagauuccaaggaucccuauaugagucugcugccuuuauuagcguuaucuugccaaggguuauacauaaagaaaggcacauuguugggugggguuuggaguuuuggggcaugcaucaucauauuuuuuggcucucccuuuccaucaaaaauacuuggagacagaguuuaguuauuuauuccugcuggggccuuugcuuugguuaugcuaacccccaucccuuauccgacucuuccccagguggugccucggugcacaacgccaugcagcugaagccgggcaagcccaauggcuggaggauucccuucaacagccaugagggcggcuguggggcugccaugcgggccaugugcaucggucucagguucccacaccauagccaacuggacacacugauccaagugagcaucgagaguggucggaugacccaccaccacccaacaggcuaccugggggcccuugcgucugcucuuuuuacagccuaugcugugaauagcagaccacccuugcaguggggaaaaggacugauggagcugcuaccagaagcuaaaaaguacauuguccaaucaggcuacuuuguagaggaaaaucuucaacacuggugagucuguaagcgcacgcccugcucaaacacgguugaaucugugcguguacauccaccugcacauauaugucuuguauucagagaucacagcaacccucaugguuuucacccccagcccccuuucuacccaucugcuaaggauuucaaguucccuuccaguaaugauucuacaaaguagccaaguggauaccucaaugaauagggcagcugugguguuucccucuuacacggaauccugucauuuuuguggcuauccuauucugccaugaauuuucaugccuauuuccuacuuuccuggaauuugcuuuuucaguguugucuugguauacaaauaauauuuugaaauccuugguuaaaauuccagagauacguuuuuccacuagcuaacuaauaagugguaaggccacaucuuccccuucucgugaguucacuucacauugucuuucuuagaauaaaaagaggcuuucugcugaagucacccacaguugugaugucuugaaguuccccuuuaaaaggucauuacucucgacccucccagggaaaacaaaccuguauuucuuacccuuuaacuugauauguaucucuuuauuuagcaacaggaucaaugccuuauuuauguagauccuuaugaaaaauguauugaaugaaugguacuuauauagaaauaauuuugauguuuaaauaguuuaugauauuacugcaagaagccgaaguuauguuggauuuuucucuguucacacauccaucuggugcuuuuuguuaugacuuuucacuuuauuuuuuucaauugacucuagauuuuuuccuuucuacagguccuacuuccaaaccaaaugggaaaauuaccuaaaacuuagagggauuuuggauggagaaucagccccuaccuucccugagucuuucggugugaaggagagggaucaguucuacaccucccugagcuacucuggcugggguggcagcagugggcacgaugcccccaugauugccuacgaugcuguucuugcugcaggagacuccuggaaggagcuugcccaccgagccuuuuuccaugguggagacagugauucuacagcugccauugcuggcugcugguggggaguuauguaugguuuuaaaggagugagucccuccaacuaugagaaacuagaauacagaaaccggcuggaagagacagcuagggcuuuauauucucucgggucaaaagaagacacuguaauuucccuuuagggagacgugauguucacuucugauggauucuucuuuuguguauuuccuuuucugcuauuucuuuucaguuuuuccaaagucaagagucuuaaccuuguacucagggaauuuugagauaacaagucccuugggcaccuuaagcucaguuuuuucaggcucauccuguucuuccagaaucuaucccuuuucuuacacugaagaguccuuuagcucaauugauagggucagcgucucgcaagcaaaaaaucucaugaccucauauuugagucuucauuuucaucaucuacuuguucuaaaaguuuu

SEQ ID NO: 21543 - RNA, 20587 nt, Homo sapiens
aguccgcgccgcagguggugcuugucugcagagucaugaccuguaaguggcgcggccgcgcgcugcagcucgaguucgggccgcgggggaggcuuuggagcggcgccggcgguggcucggccggcucagccccuccgccccgcguccccgccgugcgcggccuucccugaggcgggcguccgcguggguccgggaucgcguggccgggcggccgggcgcacucccgggauuccaggcuuccgggguggcgggcgaggcccagaaagcaccaggccacccggccgcgccggcacccgccgcguccugcuugacagaggcugauggacguguauuucuccacggugugggccgcggugguaggauccaacucccuuggguguuuucaaguugcgugaccuccuccagccccgcccugcacaaaggugcccaggcgguucuucgucuccccacucacuuuccagcuccagauuuugacuuggauucuugcugugucacuuacuuuguucagugacuuugugcagcuuucccccugcaaguccccuguuucuuuauuuguaaaaugauguuaaugauaccucacacaaugauguuaaugugugaaggaccuggcacauugcuuuaaauguuauuccuuuguuguuuccuucgcucacaguauuuuauucuuuuuuuccgccccuugguaaggucuucguuguuagauuaugaugaauauuagggcagccuuaaaagucuucacuuuacagaugagauggagugacgggcgucuccuccucagcaugaggaacugcccaguggcgggguuucccugcugcagcaugucuguagagugggucauuugcagaaugauaggcaguccuaagcuuaguugaggaccccgcccuugugggugagauguguaggagaggaagccaucagcguagccauggugagcuuuaucuuucccacccucggaagcacagacauggcccggcacguggcucacgccuguaaucccaacaguuugggaagcugaggcacgaggaucgcuugaguucacgagucaagaguuggagaccagccugggcaacauggcgacaccuugucuguacuaaaaaauacaaaauuagcccggugugguggcacgccccuuuagucccaaacuacuugggaagcugaggagggagaauggcuuaacgcugggaaauggaggggagacguuuaguggauuuaucugcuguucugauaacagcucaaaauaucuguuugccccagaauaaucccagcuuuuauuuccuguuuuaguuucccuucagauucuauaacuauuuagcaggcugccuucaggguuaaauuuagugcuucucacuauauuuaggauagaucaaggaaugggacaucugaguuuuccuuuuaguuaacccugagccaaacaggccuucaucagaggccaggguuugucauuguugccuuuucuggagacauuugcguuguuacaggaaacacccaaaagagauagcucucuaaugguaggauuuucagacucuggagcagaggugggaugggaaguucgggcaggccauuacuaauugaagggguggguugccccuccacaccuguggguguuucucguuagguggaacgagagacuuggaaaagaaaaagacacaaacaaaguauagagaaagaaguaggggggcccaggggaccagcguucggcauacggaggaucccgucggccucugaguucccuuaguauuuaugaucauucuuggguguuucucggagagggggauguggcagggucauaggauaauaguggagagaaggucagcagauaaacacgugaacaaaggucucugcaucaugaacaagguaaagaauuaagugcugugcuuuagauaugcauacacauaaacaucucaaugucuuaaagagcaguauugcugcccgccugucccccuuccagcccuaaggcgguuuucccuaucuuaguagaugggacauagaaucggguuuuauaccgagacauuccguugcccagggacgggcaggagacagaugccugccuuccucuugucucaacugcaaagaggcguuccuuccucuugcacuaauccuccucagcacagacccuuuacgggugucgggcugggggacggucaggucuuucccuucccacgaggccauauuucagacuaucacauggggagaaaccuuggagaauaccuggcuuuccuaggcagaggucccugcggccuuccgcaguguuugugucccuggguacuugagauuagggaguggugaugacucuuaaggagcaugcugccuucaugcaucuguaacaaagcacaucuugcacagcccuuaauccauuuaacccugaguggacacagcacauguuucagagagcucgggguugggaguaagguuauaguuuaacagcaucucaaggcagaagaauuuuucguaguacagaacaaaauggagucuccuaugucuacuucuuucuacacagacacaguaauaaucugaucgcucuuucuuuucccuacacuaauaauuccugaaguuuugcagagcuucauagauuauaaugugcuuuggauccuuuacugcugcgucccaccagaccauaagcaggaacuauguauccaucaggguccagacaggacauggaaacaacacuaguaacucgaacaaggaaaauuauuuauuuauuuauuuauuuuuuuggagacugagucucacucugucguccaggcuggagugcaguggcgcgaucuuggcucacuguaaccuccaacucccagguucaacugauucuccugccucagccuccugaguagcugggauuacaggugcccaccaccacaccuggcuaauuuuuguauuuuuaguagagacgggguuucaccacguuggccaggcuggucugaaacuccugaccucaggugaucaccugccuuggccucccaaagugcugggauuacaggcgugagccaucacacccggcggaaaauuuuauauaaaaaauuauuaucuggccaggcgugguggcucaugcuuauaaucgcagcaguuugagaggcugaggcaggaggaucgcuugagcccaggaguucgagaccagccugggcaacaaagugagacccugucucuacaaaaaauuacauaauuaaaaaauuagcccggcaugguggugcauaccuguggucccagcuacauaagaggcugagacaagaggauugccugaacugaguaggucaaggcugcaguggaccauguuugugccacugcacuccagccuaggcgacagaacaaggcccugccucaaaauaaaaaauauuagcuaauggaaagugauuaucauaaaagcuaaaagggaacuuuaaagaacagaagaaaagcaaauaugauguauagcuacuaccuccaggaagaaauaagcuuggaagagcccccaaccuccuugcuccagggcugagcacagaccuugucagggcuggcuacauaauuuguggggcccaguucccuuguucagauagcaagagaaaagugcuguuagcuuuuccuucugcaguaucucuuucaaccucucaugguguuauuugcuguuuaauaucauguucucuuggacacaugaauacuuaugggguaagugcagacuuuuagaggugccugggaccccuguccugugaauaggcaugugugcagcucacuggcugccagguuuucccucugccagcagcgggaucgaugugcugugacccagccaguaguggggaaacugagacagacaucuucccuucccaugagcugggcugcucaugggaauuaugugagcagcuuccaaggaaucacacuuucugugcugggacauacucaguauauggauuggagguagacgagaggcccaugaacaaacaguaagggacaggaccauauucaaacccagucuuuuuacuuuaagccauauucucauuucauucccuacacugcguaguaagaagcugguucacucuagauucuugugccuggcaugggacuuugcccauggauauugcucuaucuccagauagauuuuagacuauugacauuuuggacaggauaauucuucguuguguuauggaggggguuguccuaugcauuguaggauguuuggcaguauccuuggucucuauucauuagaugccacucauaccucaucaguuguggcaucaaagguaucuucagacauugucagauguccccccggggacauaacugccuuccauuugagaacuauggcucugucugaauccagcaguucgaucuucugauagcuguuuucuuuugucuuuguucucagcuuuccgcuuggcccucauccagcuucagauuucuuccaucaaaucagauaacgucacucgcgcuuguagcuucauccgggaggcagcaacgcaaggagccaaaauaguuucuuugccggucaguaugggagcagccauucuguucuagccacuguacacccaagcagaacgguguuugcuagcucugguuguccucuuguauccugggguccagcagugucccuuggagcccauagauuguuccgagucugacuggaggaugaccuuagcaagguucuuugugagauaggaugugccaacacggucauaggucuuuagguuuuggaucuuccucuuuguucagaugaggaagccaaaauccuaguauauugagggacuuacggaaaacuaaaauacucagugcuuggauacuuuguuccuuauuuaacuaagucuuuauagaaccagaacauauugguuuuagcacuaagccuccaacauuuuuuuuuuaaaugagcucugggagaacaccugugauuugucuccuccaacccacuaggcuagcuuuguagucuuaccuguggcuacaggcucuuuacccuugagaugucaguguuuuucuuauuagcuguguuuuaacccuucgacugaaagcagagcuagaagcagcagcuauggccucuuacagcagaacuuuaaaauggguggguguuuugaucuuuuuuuuucucugccaauauuuuucuaggaaugcuuuaauucuccauauggagcgaaauauuuuccugaauaugcagagaaaauuccuggugaauccacacagaagcuuucugaaguagcaaaggaaugcagcauauaucucauuggagguaacuuccuacccacaagguauaaugaccuaaacauuagaaacaucugaaugagucaggugugguggcgugcgccuguauucccuacuugggaagcuucagcuugggaagcugaagcagagaguuucuuuuucuuauuuauuuauuuuuuuugaggugaggucuugcuuugucacccgugcuagaguacaguggugugaucauggcccacugcagccucacccuacgaggcucaagugauucucccaccuccugaguagcuaggacugcaggugugcgccaccaugccuggcugauuuuuguauuuuuuuguaaagacagaguuucaccuuguugcccaggcugguuuugaacuccuaggcucaagcagucugcccaccuuggccuuccaaagugcuaggauuacaggugugagccaucaugccaggacuguuuuuuacuauacuaauagaggauugagaaaaaaaauuuuuuuccauagaggccacauacauaaagguagcuuuauuuuugugguuuuggaauaaauguuuaaagguuuuauuugcuuaaauaaaaaauaaacacagaaaaauucuauaaauauagcaaauacaauuuuuucuguaugaugauauauuaagaauuagaaaugaaggcaaagcaagaagccuggagaugaaacugcauucagugauggagaggcuucugacuuuacguucucaucuuuugggacacaguuuuguugcagaaccuggugaauucaaguuaagcaaugggaaauuucucauuuugcccuaauguuacagauuaaguguuacucaagaucauggcugaauuucaggaacaguuugguuauuuuuuaaaccugucuuuggcaucuaaccuaaucauaucccaucuacacucuggaguuuaucucugaaagaucauauucaagaaggaaaaaaaaaaccaugauuaaguaacccauagaagggaauacuuauucuguauuauagaaugagguguugccuuauucuaaaaacaaaaugaauaaauaaaccguaaaagauagguucuuuauuuuuggacccaaguuaucaggcuuuuaucccuuucucacaaaagaauugcucuauucuuuuucuuaugguauguuucuucucucaaugaaaggcucuaucccugaagaggaugcugggaaauuauauaacaccugugcuguguuugggccugauggaacuuuacuagcaaaguauagaaagguaaguaggaaguguggcauaagaauuuguuaucucuaagccagcaacaauguguggaaaaaaaauuugcuaugaaguucccuagucccucucauuauaucacacauguauuaggguuuugacugauuggcacaggugguuauucuuggccauuugcauuuuuauauaaguuuuagacucagccugucaauuucugcaaaggaacaagcuauaguaauuuuuuuuuugacagaaucucgcucugucacccaggcuggaguauaguggcacaaucuuggcucacugcuagcucugccuccuggguucacaccauucuccugccucagccucccgaguagcugggacuacaggugcccaccaccaugcccagcuaauuuuuuguauuuuuaguagagacuugguuucaccguguuagccaggauggucucaaucuccugaccucaugauccacccgccucagccuccuaaagugcugggauuacaggcaugagccaccgugcccagccaaccuauaguaauuuuuauuaguauuucauugaauauauagagaacacugugggaagaguugccaucuuuuuaguauuaaaugcguauacaugaccaggugcaguggcccaugccuguaaucccagcacuuugggaggucugaguaaguggaucaccugaggucaggaguucaagaccagccuggccaacauggugaaaccccaucucuacuaaaaauacaaaauuggcuggguguaguggugcacaccuauauagucccagcuacucaggaagcugagacaggagaauugcuugaacccaggagguggacgcugcagugagccaagauugcgccacugcacuccaaccugggcaagacagagcaagacuccaucucaaaaaaaaaaaucauauacauuuaguaucauuaagucuucuugaugaguugacccuuuuaucauuaugaaauaucucuuuuuuuucuuguaauaccucuugucuugaauucugcuuuaucucugcuaucacuauagccacuccagccuucuuaugccuaauguuugcugguacgugguuuuuccaguucuuuguucucaagcuauauguguuuuuauauuuuaaguggaucucuuuugucaacagcauauaauuguaucuuaauuuuuucuuuauucugacaaucugugucuuuuaauugaagugguuaguccauuuauauuuaaugcacuuauugauaugauugaauuuagggauagagacauuuuacuuuuuuuucccuuuguucaucuuuucuguauuauuuuggauuaauugaauauuuuuuagaguucuguuuuaauuuaucuauuggcuuuuuaguuauacaucuuagcuuuuuuuuuuuuuccaguuguugcccugggaauuaucauaugcauccuuaacuuuucacaggcuacuuaagaguucauauuauaucauuucaugugaaauuuaagaaccuuauaaugauauagguccauuuuucuaccccacugccccugcccucauucuuuaugcuauaguugucauuuguauuccauguauauauguuauaaaucccacaaaacaggaauacuugauuuaaauagucauauguauuuuaaggaaauuaagaagaaaaaaaucuuuauguuuacccaaauauuuaucauuucugguguuuuucuuuccuuccugaagauccuccuucuaucugguauauccuucagaccaaaggaucucauuuagaauuuuuguucugaggaucuguuagcuaggaauucuguuaguuuuucuuuaugaauauaucuuuacauuguuuucauucuugaaagauauuuuugcuggaauagaauuuuggauugauaguuuuccuuuuuuuccacuaguaguuguuaucuagccuuuuuuuuuuucuucccugaugagaagugaguaguaauuuguauuguucccucggauauaauuuguuguuuuuucucuccuucuuucaaguguuuucauaaucuuuaguucuuaguauuuugacucugauaugccuagaugugguuuccuuugucuuugccuuccuugguacuucuugaaacuguaaauuuaaaucuuucacuguguuugggaaguuuuuugacacuauuuuguuaaauauuuuucuguuccuuuuucuuauggagcuccaguauauguauauuauauuuuuaaauauuuuuccaaggucaccaggcucuguuuuucuguuuuugucuuuccaauacuuuuuccuucucuucuacagauuagauaauuucuguugaucuuucagacuuauucacuguuucuucugucuucuucaauuucccguaagccaacccagugaaauuuuaaaaaauugagauauuaaaauuuucaguucugaaauaccccuuugcuucuuuuuuauaguuuuuauuacucuaugauauuuucuauuuguucauuaaaagcauauuuuucuuuacaguguugagcuuaguuaguuucuauagcugcuuuaaagucugauaauuaucacaucugugugccacagaaugagacuauuaggccuuuaaaaggccccugauguaaauaaacucauauccaagcaaacaacaagaaaaaaauuauaacaucugggucauggcaggaucuguguucauuugauugccuuuucuuugcaguuuggaucacacuucuguuucuuugaguaucuacuaauuuaagauuguacaguggauuauauauuguagagauucaagaugcuauuacagucuuccaaaaaguguugaauauuuuguuuuaacugaugguuaacuuggccgcacccaaacaccaaacucuuaucuucuuugaaacgugggcagcaacuuuagcugcucuguucuaucugguuguucugccccacuucuauuuaacucagugaucagccagagauuuagaaagauuuuauaugcagaauuuagggcucucccucuuugcuuucuccauuucaggauuuccccccuugguuuccagcucugguucuucaagccagugugauuaugggucauuuucaccacuacuuaucacagcaacugggaccuugcuucaggguagcagcuguaaauagcaccaggaaguucacccagggcuguucccugcuuccacaugucuguguucuucucuucagauuuugucugcuuuguuuuggucauucuucagugcuuuaaguaguugugccuuuuauuuuguccagaguucauaguuaaccacaagaaaacuggucugauaggagcuacuguguaccugcuggaagaacagccagcauuggacuauuaacccaacucuuugaaguauaucuuuuuaguauuaaguuuuccaguccaugaaugugguauauauccugacauuuauuacgcuuucuuuacuuucucucaauuucuuuuuauaguuuuuuggguauaauuuuguuuaacauuugugagauuuauuccucauugguguuuuuagaugcucuuucauuuucuguuuuuguuuuuguuuuuuugagauggagucuugcucugucgcuuaggcuggagugcaguggugugaucuuggcucacugcaaccuccaccucccugguucaagcuguucucuucuuucagcuucccaaguggcugggauuauaggcaugcaccaccaugucuggcaaauuuuuguauuuuuaguagagacgggguuucaccauguuggccaggcuggucuugaacuccugaccucaggugauuuuuaaaugcccaccuacuuuccaccucuccugucaauuugucaguuugauucugauaaguauuuuuuuuuucuuuuuuuuuuugagagagagagucuugcucugucacccaggcuggagugcaauggcgugaucucggcucacugcaaccuccaccucccagguuugagcaauucuccugccucagccuccuggguagcugggacuacaggcacgcacaaccacccccggcuaauuuuuuuuucuauuuuuaguagagacaagguuucacuacuuuggccaggcuggucucgaaccccugaccucaggugauccgcccaccucggccucccaaagugcugggauuacaggcaugagccaccguguccggccugauucugagaagucuuuauuuagcauuuauauuuuuaaaaagcaacauauuaguuaccucccaugagaaaccuagagguugauuugcagacugcuagaaaauagggguuauaaaagguacaguaucauuuuuccaguucccugugguagaauucauuuugauaaggugucagccagcuugugggguggauuauaagcaguuugggggugcuguuuguauaguuaaucuuagagcaccuuccguaucugcccggggaaagauauugucauuacugccauggacccugcuggaaaagagguaaccaaauccauuauuugugaugcagauccaucuguuugacauugauguuccuggaaaaauuacauuucaagaaucuaaaacauugaguccgggugauaguuucuccacauuugauacucguauguaccagauaaguuugccucuuuagcaaucucaguagaagacaaucagguauuuauuucuuuuuugucucucuccgauuucuucacauaaccuaacugaaagaccauaagugagaaaggcagagaaucaucacagaucuggaaaguucgggcuuauuugagaacuaaggauuugacacgauuuugcccuuugauuugauuguagcuuccuguuacggcuuccagaguauaccuauuaggcuacaguugaguaccucccaucuagauaauaagcauucaauuagaaugaauuucucaucuuuacuccgcugauguaaaugaugucuuuaugagaugaaguccaaguaggaaugagcuuguaaauuaucucuguccucagguccuguguuaauuuaucccugucaguguuuugugaucauuaugucauggaggauuuccccugccacaccaugcuguagggaguuaacuuuucauuugugcauuuucuguuuggaaacagcuuacugcagagugggucugggcaucugcuacgacaugcgguuugcagagcuugcacaaaucuacgcacagagaggugaggcaguguaauagcuguguuaugugggugcuuggaggcuugguucuaggcuggucuaugugggauccuuagucaagaaaagcugggagagggcucuuuaauuucuccaucuucagcccuuucacccccaugaggcuucccagacuuuugcuguguauggaugacaggguuuuugggggguuguaauuaaacacaucauguagcuaagguaggagcugugcucauaaaggucuggucuacccuugaguccuuguuacuguguuuggagagucacuugaagcccaguagaaaugaaguggauuucaccacucaguaccccuagacauuggguacaaguagaaauguggucugugauauuuugguccagacgaggagaaaugugccaguaucugggaagagcgaguucaaaagauguggguucuaguuccaacucuucccuuuaauuggcacaguacuuugcuaaaaugauuucaccucuagagcagugugguucucaguuuagucacaggaaugauaugaggauuaagaagagagaaccuauaaagccccucgugugguacucaacaaauaccagcauccuuacuagacugcuugaagcuacuuccaaauagacugucacuuaaccaagugaaguggguggaaaugguuugacugccugcucagaagguggaggugcaugggcucuggggucaguagucucuguugagccauauaucaauaagccuuagggcaacuccucggccccuaauuucaguugaaaagaauuacaaaacguggucauuggccauguggagcugacauauggagcugagauaaauuuguuuuuuuuuguuuguuuguuuguuuguuuuuuugagacagaguuuagcucuugucgcccaggcuggagugcaauggugcaaucucgacucacugcaaccuccaccucccagguucaagugauucuccugucucagccuccugaguagcugggauuacaggugcccaccaccaggcccagcuaauuuuuguauuuuuaguaguuaugggguuucaccguguuggccagacuggucuugaacuccugacuucaggugaucuacccgccucggccucccaaagugcugggauuacaggcaugagccaccgcacccagccagagcugagagaaauuugaaugacaguucucuaccuuauuuuuguuuguuuguuuugaggcagggucucacugucacccaggcuagagugcaggcgugaucauggcucacugaagccuuggucuccuggacucaagugauccucccaccucagccucccaaguagcugggacucuaggcaugugccaccacaccuggcuaauuuuuaaauuuuuuguagagauggggucucucuaugucgcccaggcuuuccguccuuuuuuuaagugaaguugauaccggugggcuaggggaggcccccaaacaccagucugaccuugaccccagccaguguccaugcuauugacacuauugcaagaaggaauucaaggaugagucagaaaauaguggaaguauggagauuuauugcaaagugaaaaguacacacucaaaaaagggaggguguguguacucaagagagucaugcgcaaggagguuugggccaucuaccuuuauggguuuccuuuuuuuuuuugagacagagucucaaucuguugcccaggcuggagugcaguggugcgaucuuggcucacugcaacuucugcuucacagauucaagcaauucuccugccucagccuccccaguagcugggauuauaggcgcucgccaccacgcccagcuaauuuuuuguauuuuuaauagagguaggguuucaucauguuggccaggcuggucucgaacuccugaccucaggugaucugcccaccucggccucccaaagugcugggauuacaggcgugagccagcgcacccaccgccuuuaugaguuucuuuaccaaggggugaaauauucaugacgcuuccuagaaaaagguggagauuucucggaauugugccacucauuuuuucaccaaauacggguguuccagaaacuaucauggcacgggugggugugugauuuaguauguuaaugagcuuauaaugaggauaaugaaguccuaggugaaaccuaggucaaacccagcaccauauugaguccacugggucuuagcccuaguuucucagggucuuagccccuagcguaggcagcuauuucaacaguuucuuuuugcuagucauaugaaacugcugccuggaauuuucuguucucuugcgaccguccuguauuauuucugucucaaagucacaugugauuuuggucaucaacaccacuuuucuuguguguccauaugugugugacuuacguguucguauuaaaggaauucagagccauaucuuaauugcugcuggcacugucugacuuggcugacaucuuuuuauguuugggaaaguuugaguucaguuccugcuagauaaggaacaguggggaggacugguuuuguugagugcucacugcauccacuguucuuuggcuuuucucuccccaaggcugccagcuguugguauauccaggagcuuuuaaucugaccacuggaccagcccauugggaguuacuucagcgaagccgguaagaaaggaaccauauauucaagccucucggcauguccucuuuguagaaagauuuccgguuggguggaggugccagccuuccugauguggauucugucccugacucaggaugcccuuguauccaaaugcaguuggaaaggaugaagcuauaaggaggacuucuacugcacgucacuuucuccucagaagccacaauaccaaccucauggauuuuggaaacuguacuuuuuuuuuuuuuuuuuucuuuuuaagagacgggucuuaccauugcccaggcuggagugcagugguguaaucauagcucauuacagccuugaaauccugggcucaagagaucguccugccucagccuccugaguagcugggacuacaaacaugcgccaccaugccuugcuaauuuuuuauuuuuuguagagauagagccucacucuguugaucaagcuggucucaaucuccuggccucaagcgaucuucccgccucagcuuuucaaagugcugggauuacaggugugagccccaagcccugccggaacugugguuuuggcauuuucaauauucaguguauuagaugggaagggauuucauuuuucugugauuagauguggauuggucccucuuaagucaguuccagcaacuuuuacagagaaauugagaaccacagagcuuaugucuucagagccccagaagccaauuaaaaggcagggauuaguuuagcuugaccuagggagagauuuguggucuguacccagcugauucuaugccauucagaucaggaugcuuauccuacccccuccuucacaccauccuacuaguccugaggguacugugccaagaaacucaugagaagcucuuguucuucuaaccuauaacuccagggcuuugcacaagcaucuuuggcaggucacaggugccuuuccuuagucuucuaaggcugagagguggugaagggcaaauagcauagguggacauaagauggaagggaaaaugaaugugacugugagugugucugucugucuguaaagugcucuacagcccaugaaaugcuggucugagaugaugguuuucuuuagaauuuuuaaaaguugaaguaauacaaaaaaaguguacuaauuuuaagcauagagguuggugaauuuuuguguauucaccugccaccaagaugaacauaacagaacauuuccagcccccgaggaugcucccuuuuuugccccuuucuaguuaguacuccucccucugccuagagguagcugcuguucucacuucuagagauggugguaauguuuaauguaagggaaagagguuuuagcugguugcaugguggaagauggggguagggguauaagaugccaugaguaucagugaagguacaguuuugucaaaagugagaaguuucugggauacugagaugacccagcaugggucuguuaagucucgagggcuccgaggugaggugcuuugguguaccuggacugcgagcugcaauuuuuguucuauuugagguggugggacugccaccaugggcauggaagcgccauguggccugcaagguguauugcucucauaaggccacuccauucucuccggccaccuugacuugcuuuaaccagagaagcucuucucuuauguuagcuuauagcaggcuuucucagcaguggcacuguugacauuuagguguguaauucuuugugugggggcuguccugugcaugguaggauguuuagcagcaucuguggccucuaccugcucgaugucaguagcaucuccuuagucacgacagucaggaagaucucuagacauugucaaauuuggugggcaacauugcuccuugcugagaaccacuggcuuaugcaguaagguaacuuugcacaaugugcagguuaguuacauauguauacgugugccaugcuggugugcugcacccauuaacucgucauuuagcauuagguauaucuccuaaagcuaucucuccccccugcccccaccccacaacaguccccagagugugauguuccccuucguguguccauguguucucauuguucaauucccaccuaugagugagaauaugcgguguuugguuuuuugugcuugcaauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuuguuauugugaauagugcugcaauaaacauaugugugcaugugucuuuauagcagcaugauuuauaguccuuuggguauauacccagcuaccaaugacuuucuucacagaauuggaaaaaacuaaaguucauauggaaccaaaaaagagcccgcaucgccaagucaauccuaagccaacagaacaaagcuggaggcaucacgcuaccugacuucaaacuauacuacaaggcuacaguaaucaaaacagcaugguacugguaccaaaacagagauauagaucaauggaacagaacagagcccucagaaauaacgccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacacuuuauacaaaaguuaauucaagauggauuaaagacuuaaacguuggaccuaaaaccauaaaaacccuagaagaaaaccuaggcauuaccauucaggacauaggcaugggcaaggacuucaugucuaaaacaccaaaagcaaugacaacaaaagccaaaauugacaaaugggaucuaauuaaacuaaaagagcuucugcacagcaaaagaaacuaccaucagagugaauaggcaaccuacaaaaugggagaaaauuuucgcaaccuacucaucugacaaagggcuaauauccagaaucuacaaugaacuccaacaaauuuacaagaaaaaaacaaacaaccccaucaaaaagugggcgaaggacaugaacagacacuucucaaaagaagacauuuaugcagccaaaaaacacaugaaaaaaaugcucaccaucaguggccaucagagaaaugcaaaucaaaaccacaaugagauaccaucucacaccaguuagaauggcaaucauuaaaaagucaggaaacagcaggugcuggaaaggauguggagaaauaggaacacuuuuacacuguuggugggacuguaaacuaguucaacccuuguggaagucaguguggugauuccucagggaucuagaacuagaaauaccauuugaguaagguaacuuuuuaaagagaagguuccauggcucuggcuuccuucuacaucugaguuagccugaacuauccuauuuuuuaaaagaaggaucuaucuacuuggguuagaaaaaugucagauuuauaauguacgauuuaccucuuuccugucuauugacuacagggcuguugauaaucagguguauguggccacagccucuccugcccgggaugacaaagccuccuauguugccuggggacacagcaccguggugaacccuuggugaguaaggcuaagugagaauaggcucagucggagcuugagcuugagugguggcucguuggcagauggguuuucugguuccugagcagccaggcgcucacuucucacucccauuuccccacauauccugccagcuuucugccugucucugugagaggagcuuccauuugaaaaccaugugagaagcaaaucacccugcucucaugaucaagcacuuggccuuagcccucuucugaguuucuggugaccuucacugucagucauacuuggaucacauggggaaacaaggcagcagugacaggcagguuguaguaagagacucugaaauuuuugguuaaaauuuaaguuggcugacuagucccaggguaggaaugaguuacagggugaggacuuugcuuccagcauaaugaucagaggagcagucaggaugguucaauaagugaaacuaugacccucuccccaacaaaagggugaagcauuuuauuacucaguggagccagcacauaagccugcccagacagaauuacagucauacgcucauacgcauuccuuacagucuacauuuguacaguuuacauccuacuuucacaacauggucucaacuugaacucucaggaaauuguucuuauuaagcccaguuuauagaugguagaauuacagaggaagcgacuggaauuccagauguagcggcuagacccaguguuugaauccaggauauuugccuucagaacuuggauguauuccacacuaguucucuguaugaaagcacacacacacacugguauguaugucuacauuucaggaugaguauaccaguaacaagacugagaagaguuaaauguuacugugggguuccugaggguucugucuucugccuuuauagguagggcucagagcucaaugugugugguggggaggccuuggaagauaugacuagugugagauuccaguuggccuccugcacauuaggcuuggggacauugaaggacuaaguugacuugaaaauuuucuugaacuugcaucagguuccacuguccagaaaucuuugaaugccagggcaaauggggaagaaucagaaaagaauucaguuacgugucauaaaugguggugcuuguauuuguaacucauuugugccaaaagucugucuguggcuaucugguaaacagaaucaguuguuaugucagauuauuuuggagaagguucauuucucuagguaaggguuugaacccuugcucugggccaagagacuagacacuggagauaguuucuuuuuucuuuuuuuuuuuuuugagauggaguuucacucugucgcccaggcuggagugcaguggugcaaucucagcucacugcugcaaccucugccucccggguucgagccauucuccugccucagccuccgaguagcugagauuacaggugcacaccaccacgcccagauaauuuuugcauuuuuaguacugaugggguuucgcuuuguuagccaggcuggucucgaucuccugaccucaagcgauccacccaccuuggccucccaaagugcugggguuacaggcgugagcuaccgcacccuuccuggagaugguuuuacaggucagccuuacccuggauugaugaaggaguguggcuguucccuagugcagggcuccugccagugugagguuacccuccauccccccaugccacuucuacccagucgccagagguugaacucuuucccucaaaucugaaacugaagcccauuaacacagggguucagguaucacagccaccagggcagagaccccagcagaucuggggcccugccuaggcccagcuucaccacucucagggaggguagcagcccaggcagguaugaagagugggucuggacugccauuguaaaggggggguccacugaaaugcacucaugagggcaugagauggagcuuccuguuggugguagguagcucuauugccagaucuuuauaaucaucagauaaccaccgucuccuagugauuugcaauuuaugaaacaugauccauaauuuuaucacuaagcccucacagagcucuuauuuccacuuuauagauuaggaaauggagauuuaaaaugccuucccauaaggucacagagcuauuuaaaugauagaacauaaaucuguacgacuaccuucuuguuuucaaucucauacuuuccccuuuggccugugagcuugggaggaaaaaacagagaccuugaauaucaccaaacaucagugaauccacucauucucuucugcaucuuuuucaggggggagguucuagccaaagcuggcacagaagaagcaaucguguauucagacauagguaagauuuuccugggcaugguuuaggucucugauguccccauuguucugaggccagacuccauggcugggaagucccugucauuuggagggguuccuuuaugccccuucucauugaucucuggggauauucuagggucugguucucuggccaaucccuggggaguguaucagcuugaauuuucuugguuugguuugaaaugaugccaggccaucugugcaccuagauaagaccuauguuacuaaguuacuuacuaagacucuggugguuuauacagucaggggaagaaauccccuugguuagugaggaguugcaaauuauuaauagugcacuuuccuguuuuuugcagaccugaagaagcuggcugaaauacgccagcaaauccccguuuuuagacagaagcgaucagaccucuaugcuguggagaugaaaaagcccuaaaguuuauguuucuaaugugucacagaauaggacgauaugauucuacaacauaaucaacucccuauuaaauucuuu

SEQ ID NO: 21544 - RNA, 289974 nt, Homo sapiens
ccgggguuauuuuauuuaauuuauuuauguaauacaguguagaaagcgaucaugucauaagcaaugauucuguacaaucauccugcagaaaauuguuuuggagaauucuugguaauugaagaccagcagagcaccccuccccacccgccccguaaaagugcuuacaaugaacagggauucuuuucuuuaucaaagacccaaagauacguggacaaaaaaagaaaagcuugaagucucaaugccuaaugugugcacauaaaacaggcacgaagaaacaaacguguguauccucuuaauuccuauaucacaaauauagcagaagcagcaaucuguacaguaaaaugcagucauggaaaaaaaaucucucuaaagcaucugaaauacuuaaaaauguuuaacuuuaaaaugcauagugaucaggaaaggaauacuuaggcaagagaagcagcugaacucccacguucacaugaagcaucccccaucgauucuuaaagcauauguaaaguaggacuuaauugggucacaaaccacaagaauaauauacaacuggcuaaggggcuaugugauaaauaaucaggagagaaucuauucaugcacuaguuugauacagcuaaauucuuuacaguacacaaaacccauuaauaauguaguauagagaccaaaauguaaagagagauagaauacauuacugauguguggauuaauucaaguucaggcaucuacuuguguuacagcacagcugucaaaaggcgauaaugaguaaaucauaaaacggguuuguuucuucccacauuauucuauaaauggacaccgauggguagugaagcaaugguuuugcuguccaacuucagaggcugcuguggcgggggucuaguucugcaucugcucaaagaacuuguagguuggauuuucguagccguucugcugcaucuuggacagguggcgcuccucuggggugacagcggcgucaaccugaaaaacaagaggagagcugaguaaaaaauaaaaaucaaucuuuuaagggugaacauggagaagcaguaaaaagauaaggaguacaguacucuucuuuugccaagauugcagaacacccauaauuuucucccccacuuugacaucuuggagcagaacgccuuugcccaccaguuacacagaugcugugcuccaucuagccaccagguggcgguggaaaccuugacgcgcuugcaacguguccagugguuguuucugguuccccaacuccacaguaaguggauaaacccagugcaaugguauuuuuuccuccccuguuggguccauaaaggacaaacagagucaacggaagccuguuuuacguggaaguguuuugguaaaauagauaaaaccacaagaguaucauggagggagauucagcaaaguauacuguaucuugggugacacucaaaucuguguagaaaaauacucgauuuccuggacugcugaauuuagucuagcccauuucuaucaaauuuuauguuuguuaaaauguuaaggagagguuugagaaucaauuaaaacaauaacauauaccaaagggggcuauuauuuggcacaagaaaaaaggaagagcaaggacgacgccauucuagaugauguaauuuuuuaaaaacugagaauuaagauacuauagaaguauguucagcucaaaguuuaaaaucagacccucucuguuaauauguugcuuuaccucuaaggucaggccaguaacugaagacguuuuucucccccugucacuguuagagcuguguguggcauuuacugucugcagguugggcaggguacuuaccccuacaacgugggcaguggcuguucuuguuuuacuauauuuguuauaccucuccccguucgcagaagagaggagguccuuaacucugcugaaugaguauguuaaaauuccucuuuuguaaaaccaugguaagaugaagagaauaaauagaaagucaucagaaugaagaggcauguuuuccagagaaaaguuuggauguaccauagagaagauauuccuucaaagggauauuuccuagaaugggcugcucauucaucucugggagaauacugcaggcccauucccccuuguugaguguugccaagugacauuccucccuuaugcagcuuuucccccuacacaccccaucuggcauggaucugagccuacacagcaaugccccugaagccaaggaagaaaaaguaccagcgaggauguagugucagcaguaagacaugaggucucgagauggagcuagauaugucaugacuagaccacacuggcugauaacaauucagacuaaaagaucugucaauauggccgggugcaguggcucacuccuguaaucccagcacuuugggagccugaggugggugcgucacuugaggucaggaguuugagaccagccuggccaacauggugaaaccuugucucuacuaaaaauacaaaaauuagccaggcgugguggugcacgccuguaaucccagcugcuccacaggcggaggcaggagaauggcuugaacuugggggguggaguuugcagugagccaagauugugccacugcacuccagccugggagacagagugagacuccaucuccaagaaaaaaaaggccaggugagguggcucaaaaucccagcccuuuugggaggccaaggcggguggaucacgaggucgggaguuugagacacgccuggccaacauagugaaaccccaucuuuaacaaaaauacaaaaaaauuuagccaggcacaguagcacgugccuguagucccagcuacuccagaggcugaggcagaagaacugcuugaacccaggaggcugaggcugcagugagccaagaucgugccacugcacuccggccugggcaacagagggagacucugucucaaaaaaaguaaauaaauaaaaauaaaucugucaguauaaucagguccccuguggucccuucggauagccccacuucaugaagugauugacucuuuucagucugggagugagguggaaugacuaccaguggcuaaucccaaggcagcuggaauagguagauauacagcucccucaucccuugggacagaauguuccauccauuaugugcccauuuuuuuugaguuggagucuugcucuuguugcccaggcaaucucggcucacugcaaccucugccucccagguucaagugauucuccugccucagccucccgaguagcugggauuacaggcacccgccacuacgccuggcuaauuuuuguauuuuuaguagagaugggguuucaccauguuggccaugcuggucucaaacugaccucaggugauccgccuaccucggccuccuaaaguagcacuaggacuacaggcaugagccgccauggccaugugccccgauucuuacguuuccauuuauggaagagacugugcgccacugugaaucccucccaucuaccacccuguggcucagagcugccugaguuccccugcauccaaacccucagcuuacuccaaugacagaccuaggcaucuccccuuagcacacucccaccaacaagcucugaccaaggccaguacucagaggacucugcucaaauggaugcucagcuucacuguccuucugggagcaaaucacagauauuuuccuuauccucuccucuuuccuuugcugugcacuguugucaacaaaugaggucaccuggcuuuaacugguaacuguguaauuagccuccaacuuguaaguuaaaaaccaugguuaaagauuagcaccaaugaaugagagauuucauucacucuguaaaucugugugccaggagacagccuaucugcagcaguacgccauuugaacuugggcaucauuuuugcuccccaucaccucgaaacugagaacucaaagaaugcccagguuaaaaaaaauuaucuugcuuaggagaucaagcacaaagcugcuauguuucugauuguagaaaaaagccacaaugcugcuugauuguuggaauauuauacuuuuauuucuuccaggaggcacaucuaccaucacacuggcugucaacaaucauuugcaugcaucaagggcaggggaacaccuggcaauuugauagguuuaucuccucuucaaacuccaaagccuaacgcuuaagagugcccugcuagagaugcgaggcuccaaggcuggugcacaauccagaccucuaacucuccugucuuuucuuggcuucuguuuugcuacuugauaauccuauuaccuuuugccacugagaggacagcuacauuuugccauuccugccauggggcagcuuggcccucagaccuuagagggcuuaggagcuacagaagaagggauuaucuugacaaaagggcauccaaggaguauggauuggaucuuuaaucuccagccccuugaaagcuagaugcgaaaaucugaguacucaugucuauggauaaaggaggagcaccaaguaaggguagccuuccucuccagcaggcucaccaaucucuuccucauggcuaagcuacagcaguggcaugggccaccaugugaaggccagcccuaccacgacccugugcagacagggccucugcacagacacaauauuauuucccuuaaagcagagccagggaggguuugagcccauggugcuuguucuggaaggaaugauaagacaaugaagucagaauuuccauuuuccaacugggcaggaacaucugucacuugcugggaugaagacacacauacauacaaccacugaauauucauucucuucccagacugccuggauuacacagcagcaggaaaugaucugaggucuucaugugacucucgguacgcugcaccuuccugagaccuggaccccugcacugcaugguggcauggcuucaacuggcugcugccuaugacacacgcugaaaagagcugagcccaaauagccugaccagccuuguucuaaaauagcuuugaggagaacguuugacacucuuuggcuaaccuccauacccccugacccuuuucucccugaacuugauucauuggaaccauuuaguccuucacuguauccagaguaauuuagagcucagcuauccgccugcagggacaagauucuauuugggugaccuuaguuucuaggucuccuccuauugccccuagaguauuuacaugcgggugugugagcuuggaggagaggcaggaaacaccacguuuacauuuuauuauguacaguaaccagcaggauguggauuaauagauguccuuuuauacaagggacugagucaggccaaacgacagaauccugucauugagauggaccagacgaguaaaggaggguaagggaacuaaggcgaacaauacaacaauagugugacacaucaaaggagccacaagucugcggaaaaaaaaaauaaaagcaaagaaaauaggaaguuuucaagcuagugacuuaucccucguaaccucccaguaacugccugcuaccuaguuguauagaugcuuguuuuccuaauuuugaugccaucucucuauaguuauauauaacuagaaggcaguugacuauguuuauggccaacaucaagcaauucuucaggcagguucaggaacuccuuugcuaucccuucauaauuuuuuuuuuuuuuaagacagucuugcucugucacccaggcuggagugcaguggcgugauuuuggcucacugcagccuccaucuccuggguucaagcgauucuccugccucagccuccugaguagcugcgacuacaggcgcaugccaccacgccuggcuaauuuuuuguauuuuuauuagagacagggucucaccauguuggccaggcuggacucgaacuccuagccucaagugauccaccugccuuggccuccccaaaugcugggauuacaggugugagccaccacgccuggccugugaucauuuuugaugcuuuccuuugaucuuccaauuucucuuccugcugcucacuguaagccacuccuagguucugcacccccccucacuuuuccuuaucguggcuuuccauucaaccugaccacucucuccaacuacucuacaaugccaacgucagugcgucuguauccuggugggucagcuucuggccgggaagaaaggaccucuaaggacaucuuuuuauacagucaccagugugacagcauauuacuuagaaaaagucauaugccauaccuccauaaaagccaaauaaaaggaacucucuucuuauuuagaucauuaaugagauaaccaggaggugggggcggggagacuucugguguucaagugaucagaucugugagaggaaaacuuuuucacauccuauaauaaagagaagcugugcccccaacuucuccuuauuaaaggugacaugucuggggagaguagcagaaagagcuacaauacguauuuuuaaauauccagugucuauguaugugaauguagaaaaguaccgcuugcuacuaaacagauccugggauuagugggcuuugcaggaacguccuaaaacaggagcaaggugguuaauucagcuagugcugagauuuccagccaccagagggcuauucugacauggagggcacauuuggggagugguaauaauaaagggcuauugcuucacugcuugaagcaccaauaaggcacaguuaccuccuugggaaagcguggccaauggcucacagagugacucucuggccuuauggcuaaguaaauucaguaagucaauauuuccugcuuauuugaaaaaaaaaaaaaaaaaaaaaaacaacaacuagcaagugcucauuuccaaaugcuaacaacucuaccaauaaaaauacaguuaugggccacauaaugacauuuuaguccacgacagaccaaacauaugaugguggccccauaauaccguauuuuuuacuguaccuuuucuaguuuguuuagauacgcaaaucccugccaguguguuacaacugucuauaguauucagugcagcaauaugcugcacagguguggagccuaggagcaauaguuguagguguguagcccagguguguagcaggcuauaccaucuagauuuauguacauguacuuuaugauguuugcacagcgaucaaaccgccccaugccacauuucucagaacguucucuccagugugaagugguaugugacuguucuaggcuuguuucauuuauacauuuguucucaggaguuuuuuuccuaggguuccuaucucugugaucuucugcgggcauuuuucacucuaaaaacaaaaaaucuccuggaaaccaaagcuuucaucaugacuucuucaggcacgaugguauguaaguacaaugguauucuguccugagugacugaggugaguccaacuggaaauauugauguacucauuuuuguucuuacugaaguaggguuacugauuaaugaagguuagccagagccggaaauaaagguauuuccauguacuugagggugagagugccuguuaagguaggaagaggauguugcagaagcaucacuucugugggugcagacgcuggaaugcuaagaaaaauggugcucugaaagcccaccgugcucucucaccugggaacaucccuaggcuggguugcaacucccuguguucagguucuaccaucccagcuaaacuacaucuuuuuugaggacagaaaagcggaauguggucuauuucaacauugcuguacagacacacuauggggcugcacagagggcugcuuucaggaaggacagucacaaaggucuugaggggaaggagcugagaggaaauaaacaaaacaaacacgaaugagguggagccccucaucuagaaaggcuuccaguugcucuccaguagacagcaaaaugaggagagaagagcugaacagccauccuucccgauuuugcuccugcaaggauaccuccuggcuuaaaaauuaaugucagaaucugggucaaagugucaacuucuccucugacauuuuaaguccaaugagacacugcuugguaaacugacuaaaaaaagagcguuuuaauucaggcagcuggaagagcacuuaaaaggcaaccgguuaucugggaggugagagauaccauuuuccacucccugaggcuugcgcggagaacuaaaaggaaggaguguuaaaaugaugugucagggauucucaaauccgacugcacaucucauucauuuggggaaauuuucaacacucagauucgcagccuccuauuuggggauucuuuuuccuuaggucugagguaggaccuggucucacgcacagccaggggaaggagcuccagguggaggccuugcuuuuaugcucagcaucacuggggucuguuacgggcuaaaacgugucccccuagaauucauauguugaaguccuaagcugccaguaccuccaccugugacuguauuugcagauagggucgaagagguuauuaaaguuaaacaaggucaucaggguugauccuaauccacuaugacugguguccuuguaggaagagguuaggacacagcagaaaaacagagugaaggucaugugaagauacagggagcagacaggcaucugcaaaccaaggagagaugccuggggaggaaccaaccuggcugauaccuugaucuuacacuccagaaaugugagaggguaaauuucuguugcuuaauccacccaucuguguuacuuuguuauggaagcccgaggaagccaagucuuuggccucuggcaucaaagaaggcaacuucaacggacagaccggcaacaaagagaauuauauuaaauaaacuaaaaagugcucuugaaggccaggcaugguggcucaugccuguaaucccagcaccuugggagguuggggagggcggaucacuugaggccaggaauucaagaccagccuggccaacauggcaaaacccugucucuacuaaaaauacaaaaauuagccaggcguggugguaugccccuguaaucccaguuacucaggaggcugagagugagguaggagaaucgcuugaaccugggagguggagguugcagugagcggagaucaugccacugcacuccagccugggugaaagagcaagacuccaucucaaaaaacaaagaaacaacaacaacaaaagaaaacaacaaaaccaugaaaaaaaccaaaacaacaacagcagcaaaaaaggggucuugaauuacucaaguaugaagacaucuuuauuugcucaaauauggaauuaaauuuuuuuaaaaauuaauuugagcagaaaugaaauaagcugauacuaaugaaaaccuaucuuacacuguuuugagggacauaagcuuagauacuaucacaaaaggugcaauggccaaacaugacaguggggucauugcuuuuaugugcucacacucugaucuaugggucaguccguuccuuuccacccugcugccugcuguucucuugguuuccuuccucacacugcucauccacgucaguaugaauggggaaaugaggcuccaccccaauuuccaucagcagcuucuguuguagucugcagagguuuuaauugcugagcaaaaugaaauuucuggcuucaccacaaauuucauuuauuuaaacucugccuguccucuucuaaucaagaaugguuuagagcccauuuccuuggggauaguggaaucuucaacucccuagaaacaccuggacuuuucucugauggaaaaagcaaugggggccagacgcgguggcucacgccuguaaucccagcacuuugggaagccaaggcggguggaucaccugaggucaggaguucgagaccagccugaccaauauggugaaacccugucucuacuaaaaacaaaaauuagccgggcaugguggcgugugcccauagucccagcuacucaggaagcugagacaagagaauugcuugaacccaggaggcagagguugcagugagccaagauccagccugggcaacagcgcgagacugucucaaaaaaaaaaaaaaaaagcaauggggaauaugaggggaaaucuggacucugagcuugaccuugcauaauuugaacccuucugucucggccucaguucccucaucuacaagaugagaagaucaauuugauuggucaucaucaauaaaucuuucagcucuaaaaauuccauaacucuuaaaauaucgcaauuaaaugucacacaaauuuuucaguuucccugugcauauaaaaguuauguuuacacuauacucucugcaagacaguuuccuaaaaaguugcauauacugugagauuuuaacacuuuuucccccauccaaauggcauuucaaaugcauaaaaauaacuuauucguaaauuuucuuucucucuuucuuguuuuaguauagcaccuugaaacuaagauauuucagguggaagugcaggguaauagguugcagaacucucaaauaacaaucauguauguuuuggugggccauuugguauagugugauuuccugagaaacuuuaaagguaagagucugcacugaaaagucacauuauuuacuauuaccugguuguauugagaggccagacuauuuaagacaaaagaaauccaagaauaaacauguuuaguuuuuuuggaaaaagcaacuuccuacuucuauuuuuauuuuuaacuucuuguacugguuuuuguugcuuguguuugaaaaaaaaaagucuaagaguaaucaugcuuuuuuaaagucaugcauuaucauuuguauuauuuugauaacuucaacacaaauuguaaguugagauaacaacacacacucucaauaccuugagcagaauauucacgguaaguugcaaugaaugaaaaccaaaacaagaaagaacaacuguaacccaagcaucauggaagcacacugauucguuuuuuaaaagagauacuuagcuaguucuuagcaaaaagcuaagccuaauucucucauagucuuaauucccacuuggaaacaugcagucaaguuuaccuaccuccaccacaccaugaugaauggauguguacuguuucuucuucagcaucaccaaggugaugacgaucacugucgcuaugacaacaccgcccaccaugaguccaaugauugcaccuuuguuugaacccacaucuucugcaaagaacaccuugaaaacaaauuaagaaaaagaauuuuaauuucuaaaugcaauauaauuuacaauuuauaaacgcaauuagaagaauuucauuucuuaaaugcaggggacauuuggaugagguuauauaaaaaguuucaguauauucucugcccaacugguuggucaaauauuugaugcuuacuuuaaaaaaaaaaaaaaaaaaagaaaucacauauuuuccuacuaagaaugauaaucauaguuuauagaaggauguacaacauguggcuuccccaguucgaggaagucuacuuuccccacaggucaaaaccgaagucugcagggaccugaaacccuuugacagguggaacauuuggugaguggugggaagauagcgcuuggaucuaucaaaagcuggaaaggcacgaucauacuaaugaaaggaggucagcauuuuccuagucauagcacucugagcccugaugugugacucuaagugacugagacuuagguguuuuucaacucugcagauguccuaauuuccuuggagggacacuuuuaaugcacaggaauaggcauucugaaacaaaggaguuaaacaauagaaaaaaagauaucuuguuaccuacuuuuagcuauaguaauucugcagaauucuaauuaaccuuuagcaguguaaugcuuuuuaaagcauaauguuauuucaaagugaaguacaggcaacaagaauuuuaagucacucauaacucaugcuuucuaacuauugucuccagaaaccaaaaucugaaauguugcuuuauucuugcucuuuauuuggauuaaacauaaaaauaauuuugagaacauuguaaagaaggaauaaaauuucauuuacugcacuacauugcuucauacuguuuauaaaagcaagucauuauuuuucaacuuuaucuacuugaaugaaauuauagaagcacaccacaacuuuuaucaucuuguuauauaaggaguugaucuuaugccagaugaaguaaaacuaaagcuaaauauuaccacguuugcucugcaacuuaaugaaaauacaggcauacauagcuuuauuguacaguagugcuuacagauaguauuuaaaaaaaaaaaacaaaaagguuucugguaacccugcaucgaacaagucuauuggugccauuuuuccaacagugaacacagguucacuucaugucugugucacauuuugguaauuauuuaaauauucaaacauuaaaaauuauuauaucuguuuggugaucugugaucaguggccuuugauguuacuauuuuaauuguuuuggagugucaugaaacaugcccauaaagacagcaaacuaaaucaauaaauguuguguguguucugucugccccccaaacuggccacuccacccccucaacucccaggcucccuaucccuugagagacaacaauauugaaagugggccaguaaauaacccuacaguggccucuuaaguauucaagugaaaggaagagucacaggucucucacuuuaaagcaaaagcuagaaauaauuaagcuuagugggcaaggcauauugaaagccaagauucuugugccaguuagccaaguugugaaugcaaagaaaagcucuugaaggagauuaaaagugcuacuccagugagcacacaaaugauaaagcaaaacagccuuauugcugauacggagaaaacuuuuaguugucuggauggaagaucaaaccaaccacaacauucucuuaggccaaagccuaaucaagaacaaggcccacaacugucuucaauucuaugaaggaugagagaggugaagaagcugcagaagaaaaaaaaguugggagagguugauuucaugagguuuaagggaagaagccaucuccauaacacagaagugcaaggugaagcagcaagugcugauguagaagcugcaauaaguuauccagaagaucuagauaagacuccugaugaagguggcuacacuaaauaacagauuuucaguggagaugaaacagacuuauuuggaagaaaaugccaucuaggacuuucaucacuagagagaaguccugccuucaaagcuucaaagaacaagcugacucucuuguuaggggcuaaugcagcuggcgacuuuguuuuugaagccaagacugaccauuguaaaaguccuagggcgcuuaagaauuauucuaaaucuacugugcccaugcucuauaaauggaacaaaacugggaugacagcacaucucuuaacagcaugguuuacugaauauuuuaaacccacuguugagaccuacugcucagaaaagacucauuucaaaauauuacugcucacuaacaaagcaccuagucacccaagagcucugaaggacagguacagggagauuacuguuguuuucaugccugcuaacacaacauccauucugcagccuguggaucaacuuucaagucuuauuauuucagccucuuauuauuucaaaauauauuucaaauauauuuuguagggcuauucacugccauagauagcgauuccucuaauggaucugggcaaaguaaacugcaaaccuucuaaaaaggauucaccauuccagaugccauuaagaacaucugugauccaugggagaucaaaacaucagcaauaacgggaguuuggaagacaaugauuccaacucucaugggugacuuugaggaguucaagacuucaguaaaggaugucacagcagaugugguggaaauaacaagagaacuagaauuagaaguggagccuaaagacaugacugaacugcuaccaucucaugaucaaacuugaauggaugaggaguuaccucuuauggaugagcaaagaaagugguuucuugcaauggaaucuacucuuggugaagaugcuaugaacacuguugaaaugacaacaaaggauuuaggauaucacauaaacucgaugaagcaguggcuagauuugcgaagacugacuccaauuuugaaagcuguucuacugugagcaaaaugcuaucaaacagcaucacaugcuacagagacaucuuuuugugaaaggaagagucaaucgaugcagcaaacuucauuauugucuuauuuuaggaaauugccacagccaccacaaaccucagcagccaccaccuggauuagccugcagcagugaacaucaaggcaagauucuccacgagcaaaaagauuaggacuugcugaagacucagaugaucauuagcauuuuuaguaauaaaauauuuuacuaauaaaaguaaaguauauacauggcuuuuuuuuuuuuuagacauaaugcuauugcacauguaacagacuagaguauaguguaaauacaaacuuuuuuuuuuuuuugagacagagucuugcucuuguugcccaggcuggagugcgaucucggcucacugcaaccucugccuccugggaucaagagauucucuugccucagccucccgaguagcugggacuacaggcacaugccaccauaugcagcuaauuuuuguauuuuuaguagagauggcauuucaccauguuggccaggaugcucucgaccuccugaccuugugauccaccugccuuggccucccaaagugcugggauuacaggcaugagccaccgugccuggccaacauaacuuuuauauguacugggaagccaaaaaauuugugugacauuuuguugcaaaauuuguuuuauugugguguucugaaauuuccaagguaugccuguaccucccuaaaaaauucuuucaauuuagccucaagguagucaaaugacugauuuuucuaagcugaaacuaacauacuagcaaucuggaaaggcaauauaaaauauagcaaaugaagcaacuucuaaaaguguuuuacucgugguuuauaacaaaaugagaaauuguucauaauuauucccuuuacuaaacaaauaugcuagcucaacauuuuuaugaaaagcaaaucauuaauuagcuaauauacuagugugagguaaucaggaauaaauacaagucuggacauaugccugugccuuuaagaaaauacuguaauuuuguaauauucauugcacuaauuauaauacauuaucuuaacuaguccaguagagggagcugauucuccuaauugcugccgcugccauuagucacugucgcauuauaggcguuaguguaauuguggggaugggcuuauaugacacaggccccaggccccgacaaaugcaaaucuguacauuaaucgucagcuuucuaccccaccaacucuucaacucuuuagugguuccccaguuuuuauuaaccucuucagcaacagccucaucaagagaaacccugaucuuauaacaacugauacuagauuaucuugccaaugaaaaccaugcuucaaaaagcuaaaugucuuucuacaaaaaaagaacuaugggaguuaagaaugcaaauccaaaucccaagucaguuuuuuauuugcuacaauuauuuggagucaaguaaggcauaaauaauaauuuggagguguuucuuuuagagauuaauacuaggauuuaucaacuuuaugaauauugaaaagacauuuucugcuuggaaaaaaguaacacucacacacacacacacacaaaacaaaacaaaagaagugccugagauaacuuuaaguauuauugcuauggaaauuuucuuaccauuuuucuguccaccacugaaugugauaaaauugucgucuucauuaauuuaacccucuuacugcaccuacugauaagauggaacccuaacauaauccacgauuugauuuaucuccauuucuaagcuuuugguaaaggauuuuauauaacuacuagagcugaccacaaaggagauguggcuuuuugauuuacuccaauucuaacauuaggggggaaaagugauuucaucugaaaaggaagcugcugucuucuuugcacaaaccuuuugaugaauaacacuaucgggaacaucaugggguccugcucacuccaugaucuuacucuugcaagagaaguuaaaucaugggagguaggggagggaaugaaaagaaagagcugggggagaaaugaauggguaaaggaagacaguuccggaugugaauuuaagccacauaaaguguucuguaaaaccaagcaguguaugcauguguuugauccuucaaauaaaccuauuguaaaccuauuuucccagaaaacacaguggaagucaaaguggcugcuauauugaaauuaauuccacuuuaagucccgagucaugcacgaacuuugcugccuuguagucugaaagaacuauacauacagccucuuucuuuucuuuuuuuuuuuugggauggagucucgcucugucgccuaggcacgaucucagcucacugcaaccuccaccuccuggguucaagcaagucuccugcgucagccuccccagcagcugggacuacagguguuugccaccacacccagcuaaucuuuuuuguauuuuuaguagagaugggguuucaccauauuggccaggcuggucucgaauuucugaccucgugauccacccgccuuggccucccaaagugcugggauuacaggcuugagccacugcgcucagccuagccuauuuauuuucuucauguuuucaugguaauccuauaggcaagcauuguauuuuuaucuuuuccuuaauuugauuucuagcacaggaugaaccagaguuaauaggucauuuggcaagacaaacaguaguggaaagagguaaauuauuuuacguaccaauuuuugaugaugaacuucauauccugagucaugucggaauucugcauccaucuucacuucagagaucuccuccgucuugauauuugucaacccagaaccuguauuacaucauaauuaaaguaugcaggacaaccaauuaguuuuacucauaaauaauaacacuguaagacaaagccuacccaaaacuucuuucuaggccugaaguuagaagaaaauugauaaaugacucuuaaagaaaaaugauacccuauauuuaaaacuucaauuacuaccuauuuugaacaaaaagaaaugaaaggguaagggaaaccugaaaguaaggcuucugcugccuuuaaauacaugcuauaauuuuugaaaaugggggaaaagcagaaguuaaauccugguugagagguuggcaaggauuuguuccuggaauauguuggcuuggcuuacgggcuuauuguuuagccuauuaugugucuuuuuccaugugcacucauuacuucagaaauaauaauaaaaggcuuuaaaaaugagcauuaauuaccugguagaacaaaacugcuacuuuggggcuuuguuccaauuacaaauaaauuauguucauguaucuaugcagugaagcguuguaaaaauuauauaauuuuagucaaguguucuaguuacacagauuguaauugguucgucugcugaauaaagagcuauaguacauaauuuuaaaaaugcuucuuagcaacuaacagaauuuauaaccuacgaacucuuccuuuucuauaaauugcuauaugauucuuaacacuaauuguucugaugaauuucauuauucaaauaauaauuugaagcuuaaaacaaaaugcagagucauuuaaaaaccaaaaacauaaguaaaaaauguaaaugucaguguccaugcuauaacauuuaauuaucaaacaucagaauuuuaggaugaaaagggcuuuugaagucaucuucucuaccguguucccacccaggggcagauugucaguuccuguuugaacauagaggaauguaucaauuucccuccauuuuuugauagauuugccugcccaaacuguccuuuuuuuacaugaagccagaaucagcuucccuguaacuuccauccuuugagccugauucaacacagagcaagccuaauccucccuuccacauuaaaaccuugaacagguaucacgacccuaaggagaggcauguuccugcugguucuugucuuacuugggcuacacauucccaauuccuuuggcucccaggggaauucacuuccugcucuuggccuaaucacucuuucaaucuugucuacgagauucugggaaacuugugacacaucuugcugacacugaaaagcacaauguccacagcauaugaugugccagucuaagagcacagccuauacaaggagaagguaaggauaaucugacaaaaccuaggaaauccacgcugguugugaccuagcaccauuuccucauccaauuguucaaaaagcuuccacuugauaaccuauuugaaaagagacccacaaucaaugucacucuauaccuggcuuacagauugugaagcuaucuucucuccuuuuugcuauucagaacuucauuuuccuaucccuaccuucccagcuuuccacaaagaccacaggcaauggugcuacuuccccuucaaguucucuuagccugcaguuggucugggucauaagaacuuggacuuggguagcaagaugucauaguuuaaaauauauccacaaauuugcugauacuccuuccuucaagagggagaacuugauucccuuccuucgaauguggucgggauguagugacuugcucuagugaacagagcaugauagaagugaugguguaugacuucugagacugggccaaaaaaggcacuaaaacuuccuuaaucucuuuccuggaccucuuggugcaggggugcgagaugccauguuguagggacgcucaagcagcauuacagaguucacaugguaagauacugaggucucuuaguaacagugacgugagugagccacguuggaaacagacccaccagguccaaucaaaccuucagaugacuuuagcucaggcagugucuuaacugcaaccacaugacggacacugugccagaaccauccagcuaaaccacaucccaaauccugaccuauaaaaacuguaagaaacuaaugcuuguuguuuuaagcugcuaaauucucgcguuauuugcuacguagcaauagguaacuaaugggcuagggcuuucuuuucucauguugaucuaucucgggcuuuaauuuccuuucaucagaaguucauucucuuuaauauagacauaaaaggcacaauggaagugggacaguuucccuuucucauucuuuaacucugguccucucaaugaccuaacccucaacccccaacuucuugcuacgagacccacagaguucucuauucuuauuuauuuucuuacuuuaauauuguuaaguauuuuuugguuaaguuucaacucauucugcugaaacgaaccuuucugacacuuauuuuuauaggguagugaugcuaaaacucucuuaauucucacuggcuguauauuuuaaucuuucuauagcccuuuuaaaucugagauccuuauauaaccagugauuucuuuagagcucacuccuuuucuguuauuaagaucuggcaacgugccaagcacgguggcucacgccuguaaucccagcacuuugggaggccaagcuggguggaucacuugaggucaggaguuugagaccagccuggucaacauggugaaacccugucucuacuaaaaauacaaaaaaaaaaaaaaaaaaaaaaaaaaaaaaauuagccaggugugguggcgggugccuguaaucccagcuacuccagaaggcugaggcauaagaaucgcuugaacccggcagguggagguugcagugagcugagauugugccacugcacuccagccugggugacagaaugagacucugucuccaaaaauaaauaaauaaauaaaagaucuagcaacacaauagguuagaacuauauuucugagauuuuuaagaaaacuuucuugaacaguuugaagagucuucccuuuuagauuuuggagccaaauauuuauacugaaaaauaaaaguaaagaaugagcucuggccgggcacaguggcucacaccuguaaucccagcacuuugggaggccgaggcgggaggaucacgaggucaagagaucaagaccauggugaaaccccgucucuacuaaaaauacaaaaaauuagccggacgugguggcaggcaccuguagucccagcuacuagaggcuuaggcaggagaauggugugaacccaggaggcagagcuugcagugagccgagauucgugccacugcacuccagccugggcgacagagugagacuccaucucaaaaaaaaaaaaaaaaagaaugagcucucggccaggugcagugacucaugccuguaaucccagccuuugggaggcugaggcgggcaaacaguuugaacucaggaguucgagaccagccuagccaauauggcaaaacucugucucuacuaaaaauacaaaaaugagccaggugugguggcacaucccuguaaucccagcugcaugggaaacuuaggugggaggauagcuuuagcccaggaaauggggguugcagugagcugguaucaugccacuguucuccagccuggaaacagagacaaauccuguuuuaaaaaaaaaaaaaaaaaaaaaacaaaaccaagagcucuccacuaaaaacuuuacaagcccacacuacuuuugaaaugauacugugaauacuuuuggugguccaaaaaaaaaaauucauauuaucaagucagcaugacagauaaauucauguuuacagcucaauaguuugagaagcucuuggcagaagagcucuugcuauaauaguucauguuuguuuagcaugaauagucaucuagggaagacuuuuuacauuaagcaaaucuuacuaaaagacaaaaucaguaagcuggcacauagggaaauauucauaauaaggugauaaugcauguaauaaaaugugaugaguaguuucaaauaaauggcagggaccuugguuugcaggcuuacuuagaggucuuucuugaguugugcugauuucacccuaagcccuggugacuccagcucucucuuccuguaagucaugaugaguggacagagccuuuuguucaugugggggcuaagggagguauguccuucaugacaccucuugcauggcucgggucaaggaccugguuucccuuuauuuggacugcagaaggguggugaugaauuguaacagaaaggguagcuuucuacccuaugugaagagcucgcuaauguguuuuucuuuuuuauucuggucaaacuguauaauuaguccuucagagucuauuuuuucuuuggaaguaagccaggaggaggagcuauaauggccacuaugcccccaaaucaccacuguuauuacaauggucccuacuugacacugcaugcuggaagcuaccauauucuguuuuuuuagauaugagaguuaaggagaagccauuuuccucagucaugauuauaaagcacugggugggggaaaaacaaaaaccuuuuuuuaacuuguuucugaggacaacagugauuauucaaaaacaaugccaucacuugaacggcaugacaaucuugggaaggcuuucuaaguuuggaaaggcuaaagauauaauucggcacauuagacucaaguggguggucucuaaaaugugaagaagaaccaaagcuaugcuacaaaacacggggaaauuagcccaaauguuugauaaacuuacuacaagcacaaaaacagaacacacgcauggcuuaauacaugugcaguaaauacugcuauucauagacaaaccuuaacuagaaucuuccucacuucauaucugagcauucuuucucaacuuuagccaucuuacugggcaacccaagccuacgcuguguaugaaaggaagcuuggcuuaggccacccucucuucugaauagaauuguucccuucuucuuugccaauccaggugccucaaaucuuucauaaccucucuggaagcccaucuccaguaaguucucuacuuaacaugccccuggguuaguacuccaucuccucccaucacagaacauucuuguuagcacuuaauguugcuuuguauuuccuugucuuccaaauuccaucucauguuuccaaauaugcaaaauuccuucuauuauaccucaagcuccugagagcagggacccuaccguuuaauuucuuucaaaccuagaaagaauuuaguggauugaucuuugugaaauccccaagugacaucauauucuuacuguuaugagaaagguuuuggaugguuuucucccaccaguguaauaccauuaacuauucucuagcucuuccuuuaaaacacacuguuuuuguuugacagcguuuggagguguccuuuuuguuagauuuagauuaaaaaaaauuuuuuuuaaaagaauaggccgggcauggugcuuaugccuguaaucccagcacuuugggaugccgagguggguggaucaccugaggucaguaguucgagaccagccuggccaacauggugaaaucccgucucuacugaaaauacaaaaaaauuagcugggcaugguggggcgcaucuguagucccagcuacuugagaggcuggggcacaagaauugcuugaacccccgaggcagagguugcagugaguugagaucgugccacuccacuccagccugggggacacagcgagacuccaucucaaaaaaaaaaaaaaaaaaucaaaaaacaauuuuuuuaaaaaagaaaaaaacauugacugguagugucaccugguccuggauguuucaauaguaacauauaggcucuccuggcccaauguagaaauuugauaaaauugaaugagucgaaugagcgcuuucuaaguuacauuuuaugcuuguagaugaagagcaugucuuuuaaagagaagcaccaugaaaaaagucccaaggcaaaugaccaaccugagcuggcugugguugcaauuagaacugaacugacccucagcccgaggccuuacaaguuggcugagcagaacaggaaugucaacuccuggcuccuugagauucccuuacaugacauugacaauaaggaggacauuagaagaacugaaacugucucugacucacuauaauuuaaguuccccuuaaaagccuacagacagaaauucauaaaucaacgagaccagcugucaagacgugucacacuacugucucugcugccacuguuaaucacagcauaaaggcaugaagaugccacaggcagacucucagucuucaucagugaccgugcuuggaggcagucauggcucgagccugugguggaagugugagggacagggugggucuccuggucugcugcugacuguaucugaaccaggcagcaaagguugaccucuguguauuaauaucuucaaagaaaguuaauucccuguucuuugacuaucgccuggggacauuaugaggauaaagaagaaaauaaauauggaaaaguauguguuauuugggauuaaaaucucccuggaauacacaaauuugucaauucaauaacuuucuuccucuuuuugauucacugaaagcacuggcuacuaucaguugggugagguuguucauagaguagacaccaggcacauauaugcuucugcugugcuaugacauuauucauaaaauaaaaauguguuucuucuuaauguuugugaaacuguaaaaaaagaagugucuauuucaguguuaaugggauuuuuaaguaauacauaaaaaaagggcuuaugugcaaaauuaugcauccacaucuguuguguuacuuuagccacucauugagaauaaguacauacaacccacaaaacagaagauguauuuugggcucuggaaagaaaccaauucugguauuuucaggaaaucaugucuacuucaguaacugauugaaguuugagcccaguucaguuagaaaauuacccaucuggacaccaaacaagaaaggagagauguucacacugguauccaagucaucaccugagagucuacaucuaucugggcuucuguuuuuaaggacaggcuguauauaaucgucucuguuuuuguuuuguuuuguuuguuuuaaagaaaaaagaaaaaaaaaaacccaaauuuggaagggcucucuuuuagguuucaaagggaaagcucagaaacaaaaaaaaucauuucacucggaacuugggaaaugaagaguaaggaauagucaaggggaauuuuuaaaaguuugguuucuaaggucacuucaaauucuacucugcaguaaguacaauugagagaggcuuaaaaugcagaaaggagacaacgucugcucgagcuuaggcccaagaugcggagaggcacaagucaagcgguucugauaccuggucgaguggucaguccucggucggcagcagggcgggcaucaacaggcucaacugggcacaggaagcaagggacacagaaagcaaacaagacaaaucaagaugguaagucguggcucccaaacauagucgagcagggaaaaaagcauaugcaauaaacaaguuacaaaaaaggagcagccagaaaagaaccacagugaguuaaucccgagcaucgaggaccaggaggggcaccacuuuaaauggcuuaucgcuauugaugugccaguccugcuccuuaguuuucuaauaaaagcccucaccaggauacgcagcaacaucaaagaagagggguggggaggguggauuucccucugagcuaguuuagagauaguuucuuggcuuuugauuagaaauaaaauauucccagccuagcagaaaaccuuaaagauacuuccuuuuacaacugcccaaucuuaucuuauuuuacaguuaauuaacuacaaaaggacucuguuaaauuuccaggggaagugcaaauaugaauuuaucaggagagcaaaguuuuacuauauaaucugccauuuagugagugaaucaaauuuguccuuaguaugagggcagaagagggaaaccgcagucuuuuucucacuuuuucaaaaaggcuggcuuccauuugacagaugacauacagcugaaacgugugaaaugaggauauuucauuuuauauuugccauuguucacaauuuucccuuuuuauguguucuggguccgacccaaagaaagcaguguggacagcaugauauuccucaccaucaucugaccuuuccaaagcacuucugaugcucagaaaauacuuccuuguuuuacgcuggcguuugaagaaacaaggaauggggacaaaagugaaguuuuuaggauuaauaauggucauaggguaaaugaagccacggagguaggugcagggggaagcugcuuugguaagguggcaaguguaaagggaaaaagguaagacaaagugagcacaggugcugaaggagacacggugugcucgaugaaauggcuucuaacaauuucagcaaaaccauccagcuuacugaugcacacaggccaggcauucaaaggugggauucucaguccaaaucgauuuuggaugccacauguuaauagaaacagugagggagaaaaaaaguggcaguaagccaagucuccaaaauauaagaaaauauuuccgggagcacuaggauauuuggaugaaauaaaaauuugguccuuucucauguagagacuggcagcaugguggagucaaaaggagggugaggcaucuaaucccaggccugggcccaacauuuacaaugucuguggccuugggaugcgccacuucuguggcuguuucuccauauggaaacagaaauguuaacaucugcaucuucuaauuauggugaggaacaaauaaguaaccuuuaaagccuguuugagacccuaccagauacuacagaacugcacugauuaaauauccuaugauuaaauauuccauaguaacuacugaugcgagagugacuauucucuaguauuucacuagugcauuagaggaagacauaguucacuuccuucugcaacucccaaauacauuucgacaaugagguuugguuuuucuauacuucauuuuuuuuccuauuugcagcaaccuguaaugaguaacuguauuacuccuuguaaaaugcaguuaguugaaaggucauuguacuuugugagaauuuccugaugaugagggacccaauagugcuucaacugcaguuaagaacacaacagaccacaugcacgagggcaaacgcguaccuugaagugguggugagcacauacaucaauaguuacguuauuagaaaauguauaugcaacucggggcaguaaguuaaguguaccugugguuuaaaugcaggcugaggagcugguagucccacgggccacugcuaaugucaccacuuacuuucucugugaucuggggcuaaucacauucuuucugaacuucaguugugucacaaaguaaaugguuuuuccaggguucaaaugcguauacuuaugugaaagaaacuuacaaaugauauuguccuauaaguuucucugccucuccccgcucuucuucuucuucuucuauuuuuuuaaauaggcauguauuauuuaaaaacaauaauaaaacccuaacccuauuuuuuaggaagauuaaacaaaacuaguuucagugacauaaacccuaaucugcuuuaaaagauugaagcugauuuaguauaaauuaaugcucaaaaaauaaguagcucagggagcagacauuaaaaguuuuuuaaaaggcaauuaugauaucauugccgaaaaaaaagaauacacaccaacaaaacaaaguaguguguuauuucccaauccacugcaaauacuuuccaauuuuuccaauugaccuuuacuuaaccagacaguaacuucaucaaugaagugcuaaaaaacaucuuacauuggcuguuuaguaauuuaaaaacaagaaauacauuaucuuagcuuuaacuuuuaauagaguuaaaauaaaauguaagcagaaaugaguuauucucuugcucucaguagcuuugaaucaaauccuuugcuguaagaggagagaaacagaauggucagaccucugggauuuuugagucuguuacuucugguauucuuuguaauaaaccucaacuauuaaccgugcugccuuguacaaacucucuaccaggccaaagguaaugaggaaucagcaguacaccaguuuuacauauagauaagaggcugacaagaacugguuuguaaguuuaaugaaauauuuauuuaaucuaaauuucaacauuuaaauuggcuuccucauugccucuauaaagcuaguuaaaaauauacuagaaggcagcuucacauuuugcaaauacauccauacaagucuuauaagaccugcuuugucucuuuaaaaauauuauuuuaucuacauauuauaucuagguauuaucuacaaagaggcagacuguuggccacaaagacuugcuggcagucacugcaugcuaugcugcucuuuguggcugcccuucucaggcagucaggaaaaaguagaacaaacacaaaugucaucaacgcuaaugcuuccagccagaucauuucacgaucugugagcacaauucuguaacaacagcuucauuucagccuagccauucauuuagguuuuguggaugugaaaaccaaagaauaaaaaauuguuaaggcaaaucacagcacauuggaaaacucugauaugcuuauuuucuucaauguaaauuuaaaaaaugggcaucagaaccuccucuggauuucacugauuguucuuaagaaaaacaacaaauuuuugguaagcauuugaaacuaugauaaugaggacugcaugaagaacaaaaggaaauccuuugagaauuuuagauauuuucaguaguuggguguaugugugugugugugcacaugucuguacaaagaaagacuaacaaguuucuggggagaggugggagacgguguuagaagagagacggcuuuaggacuguaucucauuauauggcuuauuauauucauuauuuuaaggauacauuguugaggccauaaggugauucaucuugagacaggcugauaaagucucucuaauaagauccuggcuccauuaaaaaaaaaaaaagcuaccacugacauuuacuacguuccaggaauuuugcuaagagcuuuuuuaugccuucuuauuuaaugcucauacuauaccucugaguuaggaauuauugucaaccuuauuuuacagacgaggaagcagccagagaggcuaaguaacuugcucagaagcacauagcagggcuggaauuuaaacucgggucuguaucauucaggaguucagggguaugggguaguauuuaauauccuaugagaugauggccgucuauuuuauuuaaaaaccaauuggggccgggcgccguggcucaugccuguaaucccagcacuuugggaggcugaggcgggcggaucacgaggucaggagaucgagaccauccuggcuaacacggugaaacccuaucucuaguaaaaauacaaaaaauuagccgggcgugguggcggguaccuauagucccagcuacucgggaggcugaagcaagaaaauggcaugaaccugggaggcagaguuugcagugagcugagaucgcgccacugcacuccagccagccugggcgacagagcgagacuccgucucaaaaaaaaaaaaaaaaaaaaaaauugcuuaaguggcuuuuuaaauuguuugcuauaaucaauauauauaugucaauguugggacugauaaugaagaguacugcaacucaagacucugacacugcaaguucuauugccucccaaaauuguuauaccagauucuacuguucaaacagaaucauccaacaagaauaucagcucuuuucaugagaccuaggcaauguaauagcugcguguuugucaaguauccagaaguacuuaaucaagggcuuugcucaaauggacauccuggcaauuaccaaggguucacaguguauguguguguguguacauucacacgugugcacgcagauuuucuccuaaggcugaugcaacaagguaugcuguuaguaaaagagcaaauuuagcgugcauucaauuuacaaaaugagaucggacauuuuucacuaaaaauucucauuagagacugaaugaagaggaccuucaaugaccaaaaucuaucuaccuguaaagaaacaaaacaaucugcacucaauacauuuaacaggacaguuuuccaggucuuugauaaugaacugucccuaaaauuguuuucuucuaugugauuaagaauuauuuucauaaaugguaaaguuuuaauuauuuuuacauugucaguaacaugcuguuugcuauuacuguaaggugcccuuuuucaaauuaaggaaacaaauuuggggugaugauucacauugugaaaauagucuauauauuuucugcaaugguucuuuagaaaaaacuuguccaguacacuuaaggucuaauauuauauuuagauuuaguacuaauugcauguuauaagguauauauauuuuuuacuuuauuuauuuauuuuuuuuaaauuuaaagucucgcucugucacccaggcuggagugcaguggugugaucucagcucacuggccacguccgccucccggguucaugccauucuccugccucagccucccgaguagcugggacuacaggugcccgccaccacgcccggcuaacuuuuuuuuguauuuuuaguacagacgggguuucaccauguuagccaggauggucucgaucuccugaccuugcgaucugcccaccucagccucccuaaguccugcgauuacaggcgugacccacgaugccuggccuauaagguauauuauaaauaugaaaucuccaucaacauuugcugcuuugauaaagaaaaucagguaaagugcuguuguguucuuaaaaaacauguuauuuguaucuagaaaucaagguguuuguguguaauuguauacuucugaacauguagaaaaagauaaaagaagcugaaagauauucuugccugaacagguguuucugcuaagaaaucccugugaaaaaggaugccaucuacugcucaaauuuguugauagagaagaaucuuacuucucugagguaccaaaggaaaaaacauuuagagcaaugugcuccuuaauuuuggcagcugccuuaaauuuaauuuucuaaacacaaauuaagucuuaagcaaaauuaaauuuuauuuauauguaguucucuaucuuugccuuuaacauuuaauucaaucugaaauuucauguaagaauaaguagccagugaagacuacuuuggugccugucaaaucugcaucucugcaggcccucaaaacuccucucuguugguaaacuguaauuuuuccuuauuucacuaucuaucugcuuuuuuggaagguggcauucuaggucauuacgucauaaacacaaguugaauuuugugcuuccauuccagagggaacaauauaccucacaguuaaaaaacauuucuaaaaaauuccuaccaaaagucaucacuuaagaacuuagucuccuggugccuccauuuccucauuugaaaaagucauaaacauaauaauaugauauacaguacaugcucuuuauguauccacuuuuguuauauaauguaccauuuuauauuaagaagaggaacuggaaaauaaaaauuagaagaauguuauugccacacauuuuccuugugaagaacugccucuucaauaauacacuguggcuccccuucguccgggaguguucacucgaaggauaauauucccuagaaugcaaaccuggacaugugcgaaacaagaggcccuuuaccugcaaauguuauguaaaucauuaccauuuuguuuugccaccuauacaauggaguuguugucuuuuccaacaauuggcaguuuacaugcuuugcagcauaaaaaauauaaagaauaauuuacacagauauauuauuuuaaugacauaguaacuccuaguauuuacuuuuuaaaguaaaauuauaaugaaaauauuuaugacuacaucaaaaaaaauucaccacucaagaacauacaaaagauaacucucucucuugcacacacguuauguauguguauauauaccucccagaacgcccuugcuggcucaggggacucuuaccuucguuuucuguguuggcuggcacagagucagccccaaaagaaugccacggcuggagaucguccaggcugaacucuccauucacgggaaggagcuccacggugguuuucguuucggucaaagauggcaugagagcaucguuuccguaacugauccuugguucacuaaucauguuggccaagacgucaucugaauaguuuugcucuuucugaagcagcucaucuaaaccaaacaaaaccaucucuuuggugaguaacaacaaucacaacagcagcagcagcagcagccaccauuuacuucugccaggcaagacuucaacugcuuucacgugcaugaucgcguuuagagccaugacauagguaccauuaucaucucccuuuuacagaugugaaaacugaggcacauggcauucaagcuacuuaugcaaagucgcagcucacaagagcugcuggcaggacugcaggcaggagcauggcagccggccaaugugcugcagcguggcacugcuagaggugaaaggccacaggggcucagcugccauuuccuccugacacaguuagacgucccuaguauacaaugaucgcacaggaauaaacgccaggcuuugguguggcggcaguaagugaggcacaaucucauucaagcugaaagacaacagacaaucuccugucuugccuugcacacuugcaaggauaagaaaagcauuaaagggccaguaguuugcuaccuucuugaauaguuuucacugucuugccuugaaaaaaaaucugcauuuccuaaaugcuccucuugugcugcaugaccuaugcucugaggcaacaaggaaacuguucccuugcccuuccagauguagcccugcagacagacauccagccuucucuggacuuaaccaccccuggcuccccguauuucccaaugugagcagacaccaaauauccugccuuucuccucuguugcuucccuuuccaaagaaugcugucagugccgccuacccccccacuuuaaaaauugauuaaacaagaaucagcuuuauggaacaucauugacuuaucuuuucuuacuggaaaaagagagcuuagaauauaaucuuguaucauguguaauuacugcuuuaaaaacugaccccaggauaugaagauuugugagucuucucuuaugucaccaaagauucaccauguuuuucucugauuuuuacaaauuagagaccgacagacagcacugcacuauuaacaauaauauuugauuaaccaaaaugucucauuuuccaaucauagcugugucaagaguuugcuguaguauauauuucagacacaucacugguuaguuuuauugcuagagaaaaugaaaauaagaucaggauuuaaauuugauuuguaacauuuuacaaucaucuuucaaauucucuuuucuauugacaaaaaauguaucugaaaaauuaaaauucuguucaaauauacccauuaaaauaauuugauggaauagcauuaaagcuugugauuaauaucuuuucauguagucaguuuuauugcaagugauuuuaaaugauggaagucccaagcaaauuaguccuuuugaagucuaaucugaguuauaauauaucccuauucacuguggcaccguuucuaaaauucaauacuugaugcccaugaugaccuuucccuuacagauaaaagacccucauuagauuuccuccaacuuuuucauguuuuacaaagccauagguagcggcuaauaacuuagccaaugucugauuaaauaaauuaaaugagcauuucuuuuauauaaaucuuuugcuugugacuguuaagcacuuacuaugcuaaagagaggauauucuggaauacuaauaauuauuggugcauacacauucaucuugacaggaaauaaccuuugccagcgagaaagcucuugaacuccccaggggcuacgcuguucuugggucugugguaucuacuaucacuuaccauguccuuuauuuggaaauguucucacuguuucgcauacacaguacuuaucuucuucccugugacaucucugaauaacucuuuuuacucuuuuuuucuccucucuucaucccugucauuuucuucuuguaucucuuuccaucucuuucuacaauucuccccuuuggaaaucccaucgacucuugaaacucuaaagaucuccuaccuuugggugaaucugaaauguacuuccccagcuuugacuucucccucccacucaaauuuguauauuuccaacaguuugcuggagauaccaacuuagggcucccuccugauccaugcacuugguagguacacaacuguacucaaggucccuggcuuucccuuccaccuuuccuguuuucuaaucauggcagaaccauucucccucccagucacaggcuugaauccuucagagccauccaggacucccuguauuucuucguguccaguacucacacuaccgacaaauccuuuugcauucuauuucugaauucucucagccauuuccugcuugcuuuuccacaccacccucaccgccccuaggaauaugauuacuuuucgccuggauaauuacgauagucuccucacugcuugcuauggucugaaugucccccaaagucauguguugaaacuuaaaucuccacugugguaguagugagagauggggucuucuggaaaucaagucaugacaguuccaccccgugcccccgaauggacuacugccuucuaaaagggcuagaggaaaccagcacaggccccuuuaugugcaucugccaugugagaacaguuuuugcugccucuggaggaugcagccacaaggcgccuuuuuuuuuuuuuuuuuuuuuugagacggagucuugcucugucgcccaggcuggagugcaguggcgcaaucucggcucacugcaagcuccgccucccggguugacgccauucuccugccucagccucccgaguagcugggacuacaggcgcccgccaccacgcccggcuaauuuuuuguaguuuuaguagagacgggguuucaccguguuagccaggauggucuccaucuccugacuucgugauccgcccgccucggcuucccaaagugcugggauuacaggcgugagccacugcacccggcuugauccugggcuucucagccuccagaauuguaguauuucuauuguuuguuuauaaauuacccagucucugguaucaugauaacagcacaaaccgacugagacaauggucucccugcugguuuuuauuuuacguuugguuccugaaaucuuaguuccugacacacaagaauggcucccucuuuguuucagugggucuucauuuucuaccgaauuaauuccaacuccuuugccagaugcugaaggcccucuguggucugggcccaccccguauuucuagccauggaacucacagcuccagcugucuacaccacaccucucucucaggcuaaauagcuugggguauucccacaaaagaccaugcauacccauucugacacuuuuguuuucuauuccugcuaucuuggaagcccaucucugcucaucuacguuauuugaacucuuuagagcccagcucaaaugcccucuccuguaugacucuccucucccaaggcaggcauuauuaaucugaugggacaaggagacugaggcugggagaaaggaaccaaucucuucaagacccaauggccaguaagcaccagugcugaaauccaaguccugggcuucauaacaccagccuucccauguucagccccuaucuauuucagccucucguauuaucacaaaaguagcuguagaaauuaggcauuauuaagcaugucuguuccaauaucuuuagcagucucuuccacccuuguggauuuguaagcugacuuaaucaccguuaguccuauggaaugguuauugcuuuuggucaucaaauaagcauuucucaggcaggggcagcuggaaagggcccugugcccaucuuagcccuuggcaguaaaaaggcagaggagcaaaagaucacagugagaaaucuuacacuuguacuucacagaacagucaggggagguugagguacgcuguaguacccuuuucucuuuucucuguuacacuguugguagaaaaguuccuccaaauggccaccagcaugcugagccccauggugguuaauuauauucauuuucagaaaauguaagugaaaaagugacagauucaagaaaagguacauuuuuagcagagugaaacacacuuagccuucguuuuuuuuuuuuggucguuguucaaaauaggaagaaauccacauuccuaucuuaauucaacacagaaaauuuagaaauaaccaccccuggcuaugucauucagaacaacgaaccucugccuccuggguucaagcgauucuccugccucagucccgaguacugugauuacaggcacacacuaccaugaccggauaguuuuuauguuuuuaguagagacagaguuucuccauguuggccaggcuggucucaaacuccugaccucaggcgaucugccugccuuggccucccaaagugcugggaugaggcgggagccacugcgccuggccgucaguguaguuuuaagagaaaaaaagagguagacaugauggauuaccauuaucagaaguggaauucaauuucgucaucauaaaaugucuaaggcagccagcuaccuguagacaugacuaagggcucaggauuuuaccaguggcuuacacacuggcacugggcaauugagccuaugacaaaauacccagagacaaauaugauucuuucauuguucauucugagugggacuuucuuugacuuccauggugagacuaaucacaccgaaaccacacuuccacuacauuaguggcccugauggauuauccuuuuaucugaauuaauuuaauacuuaauuacaacacucugauggccugcaauggggauuuucagaacuuuuaagcaucuauauuugccaaccgcuauauuaaacuaagagacugcuuauuuuccucccaagacuuauuuuuuccccuucuaaaagcuauuuguuaugacccaaaauuguagcguuuaucuuugaagucaaauaucuucuauaauauccaagcauuugaaccuuguaguuaacaguggaaauauuuaacugaguuuaguggugauaauauuuaaaauauggcuucaucaauaacagagguauuuaauuucaaauaccaaacaccuaaugaaccccaucaccuugcucuuuuacaaaugcuucgagguggccaggcgugguggcucacgucuguaaucuagcacuuugggaggccgagguggguggaucacgaggucaggaguucaagagcagccuggcuaacuuggugaaaccccgucucuacuaaaaauacaaaaauuagccgugcaugguggcggacgccuguaaucccaccuacuugggaggcuaaggcgggagaauugcuuaaaccugggagacagagguugcagugagcugagaucaugccacugcacuccagccuaggcaaccgaguaagacucugucuccaaaaaaaaaaaaaaaaaaaaugcuuugaggauguauacgaggcauacuuagaguaacagagggaagaagcccuaccacuuaguuaucauuguaaacacuuuaaagaaaacaacaucaaaagauaauaauuucaucuucaaacagcuaaauauuuuguuuuuucuuagauauucaugaucauucauuuugagaaaaauagccuuauaaauaaaagaacugcugaauaggaagcagaugaauucauccaauauucuuuuaauuauuaauccacuagccaaaugucuucuaagaauuuaacggucacaucuuacgauuaaagaaaauaaaauuuaugggcauuaaaucaaucaguuauguguuacaagugucaguuauaauuacugaacagcuucuuccauccacugaacacaaguggguuggagaagaacauuuucuucauauaaaggaggugccacucagccuuuucccuguaaagucuggcuguuaaagcucugaucugaaucuauccaucugacaaaggucuaauauccagaaucuacaaggaacuuaaacaaauuuaccagaaaaaaaagaaaaacaaccccaucaaaaagugggcaaaggauaugaacagacacuucucaaaacaagacauguauguggccaacaaacauaugaaaaaaaaaaaaaaagcucaucaucacuggucauuagagaaaugcaaaucaaaaccacaaugagauaccaucucacaccaguugggauggugaucauuaaaaagucuggcaacaacagaugcuggcgaggaugcggagaaauaggcacgcuuuuacacuguuggugagaguguuaguucaaccguuguggaagacagugaggagauucugcaaggauauagaacuagaaauaccauuugacccagcaaucccauuacugggaauauacccaaaggauuauaaaucauucuacuguaaagacacaugcacacauauguuuacuguagcacuauuuacaauagcaaagacuuggaaccaaccaaaauguccaucaacgauagacuggauaaagaaaauguggcacauauacaccauggaauacuaugcagccauaaaaaaggaugaguucgggaggugggagccaagauggccgaauaggaacagcuccggucuacagcucccagcgugagcgacgcagaagacgggugauuuccgcauuuccaucugagauaccggguucaucucacuagggagugccagacagugggcgcaggccagugggugcgugcaccgugcgcgagccgaagcagggcgaggcauugccucaccugggaagcgcaaggggucagggaguucccuuucugagucaaagaaaggggugacagacgcaccuggaaaaucgggucacucccacccgaauauugcgcuuuucagaccggcuuaagaaacggcgcaccacgagacuauaucccacaccuggcucggaggguccuacgcccacggaaucgcgcugauugcuagcacagcagucugagaucaaacugcaaggcggcagcgaggcugggggaggggagcccgccauugcccaggcuugcuuagguaaacaaagcagccgggaagcucgaacuggguggagcccaccacagcucaaggaggccugcuugccucuguaggcuccaccucugggggcagggcacagacaaacaaaaagacagcaguaaccucugcagacuuaaaugucccugucugacagcuuugaagagagcagugguucucccagcacgcagcuggagaucugagaacggcagacugccuccucaaguggucccugaccccugacccccgagcagccuaacugggaggcacccccagcaggggcacacugacaccucacacugcaggguauuccaacagaccugcagcugaggguccugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacgcagagugccucuccuccuccaaagaacgcaguuccucaccagcaacggaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagaaaaacgaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacguaauugucagauucaccaaaguugaaaugaaggaaaaaauguuaagggcagccagagagaaaggucggguuacccucaaagggaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaaacaugcaaaggaacaaccgguaccagccgcugcaaaaucaugccaaaauguaaagaccaucaagacuaggaagaaacugcaucaacuaaugagcaaaaucaccagcuaacaucauaaugacaggaucaaauucacacauaacaguauuaacuuuaaauguaaauggacuaaauucugcaauuaaaagacacagacuggcaaguuggauaaagagucaagacccaucagugugcuguauucaggaaacccaucucaugugcagagacacacacaggcucaaaauaaaaggauggaggaagaucuaccaagcaaauggaaaacaaaaaaaggcagggguugcaauccuagucucugauaaaacagacguuaaaccaacaaagaucaaaagagacaaagaaggccauuacauaaugguaaagggaucaauucaacaagaggagcuaacuauccuaaacauauaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauaguuggaaguaaaacucuccucagcaaauguaaaagaacagaaauuauaacaaacuaucucuccgaccacagugcaaucaaacuagaacucaggauuaauaaucucacucaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaaucaaugaauccaggagcugguuuuuugaaaggaucaacaaaauugauagaccgcuagcaagacuaauaaagaaaaagaggagaaucaaauagacacgauaaaaaaugauaaaggggauaucaccaccgaucccacagaaauacaaacuaccaucagagaauacuacaaaaaccucuacacaaauaaacuagaaaaucuagaagaaauggauacauuccucgacacauacacucucccaagacuaaaccaggaagaaguugaaucucugaauagaccaauaacaggagcugaaauuguggcaauaaucaauaguuuaccaaccaaaaagaguccaggaccagaugguucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcuugguucaauauacgcaaaucaauaaagguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaagguauucaauuaggaaaagaggaagucaaauugucccuguuugcagacgacaugauuguuuaucuagaaaaccccauugucucagcccaaaaucuccuuaagcugauacgcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuuaaaggagaacuacaaaccaacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacgaagcuggaggcaucacacuaccugacuucaaacuauacuacaaggcuacaguaaccgaaacagcaugguacugguaccaaaacagagauauagaucaauggaacagaacagagcccucagaaauaacgccgcauaccuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucacguccaaaacaccaaaagcaauggcaacaaaagccaaaauggacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcaaaggacaugaacagacacuucucaaaagaagacauuuaugcagccaaaaaacacaugaaaaaaugcucaccaucacuggccaucagagaaaugcaaaucaaaaccacuaugagauaucaucucacaccaguuagaauggcgaucauuaaaaagucaggaaacaacaggugcuggagaggauguggagaaauaggaacacuuuuacacuguuggugggacuguaaacuaguucaaccauuguggaagucagugucgcaauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaacuggaaaccaucauucucaguaaacuaucgcaagaacaaaaaaccaaacaccgcauauucucacucauaggugggaauugaacaauggagaucacauggacacaggaaggggaauaucacacucuggggacuguggugggguggggggaggggggagggauagcauugggagauauaccuaaugcuagaugacgaguuagugggugcagcgccagcauggcacauguauacauauguaacuaagcugcacaaugucacauguacccuaaaacuuaaaguauaauaaaaaaaaaaaaagauuugaauuugcaaauacaaaaaaaaaaaaaaaaggaaaaaaaaaaagguugaguucauguccuuugcagggccauggaugaagcuggaggccaucauccucagcaaacuaacauaggaccagaaacccaaacacucauguucucacucauaagugggagcugaacaaugagaacacauggacacagggagggggacaucauacaccagggccuguccagggguggggugaaaggggagggagagcauuaggacaaauaccuaaugcaugcggaguuaaaaccuagaugacggguugaugggugcagcaaaccaccaaggcacauguauaccuauguaacaaaccugcaugcucagcacauguaucccagaacuuaaaguaaacaaagaaaaaaaaaaaaagcucugauuuggacaccagugagaauaugaagucccucggcuugcuggauuuucuucugucuaggaucgaaccuccacugcuauuacuauuuucuuuccuuuuugauucuuuuggaucccauggaaaaauauuuaucugcaacuucuccacaaaauggaaauuuguuuuuaaucuuaucuaacaggagauucgcauaugaccaauucuuaucuuuuaaauaaaaauuuacuuaugugccugccugaaaggacugaagaucauaccucuacgcucucuuccauguccuuucuucucucuccccugacacagcugcauuggaaguagcuguaaaugggauggacuaauuuucccuacccaggaggcccacuguaaaucaagcggucacccacuuccagcuaggcauuuugccacaccagggcuaugagaaacagauuuaauuuuccaaucagcaguucugugcaugucugauucuuggcucaacauacaacugcuaugcuguuuauuauacuucaucucuccauggccucugaaacuccccaaggcucggguucgucauccgcaaaaucgugggaggcugguuccaugguucuugcagucccuucgcuuugaauccuuuugucuguacucuugcuacauggguguucucugggaguuuguuagacaugcagaaccucaggucccacccagauccagggaaucagaaucugcauguuaaugugauccccaggugacucucaugcauguuaccaucugagaagaccuacccuccaccacacugaccacagccacgagcuguaccaagacaccaccacacaacagccucgguuaucccuucaugaaagaaaaacaaacauaauggcugggcgugguggcucacgccuguaaccccagcacuuugggaggccgaggugggugguucacuugaggucaggaguucaagaccagccuggccaacauggugaaacccgucucuacuaaaaaaauacaaaaauuagccaggcacgguggugugugccuguaauccccauuauucaggaggcugaggcaggagaauugcuugaacccgggagguggaggcugcagugagccgagauugugccaacugcacgccauccugggcaacagagcaaggcucugucucacaagccaaaaccaaaaacaaacaacaaacaaaaaaacaauucucaaaaacaaagcaaacaaagcaaggcaugagaugagugugagccaagaaacaauacugccaggggaauauugccaaaacaccagagucaugccuugaaguuucuuaucaucagggucacauuucugaaccagaaagccacaggaaaggaaagacuggucacagacuuccuucuucccuggaccauuuguuacgggaaguucucaggaaacaggucaguaaguguagagggcaucacaggacaaacuucauugcuggguuucccagaaaagagcagcucuccccuacugaagacacuuuuagcagacgggccuucacuagugaguaaauauacuaaagaagcauggacuuacuuguaggucgguggagcagcugauuugggagagaacccaugagaucuuuaaggacgguagggauguucugauuagcauauaugcuacagccaucugcgaugccaaagccauacugugaugggacuaugccaguuaugacaccuucauaaccaugagaacugcacucauggccuuuucauacccaucugcugauuugauaaccacaauaaucuuccuuagugggaucacuacucccacugacaguugaacaaacugacauccauccugagaaguauacuuaaaacuagcaaguggcagaacugaaaucugaacccaaguaucccaauuccuaaugcaaccuucucacuguuccaugaaaaguuccauuuuauagaggacauggcuauauuacuuggauuagaaacuaauauuaaagaagcauaucacgccuguaaucccagcacuuuggaaucaugaggucaggagaucgagagcauccuggcuaacauggugaaaccccaucuuuacugaaaauacaaaaaaaauuagccagauguggugguggcacuguagucccagcuacucgggaggcugaggcaggagaauggugugaaccccggaggcggagcuugcagugagccgagaucgcgccacugcacuccagucugggcaacagagugagacuccgucucaaaaaaaaaaaaaaaaaaaaaaaaaaggaagcauaaacccaucuaucaucacaagcacccucuuuuucauacauuucaaauuuuugauagguuugaaaaagaaugaauucgacgguaucuuuuagaagccaggauaaaagagauuaaagcaguaguccaaggucacggagauuccugaugguggagcagggcugaaaagcucccucuucuagcuaagugaggccugccugucacuuugcuuggacagcccauucucaauagcacuuuccucccagaacacucucccaagucuuuagguuucccuuucucaggaugaauacgauggcuacgugaauggccagaaguuucaccaacucuaagucaaauuguaguguagcgaccuaggcacuucaauggucaagagagauacagcccuguaugacgcggccacauuuuccaacuuggggaagaauuuauacacauauuaucacaaaguaaaugcuguaccauaaauccaguuuuuaucuugaccuccagaaaauuaggucaguuauuuuuagcuacacuaucaaucuugaaaaucucccagaguuaaaacucagacuacaugucuaaaucgggguuuauuuuuguuuaaaaauaacaguuuccuggccacacauguuuaaaugaagcaugcuuuguccccuuaugguaacaaacugcccuggaagggacacaaacaaagcuucacaucauuugugaaaauauuccuuauugcuagggacauuuuccugaaauaucacuugucuggcuuagacugaggguacagaagaagucccuuuuccuuuaaaacacauuuccuuuuggcuuucaaacaucauagaucaaagaacuuagaccuaccaguggcaucagucaguaaucaagauaaagaccagccaggcucccuggcaucuaaaagcagauuguagggcuccuuuuucccguuuaccuguagaacuugugccaaugugcugaucugauuuccaacuacauuagggagucuugguccugccuggguugucaggaacuuaaaguagagacuaaaaaacaacuuuauggccaggcgcgguggcucacgccuguaaucccagcauuuugggaggcugaggugggcgguucacgaggucaggagaucgacaccauccuggcuaacgaggugaaaucgcgucucuacuaaaaauacaaaaauuagccgggcauggugcaggcgccuguagucccagcuacucaggaggcugaggcaggagaauggugugaaccugggaggcggagcuugcagcgagccaagauugugccacugcacuccagccugggcgacagagcgagacuccaucucaaaacaaacaaacaaacaaacaaacaaacaaaaaaaccaaguuuauauacuacagaaauaaucucugaaagaugcuguauuaagauuacaacacacacacacaaacacacacacacauaucuucuuguuuugaggaaacguacagugaaguauuuagguguaaagggccauuaugucugcaacuuccuuuaaaaauuuuuaaauauauuuuuagaacuuuucuaagucuccaauuauacuaaaacaaaaaguuuaguacuguaggcauugucagcuuuaauuuauacauauuuggaugucuuccucugguucgauuuauagugaaauuacaucauaugcccauuaaugugauacaaacugcaugucuucuacaaacaaaaauaaaaauagaagugaauguaauuuugaugccuuuuuuuuuuuuuuaacuggagacagagucuugcucugucaccagguuggacugcagaggcguaaucucggcucauggcaaccucggccuccugaguagcugggauuacaggcgcgcaucacuacgcccggcuaguuuuuguauuuuuaguagagacaggguuucaccauguuggccgggauggucucgaucuucuaaccuugugauccacccgccucggccucccaaagugcugggauuacaggcaugagccacugcacccggccugaucccucauaucuuuuaaacauaagucaauuauuucauauggucuuuaagccaagaaacagcuaucucuucacucuucacaugcuggaggaaaaacuggcugccuggcugguugagagauguguacuuugauggcugaccugaagacauuucaaggugauuguuacgugaaauucucucuucaaaucugacuugaagagucuaaccucugcagcauauguuaugacuucacugugagucuucuuuuauuaauaaaauauaauguuuuuacuaauuauaagaguaacauaaauuucaugccaaaaauguagaaaaaaggaaugagaauucauuuacaauucuaacagcagaaauaaucaagaguagugguuuuuuuuuaaugguuuuauucuuacagcauuauuuucgucucuuuaucacuuuacuaugcaauuuuuaugacuaugcuuaaggagaguaaauuuuucgaaguuauugaggcaauggagagucuuuggaaugaggauaauuaggccugaggacacagaggaaucaugaggaagaauucuccaguuucauuccuuuuucuggguacaguuuguuucuccuucuaaguaaguuccuagauauagaaugaauuggaaaaaaugaaacgugagguuugcuacgucuauaacaguaucacauuucauuuuuuaaaacugccaaugcuuucagugaggaccagaaaguacagugagaaaaaaaaauuccucaaauauuaguuuucaugcucuugcacgcauuuuuauaaaggcaaaagucauucuggugccuguauacaaucuaaaggcauaaucuccuggagccuucagugcugguuuugggguuuucuggagaucaauccacagugucccauuuuuucugcuggagcucugaacccacuaagagagagcaagaagagauguaaaccucuccuuugcuucugauaaagccaagcccuuacuaguccacaugaugcuuucucuggggagugagucacauacaggagacauggcuuguccagcugcgugcuggacugaauuucagcuccaaccugaaccuuccaacaggacaagggagggaggagaaugggccguagcaagacuugcccacagcauugccauaacagcugugcaggcuguggguacaacucuaagagcagcacucauuuuguaguuucagugagucgugucccuaaagccguguccugugugaccagccccgucucucaagcucaugagagaagucuaucugaccgggauaagaaggauccuggggcgggcccaagcaaaugaaugaauugggaaacagugccgcucccggcagccagcaaaaacuccgccaugcugugaagaaagugcauucuaauugauucauguugauacaugcugaauugauggaauuuuauacuucaaaggaugcaaagaauugguuagcaagucugaugagcucaugguagaaaggaugauuuucaacauccauacauagugaauuucauucaaagagccuaaaaagacuuaugcagauaauuauaaggggaucaggcaaguguguaauagcacaaauuauauauauauauauauguaaaaucacaacacaggauuggguccuuuucccacagacagcacaucauccuuguauauaugauagcucauuugaaauguuuauuuaugcagauuuuaaaaagcacacaaacccuguaagcacuucugcacaguggccuacucguguuuucuuuaacacaaaacuugcuuucuggugaacaauucuagauauagcaaugguucuuucuccucugcuuuagcuuauucacaagcuucuuuaacuucuuuaacaacguguggggaaaccaagccuggcaacagaaagcacuucacauggggggcuuggaaaugaauggaaagcgucugucuucaggagagcauucacgaugcacaggagugagagaagcugaaaagagucacuuuaaaagaaauaaucugcaaccaagaaaaucaaaccacuuuaucauaaacuagugagccccucccucccugccugccuuccuuuuuccaggggagugcuagaaauaacuucaucaauuucuuuucacuugaagggcucaugguucagaagaaaagaugggcauaaaaauaauuacuauuacaaguguuaugguagggauaccgacagaaugacaaagaaacaagccugggcuuuagggaugugacuagugauauuacaguggggccccagggaaagagaucauuguccuagcagauacaagugcauguaccgaggcacagaggacaagcugcccaggaucugugacucuucuggcugcugugguacaagggaagugaaaagggaagcagcuuagccaagaggcuuucaguuugugggauacagagggcagaggaauacacugaccuauaccaugaguaugcaauuagcaaaaucccagccuaugggaauucuacgggucaagugaccugcgcuucaugaacagguaaacuguaaaaaaaggauggaggagaagccuggagauuauaaaagacuaaccagacaaagucagcaguaaaaaauggccaaaagcauagccgauaaggaugcacacaagagugauacagccagaaagauauuucaggaacuggcccaaggaaaaacagugggcauuuugguggcgguauuugggauagggcgagaugcuaucgggguggaggauaaacuucuaauucuugaccugaguuuaaucuacgaaaagagaaaauaugggggagaaagguucuguuuacacauguugaguugcaaucuuucagaauauuggguggagccaauggaaacauggacccagagagcucacuucuaugcugaaacagcccacagggaagcaucagaaugaaaauggaaacguucccaauacuagcagaacuccacaggcgcuuugaaaaaaacauccacauuagauuccccaaaagggauuuaucugguaauaaauucugcuagacaaugaacaguuccacccaugauaaaauaacauguuguugcugcaaauucuuuguauugucuaauugcagugcuuaacguaauaaaaucaggcugguguuauuguuaagaacuagagagugaagcauuuuuuauccaaauaaagugcaauggguuuuaaaucaaaucauuuuagaauaagaauccuaugagauaauaauaaaaugcaacuucaucuuuuccugccgagaacaaagaagaaaauaguguaggagaugaaaaguaaaguagacccaaccuuuuugcuaauuuguuuuuagauacguacuccaugcagacaauggugaagugaagugaagugaaggggugucaucuuauucaccuagagaaccacaaaucuuggugcuggaaaguacgauccauucgacaugauggacuauuucccacccggccacucacucgagaauggauaaccuguuuucccgccugggguaacugcuuuccauggauguacagcuucaggccucauacgagaggaucucacaacaaucucuucaaacuuuuucuaauccccacacuuuccagucuuggcacaagaccucauccaggcuucugagucuuuguugaaaauuuacacaaaauucuagaaauguauuuucuuuaagauaguuacuuuaaaaauguuauuuucaucucagcacaguuagccuuuccuuaucuguucuuaaaauguuucaacuugaaacuaaaaaagaaaaaaaaaaacacauuucaucucaaauuaugauauacuaaauaauuauugacuuggccccaaacauuucuacucuuuucuucuuacacaaucagauuuaaaaauguaacuaccuuuucuaaacauacaauauuaaagcauacucaacuucaguaacagguaaugaauguaccucaaaagucagagccucuacguuaaguaccauagugcuccaacaucguuuuuuacauuuuuaaaauuuuauuuuuuauugauacauaauagaugugcauauuuucagauuauaugagaaaacuuaauauauucauauaauuuggaaagaucaaaucaguauaaugggauauccaucacuuaaauguuuuucuuuucuuuuugcuuugaggaagggucucucucugucacucaggcuggagugcagugaugugaucauagcucacuugaaccuugaacugcugggcucaagugaucuucucaccucagccuccagagcagcugggucuacaggcaugcaccaucacaccuggcuaauuuuuaaauauuuguuuuguagagauggggucucacuaugaugcccuggcuagucuugaauugcuggggucaagugauuuucccaccucggccuucccaagugcugggacuauagguguaagccaucgugcccagccugucuucuuuacgcuagaaacuuucaaauuagguucuccuagcuauuuuuaaauauacaguagauuacuguaaauuagucaccuugcugauaauuaaauacuaggucuugcuucuucuaucaaacuguguauuuguauccauuaaugaaccucccuuuguaaguaugauguaagcaauccuuacuuggcuacacuauaagcuucaacaacaaauuaaaaaaugauucacauuauagagcauuuauacaugccuuuucaucuuccaagugugguaaacauuaauuaacccuggcuaauuaaaacagccacaguugacacauuuacucauuaaucagccucaagcaaaugcaaagcauuaaacucuuucacguuuugguaccaauuaaauguuauuauuuuuuuuuuaaugaagaggucauaaauuuaagacauguaguucuuagauuuaaauuugauagugguugaaaaaauuugacaauaguucacauucuuaaaagucaaggaaaauaaaaacauaaccgcauuauggguugaauuuucccccaaaauauauguugaaguccuaaugccuacaccuaagaauacagccuuacuuggaaacagggucuuugcagauauaagauugaggucacaauggagaagggugggcccuuaaucauauuagagaagacacagaaacagagacauggggaguaacaccaugugaagacagagguggagauuggaggggugcauguaccaaccaaaggaauaucaagggcuggcagcagcacuagagcaagcgaaaggcaugaaacagauucuccccuagagcuguaagaggcaguguggcccuggcaacaccuugcuuuaggacuucuaaccucuagaauaaugagauaaugagaguauauuucuguugguuucggccaugcgguuugugguaacugguuccagcagcccuaggaaucuaauacacugcccauguaagugaauauuagcuauuugcugauaagacaagaauuucugguuauaauaaauauacuggaauagaaugugguuucuuuuuuuuugagauggagucucgcuccagucaccaggcuggaaugcaguagcgugaucucggcucacuguaaccucuuccucccagguucaagcaauucuccugccucagccucccgaguagcugagacuacaggcgcccgcaaccauccccgacuaauuuuuguauuuuuaguugagacgggguuucaccauauuggccaggcuggucuugaacuccugaccuugugauccaucugccucggucucccaaaguguugggauuacaggcgugagccacaacacccggccgaaugugguuucuuagugaguccuuuacucaaggcuggaauuaaacaaaggagaugaaucacgagcucuaugauaauagucuaauagucuaaucuagcccucuuaagugcagagauguuuucccucugaacacccguguguuucagcucuguuccucuuccaaugcccuuccacagggaacaaauccuuucuugaccaccaauggcugcaugacuuauccugagaagaucauggggauuuuggaugccaggucaacccuuacacucagcaaggaaguggaagggccucaguuucaaacacuuuguaaacacagagguuaggucauuuccucuccaauaagccagaagcugagcugucccuggcagcaaacugugugucaaaugccuggcggguuucagguuuuacuaacuccagagugacgaaacaucaccaccucuaaugccagaaagaagucagcuguuguaccugugucacaacuaaauuuacugaagucagggcagcugaaguaaucuauaaaacuuagcaugucaauuucaauuuagcguucacauucaacaaauuguguauuuaaaaaaaaaucuccaguagucuaaaaguuuucauuuuauucuuguguaaaaucuggaagacuggaauagaauguuuuaugguaugaguguuuaguagcaacauuagguuaacugugaccuuuuggcucaagacaugagaaaauauagcuaacaaugcuugguuauggguuugucacacuauacuuuguuauacuauccagcaguauccaccugcuuuaacaguguggauacacuaaaaacuaauuuaaaaaaaucugggcugggcgcgguggcucacaccuguaaucccaacacuuugcgaggccgaggcgaguggauuacaaggucaggaauucgagaccagcccgaucaacauacugaaaccccgucucuacuaaaaauacaaaaauuagcugggugugguggugcgcgccuauaaucccagcuacucaggaggcugaggcaggagaaucauuugaaaccgggaggcggaggcuguagugagccgagaucgugccacugcauuccagccugggcaacagagugagacucugucucaaaaaaaaaaaaaaaaaaaaaaccugucaaaucccuccauacaaguguaugcacuucacauaccaaggaggucuaggauuugaaguucaucaaggccgaguuuaggcugccagaccacaaccucguuuuaaugccuuaggugcagaaacaggagaaauaauaccuuccaugccuccccugacuagcuuuaggauaaagaagcugugcacuaaauagacaguagcugaggaacgaugaagaggaucuacccaaaguaugaauaagccaacugcuauggaucgaacugugugccccugaaaauucauguaucaaagcccuaacccucaagggaccuuuggagaucagaccuuuaaagagauaauuaagguuaaaugaggucaugggggugugacucugauccaauaggacagguguccuuauaagaaaaggaggaggccgggugcggggcucacgccuguaaucccagaacuuugggagggcaaggcagguggaucaccugaggucgagaguucgagaccagccugaccaacauggagaaacccugucucuacuaaaaauacaaaauuagccaggcaugccuguaaucucagcuacucgggaggcugaggcacgagaaucgcuugaacccaggagguggagguugcagugagccaagaucgugccauugcacuccagccugggcaacaagagcgaaacucugucucaacaaaacaaaagaagaagaggaagagacaccucucuuucucucugagaaagaccaugugaggacaugaugcguagguggccauuuguaaaucaaggaagagaggccuccucagaaaccgaccugcugguaccuugaucuuggacuuccagccuccagaagcaugagaaaaauaauuucuguuguugaaggauucagucugugguauuuugguauuuuguuauggcagcccuagcagacuaaugcauuuaucuagucacacucagacaaaagaaagagcacaggucagaauagcuuuuucuagaggauucuguuuucuuucuuucuucggcuucuuuuucuuuuuuuccugaaggcaauagcugaaucugagaguaacaaggggcucaccagggaugugcaaggaauuucuuguacugccccuuucauggaaaugacaaggaagugauuuauuucagaugugacucaguucaggauuugaaagcacaugugacaaauggucaaguaaagaaaaagcuuuucuuuuucuuuacuugaccauuugccacgcaaguucccaaguucuuccucccuaucuugcuucauuacaggcagugggaaaaauccaaacagcuucccccugugucugggacaucuccagcucugugguguauuuacuuugaaggaacaaaaaaggggauaguauaugacuuccaucccaagucacuauaggauauacuuuaagaaacaagggaguuuaaauugcucugcuguauaaccugcaaaauucaucuccuacugcagaauagagugaguugcuucucaggauucgcaccuggaguugguauucagcacauguuuucuuuguaacauuucugucaauucucuaaaaagaccacacuuuuugagcuggcacuaggcucucugacaaucuuccaagacgaagcuuuuacaguccaucauuuacaaugcugacaacuccaggcacauuuugucaauuuucccuuucaucucuuauuaaaauaaaauaauaucacuuuggauuugaagagagccuaaauggauaauucuuuaagcagaaugucaguaucaaugauagaaagggaagaaucuaagagggagguaaauguucuauaaguagagaaguagguucacaauuucugaaacagcaaaucaaacagcaaaugggggaaaguuaugaaaggcagaauuuugugacucaagcccaucuuaugcuuauacaguuuuuuguuuuuguuuguuuugagauaaggucgucccucugucacccagccuggaguguaguggugccgccaggccucacugcaaccuccaacuccugggcucaagugauccuccaaccacagccuccugacuagcugggauuacagguguguaccccuaaacccagcuuauuauuuuuuugacuuuuuguagaaacagggucuccccauguugcccaggcuggucuuaaacuccugggcucaaaugauccuccugccucagccucccauagggcuaggauuacaggugugagccaccaugccuggccuuuuauacuguuuauucccuuuagauacaguuaauggacauuaauaagcaguuuaugccaaucccuuuucauagcuaauaagaagucuuaucuuggauaaauaaaaccuagccacuaaugcugccacacccaaauaaacucucuaugcaucugaacuucuugagguuaauaaugcuucauuguaauauuuuauaaaaucaccacuuuggaagugaacaccacuagaaauucacauggccaguuuauagauggggacugggggaagcagggaggaucucugcaauccaguaguuaggcucugccagaauguauuuagaguugucucuaaauacauucugagucucugcuucauuuuuuuuuucaaugaaaaugacaaugucugucaucccauguucaagacaaauauaacaaguuucuaagaauccuuauauuuuuguuauugcauauaagcaugaguuuuaaaaaccucugaauguuuaaaggaucaccugggggaauaagaaaaaugcagaucucuguaggucugagguagagcccaagaaucuguauuuuuaacuagaauuccucuaaauuacugugcuucacuuggccccaauuacacauuaggagacaaugauuucaggaugacaaucagccuuuuccauccaaggacuuaaagcagcuaaaccgaagacaccgacaaauaccagauacuuuucucagucuacuggcugauggcacaaaagugcagaagucacguagggcaguauggaaagcucgagcuaggacuggagucagcgagagacgcuagcuuccccuguucguggauuccgaagccucaagcccacauuaacaaggccuuagacgacaguaaacacccagacucaggcuccuacagagggcccccaguucugcucuaauauaccuauuuuucuuuaaauaaaaaacaucugauuuuugcaccccagguauuuaaagacacacuuugauuucugaaaggcuuuugaccacacaugaggaacuccuugggccuugaccauuuuuagcacuuucacaguuucugauuuugaucaagccacuuaaucacccaggauucugaaucugaaaaccaggaggguuuaauuccacuuucauguucccuugaggagcuguuggcagcaggaugaaggcagguccauacagaacaugggaaggaagccaggaagccagcuuuuccuuucacaucaaagagaucuagaaagcaaaaccugucucacauuugcauacaauauuagacuuacauauggaugccaugucugucaaaagacaggcuaauuagggcauuaguuucuuuaaugguugcgauuuaguaauucacaaauagucccacuuaauuuuucauccuauaccuaaaggaucuacuucacacuugaaguuuaagaaggcuucucccuuaagauagaaagaaggcauucaaguaucaaaauacugguuuccugccaaaaaauaagggaugagaaaaagcagacacuuagcuuaucaaucaaaaugcuggcagggaaagacuacuggauuaccaaguucauuccccuagccugcacugauuccucuuuuucucuaaaguuucuuauuuuuucaguuuuucucaugauacugacauugccaaccagcagucuggaaacuguucagguugauucuuagcagaaaaucgaggggcucuccuguuacuguuaauauccuuaaaacacuuaaauuugguuaguuugcuucaagcauucucaguauauuacaaaaaaaaaaaguacucaagaauuucuagacuuuauuuugacugacaucagcuacccuaaugaacaggaggggacaacagcaagguauauuaggagcaucuccuuccuuuuuaaucagaauuauauaggaauuaagaacucuaaggccacaguagaguauaguaucuuggaagaagaaagcggagaaugucugacauuuucacugaucguuuaggcugauggcuuaaaccauuuccacccaaguuucuuacaaguuagcauuuccagccaacauuaccuacugcaauuucucuauaaucuuaaggguauugagcccccaaaugagagagagaaaagagauguaaacuaaacaggagucagagaaggggaaacugagucuguugcacaucauuuacccuuuaacaugauuuuaaagguaauaaugcuuauaaaaauauuaguaguaguaagggauaucaggugacaagcagaagugccccucuccacagauaugccaguguaucuguagaaauacggugcuaaaauuagaaaagacugaacauuuuaauuuauuagguagacccaaauagucuaaaagguuucacccauauacuuagcaauaguuuaugaaaguuccuuuucaccuauccuuaucaugacaaggcauaacagauuuuuaaaaaacuaccaauuggccauaauuuuuaaaaaauuacauuuucauuggguauuaauaauaagaaguuguucaccuuuuaaucuacaacuaauuaucagauaugcaugcauuuuuuuucuaugaauugcagcuguuaaauuuuugugaauuaauccaaugcaucaauuccuuuggguuuucaccuuaaacauuuuuguggcauacaauuuguauaaugugaauuuagaagauaauagcauaggugacuggggugcuacaauggauucucaccuauuuauuaacuuuuuaaugaguugauuagucucuaaaucaguaauucgcaaaguuuagcauuuaucaaugucaccuggacagcuugauaaaauacagauugcucagccccaucccuagcuuugcugauucaggaggucaggggugggaucauggaaugugcuuuuccaacaaguucccaggugaugccaggcgaugcugauguugcuagacuaaggaccacacuuggagaaccacagcucugaaauauucccugggcaugguauuugcaauacauacuuuauaccuaauaauuuguuucaggacacacaaaugcacaugagauuugauacauacucucaaaaagcuaacaaucaguuaagugguaauucacugacauguacacaucaaaguaauguuagacacauguaauaggccaagauuggggaugggcauuauaggcagauggaauaacauaaauaaaugcauccagggcuauggauauaagaucagccuggcuggcaaagucagacucaugaaggagauuaaugggaaaaccuaucuguuuugucugucucagguuauuuugaggaucaagugaaacuuagaaacaauaacaacaaaaaaagcaaagucugugaucaagaagaauuacucuguugcaacaauauaaacuaagaaaaaaauacgcaaaauucucugcugccuugggagaugaucucaugauguguaucauuuacuuuuaauauuuuuauuuauuuauuuuugagacggagucucgcucugucgcccaggcuggagugcaguggcgugaucucggcucacugcaaccuucgccucccgggcucaagugauucuccugcuucagccuccugaguagcugggauuauaggcaugugccgccaugccugccuaguuuuuuauuuuuaguagagaugggguuucaccauguuggucaggcugcucucaaacuccugaccuugugaucugugcgccucagccucccaaagugcugggauuacuggugugaccgaccgugccuggccaauguguaugauuuaauagccagcagcaacaggccacuaacaugccaucugcuaacaggggcucuagcuauuaacaucaacagagcuaaaaacucuuaugucugaucccuugcaaauggcgaagaccuggcugagaauuauuaucucaugcuuucagagaaaacuuugcuuguccugcacugaaaaaucuggcugcaauaaucacauggaagaagguauguuuguuggcaugguucaugggcuggcuuaugacuucuaagcagaagauacaaaauaauauaaaauuccugcaacaugcacaauguagcugauauucauguucucuuuaaauaucuuaacacugacuuacauauuuaaggguguggagucuuugagcuugggaagcaucuuauuacugagguacaaaugcuaaaagagggacauuucuucuaucuaccgcauuuucaaugaaaagaugcugaaggugaauaaacagcucugcaaacccaguuuuguuuaacuuggcaacagcaguaaguaaguaucacuggacacagagacacuggaauagauucagucuuuagucuuauucaucacgucugaccuugggcauauuacaugguuuuccugagccuaugaaaucaugcggcugaacgagcugaaaacuaagauucuuuccuuugcuaauaaauuucagcaaacgauaggaguaagaacggcugucuaacgagacuaccaaaugcuacgagacgcagcaagcaaugucccuuuaccuaauggauacagcuucuuaacuguuuauccaaagucuccccaagcaaauucuaaauuauucuaaauuauuugaguaacaaagauugggcccuuauaccugugacgugucuggcaaugacaaagaauguggaacaugggaagcauuuaauacauauuuauugaagauccuguguccuuauuucuucaaucuccuugcuauucacaauggcgaaugauaugaauauacauauauauauccuaucaugguaaauauauauaacauaaaucuuacuguuuuaaccauuuuaaguguaacgcucaggguauuaaguauauuucacgaugcugugcaaugugauggacgaugcaucacggccauccaucuuccccacugaacuauuuucaauauugccaaauugaaccucugugcccuuuaaacacuaacuccacagucccucauccucucagccccuggcaaucagcauucuacuuucuguaucuaugaauuuacuacccuagguaccucauguaaguaaaguuccauauaaaacacuuuacaaaauuugcaugucauccuugugcaggggccagguuaaucucuuuaaucauucuaauuuuaguauaugugcugcuaaagcaagcaucauauauauacuucuuuuuuuuugagauggaguuucgcucuuguugcccaggcuggacugcaauggcgcgaucucagcucaccacaaccucugccucccagguucaagcaauucuccugccucagccuccuaaguagcugggauuacaggcaugcaccaccacgccuggauaauuuuguauuuuuaguagagacgggguuucuccauguugaggcugaucucgaacuccugaccucaggugaucugcccaccucggccucccaaagugcugggauuacaggcgugagcaccgcacccagcuuuuuuuuuuuuuucucuuuugagauggagucucguucuguugcccuggcuagggugaaguggcaggaucucagcucacuacagccucugccuccuagguucaauucuccaaccucagccucccgaguagcugggauuacaggcaugugccaccaugcccggcuaauuuuuuuauuuuuaguagagacaggguuuugccauguuggccaggcuggucucgaacuccugccugacucggccucccaaagugcugggauuacaggcgugagccacugugcccagucuaucacauauacacuugugaaaacuucuaagacuuccuuacaaauaaaaguggugacugagaacuaagccauauaccuagugauaucucaguggugaugauaaaguuaguuuuuauuugacaaaaucuauuugcuaucagaauacuauacuuaaaaaucauaagcuuuaacaauuaaaucgcauguauaaaaauuuuagagaacaugcagcuauagcaacuucaaugcuauacaggaagcugaagacauagguccacaccucaguaucugcccucaggggaugggcagacaaauuucaaugcccccccccaaccaaaagcaaagacacaaaaggcauguacaagacaauacaaguuguugccaagcacuguuucaaagaaauaagauuuaacucaugcuuuuaggagcauauguaaauacauaauaauuaucaaaagacaaacacauuaaacaggcuuuuuuaaacgcacuaucugaagucaaugaauccaucaacaggagcugaaauuaaguaacgcccuggccuugacccucugaccccguuucaugcucgaaguccaaagccucuucacaaauaguguuuaggugcacaccaagucaacauuccuuuggacacgucucauaacuuggaaccgguuaauagauggauccacuauuuuugaugagauauuauaacuaaccuucuaugauuuacuuucuaaagcagcccauagugcauacggcaggaaaacuguuaacuaauaauggcacuuacucagaaaauacaugcaaaauuuguuucugaguugaacaccaacaagcaaauuaacaugucuuccaaacuccgucucacaugaaacaaacucaugucauucccaguuaguguuuguggaaacauauuucaaaauuaaucucaaaauucgggaaacauauuucaaaauuaaucucaauuuggauucaucuccauacucaggguggcaaacaucacugauuuuuuuccccuccucuuuuaaaaaaugaaccuugaaggcagaugcuugugaaaaacagaauaaccagcccuuguuccagucuaaaaucauugguuguucccaagacucuacaaaaaaagcaggacacaucugcucuaguguuccaugccaggaaguaguuccacagccaccacuguggucugacuucacuucccaaucauuuuaauuuggauuucuuuuuagauuuuguuucaaauuacagggccauacaaacgagcuggugaguugagaaaauagcuuuggaacugcauuggaucaucaaaagaaacggcagacuuuggcgugggagaccaugccucaggcuccauccauuugguugaggugcccacacaugcacaaaaauaaaagaauggcauaaaaacagacaaaaacuacugacaugucagucaucauggcuuaaggaaaagcucacaaauaauuucucuggaaucucaccaaaauuuggaguaaaagaugauagcaugcuaaaucaguucucuugcuacuucuaaaauacuaacguuccugaauggggcucaagguggaaucauuucgaggcaaauaucaguucuaguagauaaaaguguuguuuaaaaccucauuaacauuauauauaaauauuccccaaaaugaucuacagauccaaugcaauccgcacuuuuuuuuuuuuuuuuuuuuuugcagaaaugguagugggggcagggggugaggaagaucuuaaaauucauguuguaaugcaagagacuccggauacucaaaguaauauugaaaaagaagaacaaagauaacggacucacacuugcugauuucaaaauuuacuacaaagcuacaauaaucaaaacagugugguacuacaguaagcacaggcacacagaucaaagaaaagaacuaagaauuaagaaauaaacccauauuaucuauggacaauugauuuuguguaauagugccaagaccauucaaugggggaaauaauagucuuuuucuuccuuuuuuugagacagggucuugcucuauugcccagguggcgugaucaaggcucacugcagccucagccaccccaggcucaggagauccucccaccacagccuccugaguagcugggacuacaaauagauguuaucaugccuggauaauuuuuuuguagaaauguggucuugccauguuucccauucuggucuugaacuucugggcucaagucaucugcccaccuuggccucccaaaaugcuggaauuacaggcaugagccacugcaccuggcaagaauagucuuuuucaacaaauggugcugggacacuggauauuuauaugcaaaagaauaaagucaaaccucuaccucacaccauauaugaaaauuaaaaugaaucaaagauuuaacuguaagagcuaaaacuacaaaacucuuagaagguaacagguauaaaucguuguaaccuuguuucggacaaugguuuccuagauaccauaccauaguaacugccacaaaagaaaaaacugauaaaauagacuucuaaauugaaaauuuuugugugucaaaaggauccuauuaaggaagugaaaauacaaccuacagaauggguaaaauauuuccaaauaauguauuugauaagaauuuaauaguauccagaauauauaaaaauucuuacaacucaauaauaacagcaggccgagugcaguggcucacgccuguaauccuagcacuuuggaaggccgaggugggcagguugccugagcucaggaguuugagaccagccugggaaacaugguaaaacccugucucuacuaaaaauacaaaaauuagcuggaugugguggcaugugccuguaaucccaacuacuggggaggcugaggcacgagaaucgcuugaauccguaaggcggagguugcagugaacugagaucaugccgcuucacuucagcccgggugacagagcgggacucugucuccaaaaauaaaaauaaaaauaaaaauaaaaauaaaauuaagaaaguaagguaaacaacccaauuaaaaaauugggcaaagaaucugaacguacaucauuuauuugaacugaacaaaauaauccauaacaaaccauugcaaucgcaugaagaaaacacugugguugauauuuaauuccucaaauuucugccagcguccauuuggagcacaauaaacaagaucaauauacugcacugaauuauacauauuaaggucaacaauuugucugccagaaugguagagagcgcaauauuuuuuuaaaaaaggaaacuuuuuuuacauucauuauuccuagaaaguguauucuuuuuaauguagcuaaaaggauuuacuuuuuccuaaaauuauggaguagaaauacauaaaagaaaguaucuguuugccaaugguaaaacuauaaaaaucauucaggaaaacggaugcuguauuacaugugaauuuuuaaaggucauuaucaaugacuuccacagaucaucuggaugacauaugcacuauauuuacagauuccauaauuaagcuccaaagcaagaaaaagagagcuuaccuaauaucacaaccaaaaaaggcauagagagcuaaacguauacaaagcacucuacuaaccaccacuauggggugaguucgacaccugcaggucuguaaccucaagucugcagacagaccaguuggggaccuaagguaugaaguguacuggcauucacacauuuguaucuugcuguguggagacauuucaacauggcaguccaaaugucagaaaacuaggaggcugucuuaauaguauaccguacuuugccauucauuugacaaagcauuuucauuuauaaaugagugguucuauuuugaaagagaaauugucuugggucaaagauauacauuuagacacaggcagcuaaacuuacaggccucaugucuguuacuuaauaacacuagggaaaauaugaauaaggagcucugagacuauuaugaaaccaaugggggaacaaggcuuugguuguugauaauauguauaaauguucuuggccagaugugggggcucacgccuguauucccagcauuuuggggggccaagaugggcagaccaccugagaucaggaguucgagaccagcuuggccaacauggugaaacccugucucuacuaaaaauacaaaaaaauuagccaggugugguggcacacgucuguagucucagcuacuugggaggcugaggcaggagaaucacuugaacccgggaggcggagguugcagugagccgagaucacgccacugcacuccagccugggugacugagcaagacuccaucucaaaaaaaaaaaaaaaaaaaaaguucuuauguccaaauacuuaagucagcuguaaaccauuaaaucuauauacauuuaaaagucauuucuuaugaaaaacaaagucacaccuauguucuuauaagaacaaagugacagcucucuauuugcuguuaugauuuuuuuuuuuugauguucauccuugacuaacaauuacacauaaggauacuugaaauucucaauaacauuaaauuucuauuuuguugggcugggaagugcuauaaauauucuauuuuaaaccuagucuacuuuggacccacuaaacccccaaaucaacaggcuuauuagaaacagaauauggaaacacugucuuugaaauaaccaugcugcauuuuuccugaagaguggaacauuuuaucaagaggccacaguaaaauuguaauaaaaaauaagcauccuuucauuauugcgaauuucuugauuccccgccauaucuuucaauccugccccauucacuauggauuuauucagccagagaucuuucccgcaucugguuuauaauaauucauguuuuuauuaauuuugaaugcuagaagaaaaaaaauggguaugaaacaauuaugccuuuguucccucuuuauuuccuacugccuuucucauaaauugguuauuauagcauucuguaaaacagccaucucugaaaagagcuacauuuuuagccuugagguagcugcaaagagaagcacacuuugauaaauaaccucagugccaauacaaagaguagaauagaauccuuuuagcagagauuuaaggaagauuacaaaggacaaagaaaacaccaucauuuuuaaguaacaauuugacaaagcaaagguugaaaggaugaagggauucugcccuuuugaaggauuaauaaauaauuaaagcagaauaugaacacugaagaggagccauaguuucacugaaauaaugauuccaucguuuguugaaugaaaaaauauuaaugaagaccuacauagugauuuaaaagaggagauuuuaucucuauacaaacaaugccugaggccauucuuugcaagaaaucuucauaaucugccugaaaauaacuuuuuaaaaaauaaaaacauuaauaaaugacugagccugggaacuugcacauaauaauuaaaauugaaugaaaaaaauaugaaauuauaaaauaaaacacgggccuuuuauaacacaacaggacacuugaaaauucacacuuauuugucaugggaauagcuucagacugugguuggcggucaaacaggacagcacaauuaaaucaaguagaugaccaaauagcagagggucaugguacaaagaaggaccauguuguaaaauuuuauuaauaaagguccucagaacccugauuuaugcuuuguuaucuuggccaaccacauccauuuaguuagcuugaucaaucacagcuuuagaggaugcuguggccuaggaaagaaauuuguuuuguguggugcuuacgcuagaugucaaggaaggaguuuuggucaggucuuuaggguuacggaggagcccacuucaucaguccaaguuaaggagcaucugccuuuuuauccuggggacuggcuucaaccuuauauuuauaauuacuaauaucuaaaaaguaccaggguccuugcuggaucuugaggaggcaaggaugaccaacauauaucuggaagaguucacaggauggaggguuaguagagauauaaacaaauaauuuacuccaaguuagaguaugguauuggagguggauacccagugcuuucacauugagguuaaguaggggaaaauuccacuucagagaggaaaauaggcagcagaaagaacacagauuuuggacuucuggcaggucuuggcuuccaccccacuuucaucacuuuacuaucugggcugggcaaguuggcaaacucucuuagguucaaaguucaauuucuucaacuguaaacuggggaugcuaucacugaauuuccgaguaucuucacuagcccauaugcugccuuugugugaaaugcaagaacagcccacuuccagugggugugcacaaugccagagggcuuggcuccuugagugggauguagaauaaaauuaucagucuccacucuuacccuaaaccaccugccacugccacaucucuauauggcgguccuguaccucaacggggaacauucauaaagaaagaaugugaccaucagcauuaucacaaagaggcacucauuaguugguuacaugguugucacucaaaugccagcucuuuucuccguucucuaugcaaauuagaaaggguuuauaggacuugggcauuuuacuugaaucuugaaaggugcaacuuuucaagcaaggaaaaaccacaagcagcuuuuuuuuuuucuuuuuuuuuuuuuuuggagacggaguuuugcucuugacgcccaggcuggagugcaauagugcaaucuuggcucacugcaaccucugccucccgaguucaagugauucuccugccucagccuccugaguaacugggaauuacaggugccugccaccaugccuggcuaaucuuucuauuuuuaguagagaugggguuucaccauguuggccacgcuggucuugaacuccugaccucaggugauccacugccgccggccugcagcuguuuuuuuuguuuugucuuuuguuuuuaagggaacuugcauaguuccgaaaaggaggaauugaagugggagggggccaaugugagauaagagguagggugacuggcugggagucuaaugacacugaugagaggacaggaucucagguaaguaggggaugugcagagauuucacaugaacacagaaggccaaauauacagaacuugcaacuaauaagaaauaaugggugagggagaggaaggcaucauggauaguuuaggccaaccaagagaacucagaauagaguguguaaaacaaguaaauuuccagaaggacaugaguguuauacacauugauugcagguucagaggcacaugggauauuuggggucuggaauauggcacugggauucaguacgcuggcuguggcuagacccaugaauuugggauucacugaaguuagugggaaaguagcaugaacagacaggaugccucagggaagcacaauggaagauacaaggccagggccagaacucacaagcaugaugaacccuaugcucuggucacaguuuacugcucacaaauuuaaugucaauuuuccccuucaccgauagcauuccuucuucucagcaugacuccauucuuccucauuuucacccauaaaagagaauucuaauuggaagcauaauuuacugaagcagauauaccucucccacuaaagauacuggcaguuccccagacuggugaaaaccucuuauccauaaagcaacuguuaccauuauuuaauuaaaccauuguaucucucuacagauguuugacugcauuaagcacauccuaauugcuuguauuuauaagcacaaacuucuauacaaaaggcaugcauuuuuagggacuuuaaaauuuucuccuuuugccagugucucugaauuuuaguaugcuauuuguacugaacugacuccaaaucuaaaauuugauuauauacagaaauagcaaauaaaugcaacucagacuaaugacaaagcauuuaaucagagaauauuagaacgacuacaagacauaaccuggaaaaaaaaucuaugaagaaccuauuuagaaaguaagcuaaaagcaacacuuuuuauuaugagaaauuuuaaacacauacaaaaguaaaaagaauaacaugaggaaccucuaauaacauuuggcuuaagcaauuagcaccccuggccaaucuugaaguuucaacuauauuccuacuaaaaagggacguauuguuuuaaauguuccuucaaaugaaaaaggacuauagaugacaacuagguucaacccagaaaagcuauucuccccagcaaaccacuucuguagcuuugacacuagcagcucagauaguguacaggguucguuauugcaaacuucucuuucuauagagaacagucauuuaaaaauggaagcacccaggauuccaaaugaaagguuuuuaaaaaagauuaucuuucagaauguggcaucugguauauuuagaaugauauauaugucauuacuuaaaaaaacccaacuaauggguggauugagagcauauuacauacauacacacacacacacacacacacacacacacacacauuaagagcacauacguaauauguucuuuauuuuuauuauacuuuaaguuugaggguacaugugcacaacgugcaggucuguuacauauguauacaugugccauguuggugugcugcacccccuaauauguucuuaauccaaccuaauggcuguuuuuuuuuuucuuuuuacagaaaaagauuccaugauacuaguuaucuaaauauccucccugguacugagauuugaaguuuauugugcugcccuauucuugggcauuucguaauauucaagauaucugaaccaccaucuguucuguggaagugugacuaauuaguggcuaauguuuucaguaguauagugccaaauaaaaaguucuaauaauuuaauuauaaagagucaacaauaauugcugggugaggguggaauauuggucaucaacuuuuuaguccuuuguaauggcuuauuucccuauaguuauuaccuaugccacuucaacugaagucacaugugaaaacaggcuuaagauagcuguaaaaaacaaacaaacaaacaaacaaaccauguuuucuagaagauuuuagcuucaguucauuaagacugauaaauuauuucauuuuguaccuucuacaacuuuuuggagaacuucuuuacacuuauuuaauacauaguauuuuaaagguuccuuacugaugucuauucuccaaguauaccugaaaaguauauuuguuugcuaaagaaacuugauacagugaaaaauuaauuggagaucucuguucucaauucaugguguagacuaaaaacuccaccuccacuaucuucauaaauucuugcucaacacugaguugcuccuucugaacaaaagcuuggcacacuaugaaguugcuuuuuuucucuucuuuuuuaaauuagagaggggguuucaccauguuggccaggcugguuucgaacuccuggccucaggugaucugcucaccuuggccucccaaaguucugggacacugcaccucccugacauaugaaguuucuucugcaaguuauguagcucaaaguauaauuucagauuccguccauuaaugugcaguacugaacagaacaucaucacuugacacaugccaaauauuucacagcaauacaaacaauauuuacaaggccacauaaaucaggaaagaaugagcagaauaacacuggcauaaaaugggaaaaagugagggccagcuguucccuugagcgguguuucaggcacuucaaagucggacuuacuguaauggguacauccaucuacaacauccugggugcucugauuccagaugauaaccuguaucuauuuccaacccaauuaacaaaggguaggauucuuuauggggaaggauaugccagauacauauugcuuauauguugguagacuacacacuaaaucuccaguauagguacauaugcuuauauugaaagaugcaccaacauaaucgucaucuauguaccuuugugaaguaaguuaaacaguuaugggcauuuuggcagcugacagagacucaugugguauuugauucucuuuccaagagaaacagaaaugagagaucuuaaaugaaaucauuagucauuaggaaaacuagggacauaaaagacagugggcacacaaggucaguuuccugguuuugauaauggacuauaguuacguaagaugucacuggugaggcaugugggugauggaugcaugagaccucucuguacuauuuuuccaaguucuugugagaguacaauuauuucagaauauaaguuuaauagcccacuaucuuuuaaguuuaaacaaugaugugguucagagaacacucauggcuucccugcucagccaucaaagagaauugugacuuacugaauauaacaauaaccucaaagucacaagucacaguuauguguuuuggcugugcuacuuauaaugcaugugacacaggccaguaaguuacucaaauuuuaaguuugagcuuuuucauuuguaagauggaacaaucgugacacucaaaagaugaagaaugaguuuuuuuccccauuaauuguaaaguaccaaagcaucauaauuugagagccauaacaagauugggcaaauuagaaaaaaugcugccacguauaauucaauaacaaguguccaauuauuacaaaacuauacccuaagucaggcgacauuccuccagucuuacaaguauggagagguaagaacugauucaauugcuaaggcuaguaagcuaguuccagccugacaguuucaucguaaaaggcaagcuguucuauuaacuuccauauuccucaaacagauaacucacuuccucaauuuuccucugggggaaaauacauguccaugugcagcaucaaaagaacagcuuacuuaccaacuucauccugaaucuccucggccacugcaggcacguuguagagcagggagagagacugauucaugcgcucauaaaucacacggaggugugucauaaccugcaucaaaggaugacaacuccaggucaacaaugucuggggguaggaaugguucuuuuucuuucuuuuuuucuuuuuuuuuugagacggagucucgcucugucgcccagguuauuuuucuuaccaagcacugcagguagauacaaacuuccaaaagaaaacugacaaaacacugcuacuguuaaaaagguugaacugaaagggcaacuuuauuuuucuuguucuccuauuucuguucucuaacuuuuugagcucagguuuaagacuugaucuugaaacuuaccauuaucuuguaugcuuauaacagccaauuaaaaaggcuaccucugccaccucugauuccuaauacugaggcucucuuaacaggacccucaugccuaaauacauuucuuugcaaauuucccccuagaaaacaacguauuucaauuugauuggcuauuucaugcuauauauauuuaacucuuucauucaagaaaauguaaaauuucacauuuccuaagguagaucccaguuuucagccuuugggaaccggggaguauaaaauacauuauuacugggcuucauuuaggcucacaugaaaucucaacauuccaguagguuuaugauugccugccauacuucaguugaaccaguuuucaagauuuuaguuuauacaacuuuuguuuuucucauuuuagucauugguuuuaaucaguuccuuagcaaucaguuagcaguagacuaagauuuuuacauuuguuauuuucauaacucagaaaaugccaaaccacauauugcucuaagacaagcuuuuagaauuuaccagaaguuaaagagcucuugccauagggaaaacaccuauaggugcucggagaaugcgugggauccugucaccaacccaagaagcaagaauccuggauugucaaagcugcagaagaugauuauaccccacgcuuaccugggaccggaucugagcggcuuucuugggauccaccaugcgcacaugcucgaaaugcuuuagggugugcugucuguccuucuguucugcgcggacauacuucuuuagcauauugaacacgugacgaggcugugggaggaaaaugaaaaacucuuuuucaaguuugugcaaaacacugcuucuuccauuggcgauggguuagagguuccacuaaugcauccggucaugugaacguacugugagucaccuuuuugcaggucugccuucuaaacauuucuccuacuccuuucuuaauggguaauuacuuagaucggcugcuuuucacuuccacaagagcauuuaacauucucgacauauaugaugacuguccuccuuacucaacauuuucuuuuuaaauaggaguacucugcuauagaaagagaacagauuugaggucugucagguuaaguuagguccuucucuuuucgcacccaaggggcauaugugagacuacauugcuacguguacauuuugaagaccagagguaaugucacacagauaaucccaucaccaguaacauguaacauacgaaaucaaaaugagaaaaacaggaaauuuaaccacuauuuuguaagccaaggaguaacugaacuguaagagacauuauauuuuucuaggagaaaggccauugcuaaacuguauuuauuuuacucugaaauuuaauuaaguucuuucuaagcuaucagauucuaauucuuucagcaacaauuacauuucgucuuaagugcuccuauuuucuuucuaauugguuccauuucauuuuuauuuuaguuuuaccugaaaacauccauccuaauaaaaacuaaggacaaagauucccuggucuucaacaauuucaucacuauaugcauuccacuacaugauuuuguaagaugauuuccaaaaacacaacauuucuucuucauuaaaacaaacaaacaaaaaaaccaguugugaaaauucauguugggaauagaauuuuggucauuugggcaaaccuagcuauuauuaacccaugugucaugaguacccugaaaaccaguuggaagguacaaaauuuauuccagagaugguguguguggugguggggcgggugguaauggagcuuuuguuguguuauccauauccuaugggaugugccucuccuuccccuuuugcuuaguuaacuuaggagccaucucccugccaucucagguggaacgagguacccuuuuucugugcuccuaugaaauacugugcaaauccccauuaauguaccuaacucauuaaauuaucuaugauucuuacuccccucuuuaaugugagauccacagggcuggauuuggucuuuuuucuuuauuuggaaccccaauaacacagugcuugacccagagggugcucuguauuugcuuggugaaugccugccacagaggccaugcuacuguacuugagaaaacaaauacauauacacaauaaaaauaaaacaacuugggcucaucugccuucuuuuuuccuaaaagaaaugugcuucucuauaauccccagaaagacagccaucacagcuugcaacaguucuuggcaacuuauuacaacucucaucugaacugugaaaucugguugaauuuacaaaucagaggaugaccuuuuaaaucucagaagaaaaguaguaaaagagguaaugacugauaagcuauaucucuauauauugaaaagaggauagguuauacaugugaauuaaaaaaaaagaacauuugaaaacaucagagauuaaaggcugacucuuguugauugugaaggauauuugauaugcagaguugugugaucaggaucuugcacaaccacccucgaugcuugcuuguuauuaagcaccaaggucuuagaaaucucucuaguucuguuaccauuauucauccaagacuggagacagaaggggcugugacuaaucgcauuuaaccaugauguuccuuccuggccuucauggaugcuuucuuaguugcucuauuucauuuuucucccuuguaaaggauuuauuguuuugaagaaaaugggaugaauuuuuaagaguuuaaauaagaaaaaaaaaaagcacuucaauuaaaaaaguaaggauugcuuugggagucugaggcaggaggaucacuugcagccaagaguuugagaccagccuggacaacauuacaagaaccugucucuacaagaaaauuuuaaaaauuagcuaggugcagugacacaugccugcaguuccagcuacuugggaagcuuggucaggaggauuauuugaacccaggagguugaggcuguagugagcccugauugcacgacuguacucaagccugggaaagagaauaacugccugucuuuuaauuaaaaaaaacaaaaaacaaaaaacaaaaacaguaagaauugcuuuucaucauaacuucuuuuuuuccaguuagucaucuaugaauguuuuuguaagauauuuuguccuaaaaggacugucaccaacaagcagguacaccaggaugccauggccccaggcuggccuuggcauuacuacuucaagcuaaauuucaauuuagagaagaugcaggucauuucugaugaccaacaucuggaucuccccuuuucuucuccuaucacaacaaacagcauauauucccacuaauuauuauuauuauuauucuuugagauggaaucucgcccugucucccaggcuggagugcaguggcgugaucuuggcucacugcaaccuccgccuccuggguucaagugauucuccugccucagucuccugaguagcugggacuacaggcacgugccaccaugcucagcuaauuuuuuuguauuuuuaguagagacgggguuucgccauguuagccaggauggucuccaucuccugaccucgugaucugcccgccuuggccucccaaagugcuaggauuacaggcgugcgaccagugcacggccaauuaauuauucauguuaacauacauuuaaaaauaagcacaaaagccuugacuuuucccaccuaugcaauucagauggcaguaucuuucagauaguauuugcagauuaaauguguucagugauaguuacccagaaugaugcguaguccauugcugauacucaauacacauuuauuucuuucacucaggccuuaucuauaaaucaucgaccccuuucuuuccucuaaguaauaagaguucaauguguauugacugcuucugaaugagacaguauauuaaaugcuuuuugcugguaacucaucaaaucuucgucucagcccuaugacagagucauagcagcucuccccaccuuauuggugaggcaugaagcacaaaggagauugugguuacauaggcuacaucccuggcccaaugguuacacagcuaguuaguguuagauuugaagaauggguuagucucacugucuuggcuccagagccuccuucuccuaaucacuuugugaucuggcccuucaaggagaaucuaaaauagaccaaguuuaagauaguucuacaaagcaacuuacgaaguuaaaaacaggccaggcgccguggcucacgccuguaaucccagcacuuugggaggccgaggcgggcaggucacgaggucaggaguuccagaccagccuggccaacauggugaaaccccaucucuacuaaaaauacaaaaauuagcaaggcaugguggugggcgccuguagucccagcuacucgggaggcugaggcaggagaauuguuugaaccugggaggcggagcuugcagugaccugagauuccaccacugcacuacagccugggcgacaggacgagacuccgucucaaaaacaaacaaacaaaaacaaaguuaaaaacaaagaaauaagugcaugguuagaaaagacagucuguuccaggaguacuugccugacuuucuaguuuuuacaagugcagguaauauucugugggccaugcuaacaucagcuccuuuaauugugcagaagguucagauuuagcuuguucagucucucaauuacuguccuagguuucuggaguuccauuauuccuuagcuaaugcaugaaauuauuuagcuaauuauuaagcuaauguguggggagaagaaagagcaagauaggaauguccucuauccauguggauaaaggauuaggauuacuggaaagugauucaagguauuaaaguuaggcuuuugugacauucaugguuucuagugcuaaauucauccuuaucuucuauugagauggguaauuaaauggugaauguauucacauguuuucaauugcugaucucauuuaauacugccauucuccuucaaaauauauuccuaacuuauccugaaaauccccagaguuugauaauaauguucccggacugaacugaggguugggcuacuauaccucacagcccaauaacgagaugcagaugaacugggaggaagagaguuuuuauuuuuguaaccuuuuacagggagauggccuggaaauuagugccagaccaacucaaaauuacaaaguuuccagaacuuauaugccuucuaagcuguaugucuacguguaagugugcauucaucucaugacagaagugauuaacuucuuuaauccauaacuaaggucugaguccugaagaccuuccucuggagucucaguaaauuuacuuaaucuaaaugggucuaggugcuggggugauuacucuuaucuugucuccugcuaaaucagggagguuugaggaguuccugcagaccuccaguaaacuuguucuuggaggccuguagaguuucuucagacucccaguaaaacuuguuaauccuaaauggguccuguuaagaauuccuugguuuugccaggaaaggccuaggcaaaacucuuggugggcuuuuguuacauuccagccucuguauaagggcgcuggcuuuuuuuuagcuuuuaguauuuaacugaaccacucagucaguacggaaacagcuguuacggaggccugcauuagugagauuuggccugccacaauaacagaguagcaaaggaggcucugaggacuccccaggccucagcuccuccagggauaaugagaccugggaaaccccuucacuguuuauguaagcugagaugcgcauuuugugugcaucuacauaaacacaagccuuuucuuccuaaugccuauuggauaagcaaagccugggaacaucagauaauucaggaagaccuuaggauaucucccaauaaaugaauuugcaggguucugcuucauugauuuggccaccuaaacacaucucuaggaaucaugcuuggaaaugaaaacaaaaucagauuaccuucuuuguuggacgguaggcaaauaaaucauaccaaauaaaaugguaguuaucucuaucccucagaaacaaauacuauuuuuaguuaagaaagaaaaaacacagguguaaaaagaaaauaauucuuggggcccccaaaucacuaagcuaaagggaaaagucuagcugggaacugcuuagagccaaucacccugauugucuacccuggagaggcuaaucagaaacucaaaagaaugcaacuguucaucucaccuaucucugaccuagaaggccccuccccacuucgagucuuccugcuuuuuguuucaagcugucucgccuuuccagaccaaaccaauguacuucuuauauguauugacugaugccucaugucucccuaaaaaugcauaacacuaagcugugccccaaccacuuugggcacaugucaucaggacuuccugaggccgugucacaggugcauccucaaccagggcaaaauaaacuuucuaaauuaacugagaccugucucagauuugcuggguucacauagauaacaguucccuauacuuuuauauuuuuguugagguuaaaaaaaagaccucccuccuuuugauauaugauuccugcauauuucacucaaauaaauaaauaauugcccucacaacuuuuggccaaaauacaaauccuccaggcuuaacauuuguuauuucuugagcuauaauaauguaucuaagaauaacaagguguccugauugucuagugagguuuauuuuauuaugcuaagacaaagaugaauuucuuaaaauuuuaauuaaaaacacagaaaccuucauacaggaaugguagggaaaaaccccucuguuaucucuauagaaacauauucucuuaaaguaauugcuauuacuauugucacaauauucauacuuaagacggguuauucauaugaucagaaaaacaaaagaauucaguggcucacgaaaaggauauugauaaagagaguuuaagaaacauuuuuuuuuuuuaaccugcaggcauauaauccggaucacccucaugucuuuaaaucuucuguuacuagcaauaauuuuucuguguauuaauacuacagucugguuauauuggcauuagauggcuaaucucauuauuaaaauauauggcaaagaacagaggaagagaucugucccaggaggacuaauuauaccgaauccuauuuauugucacuacuguuucugaaacaguguuuagcucauaauuaugugcugucuguuugcaacugaugugacauuuuuuaauuuguacuaaacucaccucacaaucacacugccuuuuaaaaaaucauucaaaauaauuuauuaaaggauuaagaacaggcaccaccgaaauggcuuagacaucauuuacagcaagaggaaagagaaacauaagauuuacauuuuagaacauuacucauuuuccucucuggaaacaagagcguaauguauuucuaccucuaggcacaguuccugccacaauuugguugcuaauaaauauuuguuaauuaaauuaaugaguaacuugcagcuagauacaauuucagaaauaggcccaguagugcagaauauccuucauagucuucaaguagaaaacaaacaccucucuacucagaauaguggccuucccaauuuucaccgaaauacugacauuaauaaaccuacuugauguaucuauauagugugcuuggguacuuuagaaaguaguuuuaacugggaacucuucccagaaaauauuuaauggacuucauagcgugcacaaacucgucucaaagagaagauucauuucauuaauuucaaaacaucucacauauuguguucuuauaguuugaugucaaauugauguagguaauauugaagaaaauuuaauggccuuuccugauaaaagcuaacacgguuuuggagauggagucucacucugucgcccaggcuggagugcaguggugcaccuccaccucaacucacugcaaccuccaccuccuggguucaagcaauucucuugccccagccucuugaguucagcugggauuacaggcgugcacccucacaccgaccuaauuuuuguauuuuuaguagagaaggguuucacuauguuggauaggcuggucucaaacuccugaccucaggugauccaccugccucggccucccaaagugcugggauuacaggcgugagccaccgccccuggugcuaguacauuuuuuauugauuuccccauuucuuagacguauuuacuuuuucauuuuucuuuuauacgauuucucaaauuugguguugcugggacuugggaaaagucucauacauuugacuaauggcaggaugacucaaugccagucacgucugaauauguagcuuauuacuugacaguucacgugggaaguguauuaaaauuauuaaguccuauugucccacuccacagcuuuaugcuugaucuagaaaucuggcaucuuaucauaauagacacuugugcccuaaacccguuucuuauggaaggcagugaagugucaagagcguuuaaaagcccugggcauaauccugccaagaaggaaguaaaugacucacuguacgggaaucaccccaaccuuuccaggucacagaaaacccucuccuggagcauuaaauugcacccuggugguuuccaaaacugaacaaagcaauucucuccugcuuucauaaauagguucagaacuauuauuuucacaguuuuacacccuggauuucaagaaaucuugagcauauaaaauguagaaaauuuccgugugcagguuuaaaaaucacacuuuagagaguuaagucucucugugcuugagaugaucuuaguuaaacguaauauuuggggaaacugccauggggaccucugaaucaccaccuuuauugucuuuaaugccaggaguugagcugaauuuuuaaagucuccugcaaaauuuauccaccuuccuuucuucagaaaggcaaacaaaugaucuuuguaguuuaaggugaguauaaaagggcaaaugauaaucccaugccaagguggacacagaagucuugaaugaagcaauggagaaaauggcaguagauucucacacucucccccuuugguguuucuuaaguuuuaacaauauggauccauuagauggaaggauauugaacaacuaaucucuauuaauccacuuagucauaaggccagagcaaaacuuuuguuuauggccaaggaguuaucccaauguuccuucccaggguauccgguuugcugaugcggcucugauuuuguacugaacaugacgcaggagcaucuaggagucaucuaucaucuguucucuccuucccguggaagcagaucacuuccucauagggaugugucaccaaagccuccauguacuuccucuaacaaucuuucuccucuuacggaggaagacaucuuccuacuucacaauuuugucucaacuuucaaugaauccuuuugauuuucuaauuauggcuaacaaaagcuaaaacaacagaaauugcagaaagaggagaaaaauuaacuccaauuugcagacggaauaggaggaaucccuuuauuaaaucacuugcuccuaguuacagguuauaaagauggcaaaccugggaaguaaagacaagaguuuauguuauaaaagguagaaaauaggagugguuuuaauucucucaucacuuagugaccuuuuuucuuuucuuuuuuuuuuuuuuuuuucugagacggaguuucacucuuguuauacaggcuggaguacaauggggugaucuccccucacugcaacccggguucaagcgauucuccugccucagccucccgaguagcugggauuacaggcaugcgccaccaugcccagcuaauuuuguauuuuuaguagagacaggguuucuccauguugguccggcuggucuugaacucccgaccucaggugauccacccgccuuggccucccaaagugcugggauuacaggcaugagccaccacgccuggcugaccuuuuuacaaaucugguagguuucauaaauuuuuuccaggguauuuugcuaguucucagaaauaauuuauuuugguuguucagaccacagucauaaauuagugaaggcagcauauagaacugaaauuuagcacccaacacaaccccaugauucaugcuuucagacaaacucuagcacagaauggauaaagagcuaagaucuucugaccugggaauacagaaaggacagaaaauguuuggacuuguaugucuucaagcuuuguuuagucaaacagugaaacauguguacacuuaaugaugaacagaauuaguaauacaacccagaaggcaaagcgcacaguguugcugaaaucauaagcaaaagauauguucgacuaacucggacccuugcagagauuugucaaacggucugaucauccgaaaaaugccaacugugacauauucuugacuuuuuaagagagauuuacagcaaucugcuuuaauuuugcauauucauacuuggacuauggugguccugcuucauacauccucuaacugguuagccuauucaaagaaaaguacauuugcauuucuuuuaauuuuacccucuccucuucccauaccuaggcaguguuaugaccuauuagaaauucugaguuuuuuguugauauuaaaacauuuauauaaggaaacucaaggugaugauacuuaaaagccaaacaucaccuggcaucuuuaaacugguauccauggucaaccuucacaaaaugaaugaaccccuuaaagcuuaugcgagauuguguuugcguguguaugcguacauguuuccagggugaggauucuuugcuacccaucuguucucuaucagucauaccaggcaggugaauaacuacuggaucuuuaaaugugcuauuugucuacaaaaacuaaauauuuauauuuucauaauacauuuucauucucaaagauaaaaugaacauauauauuaacauuaaaauacguagguuugcuggaagaaagcagagcguaaaaccauacggugcuauggguuuuaauagcauccugugaagaccuauuugcauucugaaggcagugacugagcagugcuccacuguggagggaaucugggugaugaauauggccucaguggcaaaagacagcuuuuaagcuaaugccuucccaacauacuucuuaauguucuauguaacuuaauuaaacccagaaaccacuaguaucucuuguuacauacuucccauuuguauguagcaagauuuuaucgaacuugguaaacauucagaagguagggaaguaauaguacugaguggcuuuacugaaagagcauguauaccauucagcauaguuuauaagauuuuguucacuaaaugcuaauucucucauuuuccuucccauucacuaucuguuauuggguuugcccuuaggagugcccaagcuaaugagucccccuuugcucaccaauguauacagaacucaacuaaaaauaaacggauggugaacaaauaaauaauaaauauguaaguauagagcaauuauuuacuuuucugaaagaugaucuuuuuggccuggcagucuuucaacuuuuaauuccauucugauuagcuucauaaaauuuugguuaaauucaaaaccugcugguggaaugccuuaaacauuauaauauucaucuguccacauaccaagaacucagcaaauaauuuuuaacuuacuaucaguuacauugagguacagaugucccauauuugcuuuggagauauaugcuauauacauauauuuuauaagauaauuucuuuugcaacgaaaagugauggguagaaauaauugguuuguugggugaagggcaauuagcgguaucauauaaaagcucaaguuuaguaccacaauuucuuuuuugcuuuagaaaagaaagguacaccaacacccacauugguuaaaguuugguuuaguuguaauccacaucauauaguggcgaaaaauuuauuuaugaggugguuuaaaccuucucaugccaucaccuguuuaccugugacaaaccucccauuaaugucuacccuuguuaucuccaaugacggcuguuucuuguugaacauuuauugcucuucugcuggaauuuaccaaauagccuugagcaaaaucucaacuuagugaugaaaccgugcucuuuaaugaagagucucacagaauucauguucuaucaaagaauuaugugaagaaguuuccagagaucucagcaaaauuuaacauguggcugaaccauucaaaaaugagaaaccaaagaaggaugccgaugcuauagaaacugccaacauuuuuuuuuugcucaauuaaacugauagccugaaugugaagcagcagauagaagcaugaaaugaauuucaguauggauaagaugguuucaaucguuaagacacugaaaaaauccaaacaacacaacugggauagauaaacagauguacaggaaaauguuuccuaauucucacuucccuuuagaaaaugcaguuguugaagucagaauaauaaucaugauaacugucugaugaaagauuuagacuaaguaucuguaaaaacaccaaaaaucucagaauuacaaagaaagcuuuggcuguguaucccuuaucuuuaaaacaguucaagucuuacaaauuagggggugcuaagguuuuccaaaccuaggccuacaauagaaaguugauugaaauaaaaaaucccuaucuggccuuugguuuaacuguacaggaucacauuaagucuaauuucucuucaacagucaggacauaucaucaucuucugucuaugaaggauaagcagaacgcugagaguuacaaggggaaaggcucagacagcauuuaguuccuguuucaugaagcuaugaauaguuugaguacgagcccugacaaaguaaaaagcaggaagugcaugacuguagagggcagguuaagaaaugaugaaugcuuagcuuuaaguauuuaaucugguagcuugcaggccuccaaaggugguagaaguuaaccuccugugcugcaguucuggagaggcauuuaauucuuccagggggaaaaagugcuaacuccuugauuuuccaaagaaagucuaaggaaaguaaaaaggugaagggguugguguuuagaagagucacuagccuucaacagaguaagaguuuuuucugagugcaaagacacagcucugcucaacuuuuuuuucccauggggaaaacaacuauuuuaauaauuguaauauuucaaguauuuaucucauuuuuuaacuuuuaauuuuggaacagcgucuugcuuugucauccaggcuggagugcaguggcaccaucacagcucacugcagccuugacuuccugguucacacucacaccucagccuccagaguagcugcgacuacaggcgcgcaccaucaugccuggcuaauuaaaaaaaucuuuuuuuuuuuuuuuuuuuguagagauagggccuuucuauguugccuaggguggucucaaauuccugggcucaagggauccucccaccucagccucccaaaaugcugggauuacagcugugagccaccacaucuagccuaaaguauuuauuuuaaauacaugugccuauauauguaugacucuaaauaugagucaaacaaugcauuuuuagguugaccauucaguguauuugccuauagguacauaacuaaaucagaaauuugaaacauacaguauacucagacacagggacucaggaaaugaaauucauuaguagaacaaggaauucuagcugcacaaaaacaacaucucauaacacuuccacguuuagguuuaaaaacugaguaaaaguaugauuuaaaucugagcuucaaagaaacugaaaacaauccacauuguuuuggaaucccguguuugcaaagucugagaauauacgguagaauuuguuaaggguuagacagguaauuauucuaagugguaacaucuacagaaucuauggaaacgacacuuuugauuuacuuauauucaaauaccauuuacugaauacaguugucugcauuuuccaggcacggugguuaaguaugagggagaucucagaaauauuuauguaugacuccuauuacaagaugugaucuuuuucagacaaccaccaguaagcucuggauuuaugucuucaagaggaagguauaaaaguccucaagaaggcauuuaauuacgccugcaaucucagcacuuugggaggcggaggcuggcggaucacgaggucaggagauccagaccaaccuggcuaacacggugaaagcccgucucuacuaaaaauacaaaaaaaaaaaaacauuagccaggcaugguggcgggugccuguagucccagcuacuugagaggcugaggcuggagaauggugugaacccagaaggcggagcuugcagugagccaagaucacgccacugcacuccagccugggcgacaaagcaagacucugucucaaaaaaaaaaaaaaaaaaaaaaaaaagaagguauuuacaauuuucuugugccugccaaagugcagaccuaagugccaggucaagccauacaacauuaaaacuuaaaugaacaccuaaagaugguaacuuaacaaaaauggcaaguaaugcccccuagacuccaggccugugaccacccagccacauuuuauuacaaaggaaagauuuaaaggugagucaugguggcucaugccuguaauaucagcacuuuaaaaagccgaggugaaaggaucgcuugaggccagaaguucaagacuagccuggguaacacagcgagacccugucuuuacaaaaauuuuuuaaaaauuagccacacaugguggagcuucuguagacccaacucucaugaggcugaggcaaaaggauugcuugagcccaggagguuggggcugcagugagcuacgacuggaccacugcaugccagccugggugaaagagcaagacccugaaaagaaaagaaaagaaaacaaaagaaaagaaaagaaaagagaaaagaaaagagaagauuagagaagagaagaggggaggggaagagaaaaggaaaggaaaggaaaggaagggaagaaggaaggagggagggagggaaggaaggaaggcaggagagaaagagaaacagagaaagagagagagagagagaaaauaaauaaauaaauaaauaaauccgaguuaagaauuuaacaggaauccuuagaucaaucaacaacagugaucugauuuuugacaguaaaauauuucuuccuaauccaguuuuuaauuuuuuuuucaaaugaacauguugccuaauuccauaugaagcaaugcggaggcccacaauaagcacgauuacaaccacucuaaaauuauccccuuugauaaaagaugacacuucggcaaacauucuugccacugccuuuccugugauggcugaugagacuaaacugagaguuuaaauguacauuuguuaaagccuccauucagcccucagcuuauuuuuagucccaucaauguccauuuagcaaagaucuuacuuuagagauuggacuuucagcuggaacgcuucacaaguuucugcuauaaagauucuggucucagcacccaccagccuauccuucucuggcaaaugaucacacggcuccucuccugaaagcguguucuccaaaaaagagaggaaccaaggaacuuuuguucugcagagauauaaaaaaaaauuuccugacaagugccuugcuaagauagagaauuuuggcaaauagaaaaugaaaacgcuaauaugaauauucuuuuucaaaagcucuuuguuuagagaggaagcucguucuagugagaaggcaccacagugacucgcggcucuacccucucccuucccagcagugucacccugaaccagccgcuccaucucccgagguugcagugauaucaucgguagaacaggguaaauaguaucuuacgucuuggaagaaugccacgagcucuuuaacggcuccucauggcuuucugugcacuguaacuuuauccauagaaagaaaaaucaaaauggugaggaaaaucggugcaaaugggugacuuucugguuaaguugcauaaaaugcacaaacaauuccagccaagauugagugagaagaacuggauuuacccuccugccugaaccaccaauaacuggacaauauauucauauacaaacagcguuucuuuuuuuuuuuugagauggagucuugcucugucaccacacuggagugcaguggcacaaucucggcucacugcaaccucugccucccagguucaggugauucuccugccucagccuccugaguagcugggacuacaggugugcgccaccacaccuggcuaauuuuuuguauuuuuaguagagacgggguucaccauguuggccaggauggucuugaucucuugaccucgugauccgcccgccuuggccucccaaagugcugggauuacaggcgugagccaccacaccuggcauaaacaacauuucugcaagacauuagacaucaggugaaggacacugauuccugaaaaggggaaacaaaugaggacuuacagcugccaaacucauggcccugaauuuccaggucaugguuucagguggggaaacccacacagagccuagaggacucguggaguggaggacaugaaguguguggagagaucaagguaguuguaauucacaggacaggguauuggugaggagagaguugcuccaaaagagaauccagagaugugcagagugaucccugagaauauagcugaguaaugauggguacaugcaugugaaagaaacugaagccagggggaaaaucaccaaaaagaauuagcauuaacagugcuugguguucacacagggacaggaauaaugccucuucccacgagucaggugagaaaacuuaacauucaugguagaugacugagaagggucuugccucacuaguaaggaauaacuaguccuaggcugauaacugcuucuaucccaccuaacaaaucuaaaaaugcaaagcucaaaaggaucaaacuguuuccaaguaacucaacuaugugacagaaaaaagcucaagaauauuacaaaaacaccuagcauucaacagguuuaaauucagcguccgacauuuaauaaaaaauuaugaggcauaaaaugauacagggaaaugccacauguaauaauaagcaaucaaaauugauucaaaguugacagagauguuagaauuagcaaacauggauauuuaaacaguuuucauauaauaacuguauuccauagguucaaaaguuaagauacagacgauauuauggguguuggggguagcccagguuaaauuucuauauacaacaacuacaguaugugaggugauaagaugaaaaacggccagauggaauuaagggcagacugaaugauaccauggcauaucaaaauuaaauuguuaaaaaccagugauauagagaaaacuguaaaaacagaaaaaaaagacauguuauuuuuagagaaauaaagauaaagauaucaacacaaauaagacagcagaguaucaucuuucaggcagugaaagagaaaccucaauccaguauuuuuuacccagcaaaaauauuuuucaaaaccaaagguauaaaagggacauuuuuggucaaagccaaacaaagauuucaucaccaacuuaugugcacucaaacuuuuuuuuuuaaagagacaggaugcccuuugucacccagaugggaguacagucaugcaaucacagcucacugcagucucgaacuccuggguucaagugaucuccuaucucaaccuccugaguugcugggauugcagguacaagccaccaagcccagucucuaagacauuuuaaaggaaaucucucaggcagaaggaaaaugauaccagcuggaucugcgcaaagaguuuacagcacccaaaaugaugacuucauggguaaacauguuguuuuuuuuuuaaauuuacaacucauuaaaaaauaacuguuuaaagaaaaacaucaacaauguaguaaggaaaaaguaugacaacaaccgcuuacagagagagagagagaugaaaaauggaaguacuuuuguaaaguacugucuguggagugguauaauaucauuugaacugacauaacaucaucgugacaaguuuagaauguuuucuauaagccuaaagcaaccaguaaaauaacaaacuaguuauaacuuauaaacccacaaaggagauaaaccaguaaaauaacaaacuaguuguaacuuacaaaccaacaaaagagauaaaauagaaucauaaaaaauuucuaauuaauccaaaaaaaaaagaggaaaaaagaagaacaaggaacagacuggacaaauagcaaacaaauaucaagaugacagauucagugacaaccauauccauaaccucauucaguguacauggucuucccaauccaaaggaaaacgcaagacccaauuacaugcugccuacaaaaaauacacuucaaauauaaagacaaacaaggucaauaagaguauaaggauggaaaaaugcaccacauuaauauuaaucaaaagaaagcuggaauagcuuuauuaauauuaaaguagauuuuggagcaaaacauuacaaaggauaaaaagaucauuucauaagaagaggcucaaggagggccuaacagccuggaacauuuacacgccuaaaaacacagccucaaacuauacaaaauaaaaacugauagcacuguuuagaaaaauggcccgguccacaaucacaggcagagcuuucaauaucccuugcucaaugacaaacagaaagaacaaauggcugggcauggugguucacgccuguaaucccagcacugugggaggccgagguggguggaucaccugaggucaggaguucgagaucagccuggccaacauguugaaacccugucucuacuaaaauacaaaaauuagcugggugucguggcucaccuguaauccuagguacuugggaggcugaggcaugagaauugcuuaaacccaggagacagaaguugcagugagcugagauugcaccacugcacuccagccugggugacagagugagacuccaucucauuuaaaaaaaaaaaaaaaaaaaaagaacaaguggacauaaguuacacacucaugcucagaaaguuccuuccauuccaaguaagcucucccacagaaugccggugaacacaucuaugccuguaccacucaacaugccuuuuuggggcaaugaucacugaaaaccaugaauaagucucaucauugcuaaugucaugacugacaaaugcuuccccacagagaauauggccacugcucugagauggaaauuugaguucuaauucuuucugguccacuaaaaauucuuacaacucagccaaaucucaacuuuccuugaccuuaguuauauuauuauacuuacaugaugagggggcugggcaagguuacuucuaaaauccuuugccauggucugaauguuugugucucucccacccccaauucauauguugaaaccuaagccacagugugaugcuauuugagggugaaagcuuugggagacaauuaggcaugagggcagagccuucaagauugacauuaguacccuuauaaaagagggcccagagagcucucuugcccauuccaccauaugaggauacagcaaaauacaaacaaaaacaaaaauaaaauaaauaaaagauaaacaaaauuuaaguucuaugaaccaggaagcaaacuuucaccagacaaccaaguaugcugaugucuugaucuuggacuucucagccucugcaacugugagaaauaaacuucuguugcugauaagguacccagucuaugguauucuguuacagcagccugaagggacuggaagacauccuuccagcuuuuguguucgaacuugaacuaugccaucaauugucaccaccucaggaauauuaaaucaagucagggcuugcaaugugagucccugggaguccugucuggcugcucuguggggaagugugaguaccugcuguguagagaugaccuuguggagguagcugcccugugacccuuugaccuucaagauggaauggacagggguugaaccucugaauaacagugcucaaggcauuucuccucauucuuuuuguauggcuuccaguucccagugccccacccuuacugucugugcugugaccugaagugugaacucggcugcagcgagaccuacccgaggaggaacagccugcagagcggugauguaguucuccagggccaggcggcggcggucauugagcauggcuuccacucuggccaugugugucuccaccagcugcugucucucguuggcugcuuccuguuccaaagauuccacuuucuccuggaaaugcugccaucauaaacacauauguccauggggacugaauaaguaggaugaagcagcaauuucaagucuucuaaaaaagacauccuauuccauuuucuucuagugcuaaaaaguauccuaaagacugcauagucauuccaacauugacuaauucuacguuuuauagcuuacuucacuuucuugcacucuccaacccucaucaaaccuacuuucucauugaaaaucaguauuucauaggcucucugaaggcugauuugacuaauaacuuuggauaaauauaugcacucuugaaacucuuauauuacauauuaaaaaaaaaucccucucuuacuaacaguaccucaaguaauugaccauaauaaacuguugguuuacuuaagguaauuuugagacugguuuccaucaaaaauucaaauucucauaauuuuugcuggagggagaagcagcagaagauuguggugacugaaaagauguauuauuaauaaaaaguagauugcaaguuacaaugugaguuuuauggcaaugaauuauaacuugaaauaauugggagcaaauauaaggcaggauuuaaacaacucaauuacuagacaaugauuaagaacagcugaaguucaugggacuaugaacaaucacacgugaggugcuggcagauaaagguaaaccugcagacacucauuaaaaagacugcuggcaugugauguuugguaggaaauggguucagguuuuaccuggauaacugccuucuuaucagcuuuaggcaaguucuuugcuugacguucugccucuucccauucucucaugaccuauaaauuaaggaaacauuugaauuuaaaaucaucaguucauccuuugaauacagacuuaauaggauggaugauuauguuuuuccucuauuuuugucauuuuagauauuuaaaaaauuuauuacauaccccuuccuaucugaagaauauuugaccucccacuaggauauaaauaauuaaucacagcaguauauuaaacauaaauguucauauuuauugcaggaauauagcuuuuugagucaagguuggucuuuuuuuaccccgagaacugacagucauuugauuugaugugaacaaauaccaacuauucauggaaggcacacauuaacugaacaaggucuuccaauauuaaacugaacaccuaaguuuuacucucuuaugaaagcaacugaaaccauuuuaaacuguauauuuugacuuuaaagaaaauaugacauuuuaugugugugugugucaugaauacaaugccaaaaagcaguacauaaugggggaagaaaaagaagacuucugcugucuaauauccuaagaccuaucccccuuuaaagaacugauggggaauuaaggcccuuugagcuugccaaccuaagucaugaacagcaaggauuacgcuaaguccuuccaaaaacuccaagaaaacauguaauauucugaaugcagcaaacauguauuuuuuuacaaguagcacuaauuuaguaaccaacugcuaugguuugaauguaaccccuaaaaagcauguguuggaaacuuaauccccagugcaacaauguugagggguaaguccuguaagaggugauucagucucuguccucaugaguaaauuaguaucauuauggggggaguggguuuguuauugugagaaguggguuguuauaaaacucaguuuugcccuccucuugcccuucuuccuuccaccauauaugauacagcaaggaaguccucaacagaugccagcaccauguucuuggacuuccccaccugcaaaacugagagccgaauuuuaaacuucuuuuucuuuacagauuauccaggcugggguauucuauuauagcaacacaaacugacuaagauaucaggugaauguguuuuguaggaaaucaaugcuuccugcucucaacuuugauguucaccuggauuucccugagagaaguucacucauuaaccugauacaaaaaguaaaagucugcaccucuguauguuguucaaagaaaauauuaacuuccuaccaccuacagcugccuuuucaaguguaugacaaguagaauuuguuugaagugcaacucugaacuagguaaaaugaagaaagaucaaggaaacaaaauauugguuuggugccagauguguacuugcauacucuguguacucccaaagcaugagaaaacuugauuacuguauuauaagagccuguuuuuuguagguacuuagccuuaaggaauagacucuucuaacauacuucaagaugggaaagaaaaagaggcuuggaauaaauaacuauagauagaagacuucuaugagacaauacuauaucaaaucaccauguggguuccuaauuacagauuuuauuguccauuggcauucauucuuuguauaugauaggcaauuagcuucuucuuguuguuuuuguaaaaccauggaggaaacaagauggaauaaauauuucauuacacuugaaaagcauaucaaaaauaaucucaagguucacagcaaaauugggacaaaugcccugcugcaaugaacaagaauagaacauggaagaaaagaaacauauugucccaucugcuuuggugcuucuaccacguuaauaaagggaaccugugggcaagggggaaauggaagaccaucuuugcuuuauagaugagauaagccuugcaauauaaauauuucaauuuccugcuuugggaauguucacaguggugguacucuaccaacaauucuucaagcaaggaaucucaaaauuaguuugagauagaaguucaauguucuacugcaaugugagaacugauuucccauauuacauuuacauuuuuuccauuuuaccucauacacuuuaagaaacuggacuuuaagcuuuaagcugggggaauccaugaaauaauuaaagagauuuauuuagcuaaugaguugcaaauaagcauuacuauagaaauuaacucacauuuugauuuucagaacaauuuaacaauauccuauacccccacaaauaaacaaaucaccugcaccaucccacuaagacucuacugcaaaugaauacacacuauauguaggcugaccaucucccugugaacagugaauuucacugugggacugauaacaaguagcauuacugcugacccuguauuaagagcuuuacaaaaucuaucuaauuuaauugauuccucacaacagcuugugagauuagccagggccaucccauuuuacgaaccagguuaagguaccagcucgaggcuaugcagguaaaaaagggagagggaagaauauaaaccaagaucucuguggcucuaaagaucauguuuuuguacccugugguacccaauuuuuuauuauaaaauaaaaaauucauuaggugagcuaaguuuauuuauauuuagugacaggagaaaggggcgcucuuaaaauguugcugcuuaucuuaaaaauaaaaaccuaggccaggcacaguggcucaugccuauaaucccagcacuuugggaggcccaggcggguggaucacaaggucaggagaucgagaccauccuggccaacauggugaaacccugucucuacuaaaaauacaaaaauuagcucggcgugguggcacgugccuguaaucccaguuacuggggaggcugaggcaggagaaucgcuugaaccagggaguuggagguugcagugagucuagauugugccacugcacuccagcugggugacagagcaagacuccaucuccaaaaaagauaagaaauaaaaaccuaugaguugggucagcuuucaauuugaaggacuucauuuuaagcauauacuaaaaguaguaaguuuauaaguaauaaaagugcucacacaugguucagcuguagauuucuauuugacuagaugcuagucacgacauauagcaacaaaaaucuacagguuuagcaacaaaaaucuacagguuuagaguuauacuccacaauggcaacaacaaaccaaaauaugaaaaaauuccaaaauccucuguauuuguaagaaaacauauaacaaaaacuacaauaaaacuuaauuuaaaaaaccgcacaauuuuuaaaauuuaaaauucucaggaccuggcccuugcaguggcucuauggauucuuauaaagcaauuuuccacugcaggcacaaagguaucaauuucauuuggauuuaucaaucuucaaagacuuggcuguuucaugcagagaaaaugacuacuacuaaguagagauuuaagaggcaggcaaguuuaaaguugaaaagucccuagauuucagcaccacagacuaugaagauacauauugauuucaggugucucacauuccuaugaccacuggaaucuaguagacaacauucucugcucugggacaacaucucuuagguuauaucagauauaucugaugacuaaaagaugaacaaaaucuacaaaaucaugaacuaagucacaaguuacacagaugugcuaaaaguuaaauuauuauuuuaaagaagaccugucacaucuaaaacuaacagagaauuugaaauaaguuuucuuaauaaggucaaaaaugaacaagauauacuaggagaaaaaauccaggauuaaaaaaacacacauuaaaaaaaaugcuacaguggguccacgaugaaugcagguagcaggcuucaugacuugaggucucaagguuucuauccagcuuggaaagauaaugcagguguguccagaaaucacuaacaaaaccggggagcaaauauuuagaauuaaaugaaagguaagagcaaugacugccugucucauucugaguaugaagugggguguaaggaaugggugagaugugucagcgugaagaagagugggagggcauuuccagaagaacucaaugccaagggcaaagggaagcccaagaugagaugaacagacgaugagcagaguggccugaucagaacagcagcuuaacgcuguacagaaagcaaggguagcaguugagaaggaagaggugguaggaagaccagagucaggguacagugguaggcgcugaaaaugacaagcugagcauucgguguuuauuuuugucauuguucuuuuuuuacgacuucaugugcccagaaguggauuugugagggcacaggaagccucugaaagcuucauaaagaagggagauaggauguaaauucaaaugaggacauuucaguggcaauaaguaugauucauaguccuccaaugcuuuccgaacagugccugugucuuuccuaaggaaagaucugauuuucuuggcaucaggugaaaacuuaauaauucccuguggcuagcuuucuaguucaauuagcuguuagguuuucaucgugggcagccacuagaacugcacauuauauuccagagccaaaaguacugugauuauaaggcuuuuuuccucuuuauguuauuauaccaaaguagauccaaguauuguuauucaucuuaaggcaaaacaaacaaacaaaaaacaaaacaaacaaacaaaaaacaguaccuguguuguaccuuucuagauaaacuauuaguuuuauguuuucaaggguagauuuucuuauuauucaggugaggccaagaggucaggagaugauuaucauggaaaagacaguuuguuacucagcucccaagaagccgguacaugccacuacaugcagggucauaugggaagcaccaggguuggucaggaggggaaaacaugagcaagagccuuuuauugugguuuucauggaaagaaugagcgaagcaggguaggcggguuuaggacugauuaguucaaauaauggugauggggcaugagguugucccuaguggucugguaccugguccuggggugauuagagcaggugaauaguggcccagaguauaagaaggugguugggaguaaggagcuuuugauugacugguuugcaugggaaagacaugcucaggggccauucauuuggcccugggagggaggaaucuuccuggggucagcagggacccagaucagaaauuacaggaaagauuaauugucuacuaaagacugacugugaucuuagaaaauacgcagcagucuaauucauaaauugcauuuaaugucucucaagagauuaagcaucugugcuaagacaaaaauuucuccuaucuucugauauuugccacagaauauuaacacuaaaaaugaauggcuuacuuuaaccugagaucuuuauucauucacuuuuauguccuacuucuuuuccccccacauucacuccuagguuuguagacuacaaaucagaaaagugacuggaaaauaauaaguccauauuuguugauugaaugaaugaaugaaugaggaaucugagcaagggcuaaaauccuccauauuaucaaacuccaauacaacauccagugccugguagcagacauagcuucaauuguaguugauaguauauauggauuagccauguuuuagacauaaguuauuuuuuaauuugcuuaauuaaggaccugcuaaaaaaaaacaaaccaaaccaaaacagguuuuuuuuuuuuuuuuuuuuuucagcaaaguauaaugaaaggaguacuguacuaggagcaagaaaggccuggauucuaaauguugucucuggcucacugauuuugcuuugugcuaaaaugggaagccacucucucgaaccucuauuccacuauguaucacuuaggagacuagaugaaauaaucacuaugguucagcucaguuuuaagucucuaugauuuuacagacuguaaacaaucguagguucacaauuauaacagucugggauuuaauacaaaaccucaucuuuacuaaagagcauuuugauggauuuuaauuuacaacauguugauuacagguacuacauauacacagaauaauaaugccaaguaccuuucuucgccagagagaauguuacagacaucauuuaauuugugcuuacaaaauccaacuauaccuggauccuuccuaggcagcauguucacggaggaugcaaaaaacccacaaacugugcccacacaguaaacauuuaaaauuagaacuuuacaucuuuaaagaucuugauaaagccagcaggccuguggggagacugaggcagaggcaagcucagguuucccaauaucguagggcugaaugauggaagagccagacuuaccugggacauucucucucggugcuuggccucaagccucucuuuggcuuucuggaaaugggcauguucauucucauccccaggugucucgagauacuugucaacggcaucagggguacuggcugcuguuguaggaacuauaaaguagaagagaaggagguuugagaaaaaaaagccaacaacaacagaauaauccacucguuuaauagaaagccguauuuucaguuauuucucagaacagagaauuuaguaaagcagcgcauacaagacguuaaugcuguuuaagagaacaccaugagacacugugcagcacaguaaggaugucuuucaccacucccaaguacagaaugaaggaaaaaucuuuaaaaugguccauuuugcaauuauagcauuagaguucuuuacgaaacaagcaugcaaagagcaaaaacaguuggugcugaagacauguuuuuccaaauccccaugcuuuccuaaauuacuauuuugcaauuuugaaaguaaaugaugauaucaucaauaucauacacuaagacuccugcagaaaccacagauaucuguaauuagccuguuguagaauaacggcaccccagggaaaagguaaauguaugauguauuuagauaacugaauuacgaagacaaccuucaugagacaguauggaaacacgacaaaagauauauaaacaucaauaaacacauuuuugaaucacaaaaggacuuuucugucuucauaaauuugacaauagucaaugaauucauuaugcuaguugucaaaaagaaagugauuucuauuuugaauucaacuaauacugcuaagcaauauuugaauugcaacauauacugcuauauuauguaacucaugagccaagugaauuauaauaccuauacaagcaauuuuccaaaagauuagugagaauucagaguauuuaugagcuuaaaagcaaaaagaaaaaagaauuuugacuuaagaggaagcauauuuaacauaaaaaacaaaaugagacguuuucacuaucuuuugagaucaaaucaauuguuucauucaaaagguuauucaaauaucaccaauguuccaaguauuccuauugaauuauuaccuguguauuacauuugggauauaauaucucaaagaggacuucaaugagaagaauugauagcuaagucauuuugaaacuaaacuugaaguuaaauacguuuucuacauccuucaagaaaaugucuggaaucuuaauccaaagucuucaaagauauuaacuaaaaccggaaggcuguuaaauaauuaaacaguaucuuucauuuuaaaaagaaacauucguuuugauuuuuucccuccacuucaauccugauuaauaaucauuuuucaaaaaauaaaagcaguugagugucuauccagauguugcuuucaaguggaaggaaggaggcagggcauauuccuggugccuuuacacagcugccccugucuucucuguagcaaaugagggagugguguuccuucuuacauuggcagcaacgggggaaggaaggaaggaaggaaagagucauguggggauuugcaauuaagcacauuuggauuugaaucccauuucuuuuucagaucagcugugaccuggggcaggaaacuuaagcacuccauguuucaauuuuuuuaucaaguggugauaacaugccgcaggacaugauaggagagcugggaaaaugagauaccauaccacauguaagucauccggcagagagggugacacacaguggagcucauacauguuaguggccuucccuccuccucugcuuaauacauccuguucaaaucucagagcuaaugcuaaccacgggaaaguucugauacuuuuauucaaagccacugaaaauguuuugguagaagagugcaauaauaaagaaaaaaaagaaaaggacaaguuuuaaaauuuuaaaaauugagaaaaagaaacaaaagaaaauacaaacuaacaaaaaauaaauaaaauagaaccacugaaaaugaauuacacacaggaucacaaagugcaaccuacaggaaaagcaguauguauuuuucaaaaaauguuagguguagcccacauaaaaaaggccgaaaguaucaaaaauaaguaaauuguuaauuuguaagauugaaacaauaauuuugaauauuaagaccuuuuuggaaaaaagguaaauguuuuucuccauagcuucaagcaaaccaauaugcaaguauuuuuaacuuaaucauuaaguuaaaaugaauaaaugcuaaauaccacguucuuacugacuuuaacuuaaugauuaaguuaaaaauacuugcauuucaaguucccaacuugaaaugaacaugguauuuagcauuuaaaaugugcuucccuagcuuuagucaucuucucaucuuaacugguagagcucaaaugagaacaaguuaaaguaaaagcagaaaauaaaacaguaacauucuuuugcauaguccaaucuggcagaaugacauguuuaggcaaaccauauuuuauguuugaaacaaaugaaaauguauaaauauuugggguuauaccugcugaugaagauagucaucuggcuguaacuguuauaaccauaacauaagcaccccuuuggaaaacuggaaucauaaaacuuacuauauaagaaggaaauuuuuucagcuccuaugguuugcgaacacugucuacuguauaaaggaaagaagauaaacacuauaaucugaaucacuauaaucagauuggccuaaguagaaaugcacuuagcaacauaauaagagaauaaccauggaacaugaaugugagguauguuuaauaggacugaggauauuaaaaaggauaaaaaccuucuuuuuaggcacguggaaaugaauaugaauacuauauuaccaacuuaauccauugaauccagaaauauuucugugguaauuaauuuucugugccaacuugauugggccgcaaggugcccagauuaaacauuguuucugagugucuuugugagggugcuucuggaugagauuagcaucggaauuggugcacucaguaaaguaaaucacccuccucaacaugggcaggaaucacccgaucugcugagggucugaaaacaaaagggcagaggauggagcaguucacccuuuuuauuuccuggcugccugagucaggauauuggucuucucuucucccuggacugaaauuuacaccauugucuucccugguucucaggccuuuagauuuggacuaaaucauaccaccagcucuccugggucuccaacuugcagacaacagauugugggacuuagccuccauaauuguugugugagucaauucugcagaaucaaucucuuccuauacauauauauccuauugguccuguuucucuggagaacccugagcaauacaauuucucuucaaguaaaucuuuguuaacagucccaguuauuucccauaguugaggaagcugugucucuuuuuaucuuuaacucaaauuuuucagccauucauacaaacuccccaucucaauuagugugagugaaauuauccuauauucauaccaaccagcaagccagauuacugucuagucaagcagagaaggauagcauaugcugauauuguuaaaugaauuuaauaguucauuacuacugcucugcagcuggugaggaucccggaaggagagagcaauuuuaagguggaguauguccagagagcucaacuucuauuucgugaauauccuuauauccuaaagagauuaaauucauaggacugacuaccauuuugugauuauguccacagaaggccagagacacgugugcccuauguccucacccaucaagguacuuccuuuugggaagggaguggggcucaaggaaugucaggauaugucacaggacacagaggaaacaggaagcuguauaucagcaggucacugauauauuuaagguacuuaaaacacaggucacuguaaccacuuagaaaguggaaacaaacuggcuuuaggaggguuuauuucugguuuugcauuuuaaacuaccauaaagcaguuuauccugcucacagaccucugagauuccacggaaccucugauaaaggcuaggauuucggccggaugggguggcucacaccuguaaucccagcacuuugggaggccgagguggacggaaguuugagaccagccugaucaacauggagaaaccccgucucuacuaaaauaaaauaaaauaaaaaaauuagcagggugugguggcgcaugccuguaaucccagcuacuugggaggcugaggcaggagaaucgcuugaaccugggaggcggagguugcggugagccgagaucaugccagugcaccccagucugggcuacaagagcgaaacuccgucucaaacaaacaaacaaacaaauaaauaaaggcuaggauuuccauguuggcacuccgucucaaauaaauaaauaaauaaaggcuaggauuuccauguuggccaaaugauaacagccucuuuucaucagagcccaccaugcuaggcauguucuguguucucguuuaauacaugggaagaaaaaauuacccuauuuuauugcguagaggcaaaacacuaucauuuaacauacccauuugcaucccuaaacacacacaaauaaagucuguuaagauuggguaagccauaaaaaggcuguaaagcuaauuuuuagaguaguaaagggccaauccauccacaugcuggggcacuguaaaggguuuuuguuguuuuguuuuguuaaugagcagcacaacuuggcaaaacaaccauaugcuuuguuaugauguccguuggcuuguuuucuaugaaacagcuguuccugccccaaacacuaucuggcaaauccuucaacagaaguugggucauaaagcagggaucaagugaaagagcccauggagcuagaauauggaggacguucuggccuugggucccuccuucagccugcucacucaugccuucugcaagcaagcuggcuagguauguuccccccuccacaaaaaccuagacuuaaaacgagacaaaacacaggguucaauauccuuagcucuagguuuugaccucuagaugccuagucauuagcagcaauaccaacaucacaugcauaagcuuuuaacuuuuuaaaugaccuuuguauuuuagucuccuaacagagccuugaggggcaugguaggauauauaggcuauuaccucccuuccuuuuaauagugaucauguguaucuaaacacucauaacaaaugaaaaaauguaacagaaaagcaguucuaauuccuaguacaucacugcuucaaggugaauauuugcuuccaaauauacaguggcauuuuggaugacuaacgccuucuacauaagccacauccuuauucuuugccacccugggaagucagagguaucaaagcagcugagacagcagcucugacauggacaaacuauccugccuuuagugcgccuguucauucuuuuauuccuccagcccaccaacauugcagcccuuauuauaugugaggcacaugggagaaaccaaugagaaaaacaugaaggcccugauccugguggaauuauauucuagggaaagaaacaauuaccacaagaauuuuuuaaaagccaguaagucauauuguuaauaugugauuuguauuauggagaaaaagaggaaaaagaaaaacagagcagaguucagaaggaucgggagagcugaggggagaggggaaagguagaccgcaguaagugagcgaccaggcagagucuuaagugaggaggugacauucagaucuucccagcuggcugcuggaaggacauggcaggcagaugacaaaacuagcacggaagcccuaagaguugaagcuggcuggcaaauuccacgagacccgcauggccagagcuaaagaagcaagagaggaaguagugggagaggcagggaagaaaugggggacaucauguacagccuuaaagccacaguaaggauucugagggaccagcgugggcuguuugagggggaguauaugugauggggcguuuuguugaaggaucacucuggcugcuaugggacaaaaguagaaggaagaucuuuuaagaggaaaagacaggcugggugcaguggcucacgccuguaaucccagcacuuugggagucugaggcgggcagaucaccugaggucaggaguuugagaccagccugaccaacauggagaaacucugucucuacuaaaaauacuaaaauuagcugggcgugguggcaggcgccuguaaucccagcuacucgggaggcugaggcaggagaauugcuugaacccgggaggcggaaguuguggugagccaagauugugccauugcaccccagccugggugauaacagcgaaacucugucucaaaaaaaaaaaaaaaaaaaaaggagacaaagaugaagguggcuuggaccaggguggcugucacaggagguuguugcccucagcccccuucccacacgagaagggucagauucccuucuuucucucacaccaaaaugcuguauuaccucagggaacugaauaugaaaacgggagaaacugcuuucacaugugcgugagggcucauuucaauuuuaauacugauacacgcaugcuugucacaauacugccacuucacacugugaucuauucucaauaccugccagagcucuguuuucuggggugaaguaacacagguuagcuuucaguuuauucauaaauggcgaugcugcacccaacguuccuaucacaaaaugcuccuccaucacuggggccaagacaccaacgaaacauuuuccauaccuguguuuccucugagaaaacuguuagcauuugaagggaaguuacuuuaaaacaggggaaaaccugcuaauaucuucaggaugaggcagacgucacucuccuagccugucugaagacuccuuagaggauaauccauuaaguugaacuguacaugcacugauuucccucauuuuaguucugauuuuguaaucauugcggagcacuccauuucauauucauacuaaugugguacuucacauucauauaagaauguggggucaaaauuaaaggcacugugaaagauugccccuaucauuuugauaugcauuuguuuccucaggcuucuggggugacccauaauuuuacagucacaauggacucaggacacaaaagaagaaaugacccaccuucaaacagcaaugaccguggccaucuccaacaggccagaaggcugaauguuucccuaaaccaaggcuuaugaauggcauucagucgauauauuaauauuagauucuaacaagaaaauuggguuagucuccuuucaucagcagaaaagcaauuuaucucuacagccuugguaacagaagauuaaaacaaauuaagaccuauauaaaucauugccuuaucauugaaaaugcuauuugauaccgacccagcaauguugucauuugagauggcuauaauuuaggaaaggagacaaggaggaucauuuauauaugagugaaauauaaacuuguuagcguucaugugaaacuuuaaucuugaaacauggcagagcuuuccgagugccaugcuuauuauaacuuaaaaaaaaagugucucuaaaaaaaaaaaaagugucucuccauuuuccuaauuucaaaaauaguuaaaacuccuaacgcauucuacauucaaauauuuauccuaaccauuaaguccaagauagaggagccauuuauaacaagaaaauacaguuugugauccuccaguguaauaccagacucucuuaaaaacaaaauaacaacaaaagaaaaaacaaaggcauucucccccuaauaugcccuuguauuacaauuuuauagucagugcaaucauaguugguggagaacacuaucaaugcaucacauggacauaagguaauaaaaauauaaucuaugauguguuuacucuagucaagcuacauuucuuuuuuauguccauggacacauacugacaugggaauuuuuucaaauauaugaacugaaugugaaggaacgaaugcuggcauuauuuuuuuauuaacaucuauucucuauucagcacaucacacuaaaacuuaaaagcaaccucaaguuugaaucuaaaaaauauaugugaagcaauagcaauaacuggcguccagaauggguuaaccuuagguuauuguuuuuugucaauuugucagaagcuauucuugacuucguuaauggaggcacauaaagaaauaaccugucauagcugcucaacacucaauagaugaguucgaaaagucaaaaucuucaauauuguccaguuucauauaaacuguagcaguaaaaggagaugguacaguuaaccucuauggaggucuuaaggauaaagcugauuucauuuuaccccagccuuccagagcaaucuucuccuacacuucuauauuuccuuuauaugguuauuuaccucuacggcauaucugggucucaacucauuaauaaaauuaucagguauugauagccaguacucagauuccuuugcuggugucucucaaaauaccuggccucgcacauccuggggucaaaaauaacugcugcacaguucacaacugcaaagauacggaaccaaccuaagugcccaucaaccaaugagggauaaagaaaaugugguguauauauaccacggaauacuaguaggccagaaaaaccacaaaauaaaagucuuuugcagcaacuuggauggagguggaggccauuauucuaagugaaguaaucaggaauggaaauacaguauguauucccuuauaaauugggagcuaagcuaugauuaugcaaaggcauagaguggcauaauggacauuggagacucagaaugaggaagagugggaaggaggagagggauaaaaaacuacguauuggguacaauguacacuacucagugaaauggggacacuaaacucucagacaucaccacuauacacuucauccccguaacuaaaaccacuuguauccccaaagcuauuggaaaaaaaauaaaaauaaaaauaaaaaaaccugcuguauuaaaccaaggaucagcuugcuggcuaccuuuuuuuucccccuugagaugaagucucgcucuugucccccaggcuggagugcgauggugugaucucagcucacugcaaccucugccucccggguucaagugauucuccugccucagccuccugaguaggugggauuacaggcgcccaucaccacgcccagcuaguuuuuguguuuuuagcagagaugggguuucgccauguuggccaggcuggucucgaauuccugaccucaggugaucugcccgccucggccucccaaagugcugggauuacaggcgugagccacugcacccagcugcuggcuacuuuuauaaaaguaguauuaucggaacacagccuugucuauuuguuuacuuauugucuauuguugcuuucaugcuaccacugcauaguuaaguaguuaugacaaacugcaugaucuacaaagccuaaaauaucuauaaucuggccuuguaugaaaaauauuugcugaccacuuuauuaaacgauccacuuacccucuuuuggcaaauagcuaaacaacagagcagagacauaaugaacauucuuuuaccacagguagaacaucucuaaucugagaaucugaaaugcuccaaaaucugauaauuuuugagcacugacaugacaucaugguggcugggauagcaacaccuuuguucucucacagugcaacguacagaaacuuuguuucaugaacaaaauuaucaaaaauacuguauaggccaagcgugguggcucacacguguaaucgaaguacuucgggaggccgaagcugguggaucacuucaggucaggaguucaagaccagccuggccaacauggugaaacccuaucucuacuaaaaaacacaaaaauuagcugugugugguggcaggcgccugucauucauuccagcuacuugggaggcugagacagggggaucucuugaacccaggaggcagagguugcagugagccgagaucacgccacugcacuccagccugggcaacagagcgagacuccaucucaaaaaaaaaaaaaaauuguauaaaauuaucuucagacuuuuguauaagguguacaugaaacauaaaugaauuucauguuauuucaucaugaauacaucaauauuccgaaauccaaaaucugaagcacuucuggucccauuuuagagaagagauauuuaaccuguauucaaaguagauggcccuucuuuuuaaaaaaugcugaguugcuaagcaauccaguuccuuucaauuuuagggucaucucuaauuauuauggcuuugaagaaaaagccauucuuccuaucuaagcauuuccagauaccaaagauuuagcuuuucacacuuguuaaucugauagaauauacuggcacugacgugacagguaguuuaauucaccaucacaucuuuuaaugcuuuaaaauuguucucccucccuagguugguuggggagcaaaguguaaucccagguugccuaaucuaauuuggcaguuuuaguuccaaugguauugcagaaugugcuaaugggaacuaacauuugcuacugcacagugaaaagaacaagaauagugugauuaagaacaauaguucaaauuuggccaaagauuaaauggccuaggcauucagacuucugucuuauggcuccugucuuuacaacgacccugggguuaagguggcauauuccauugaaaggcugcguggugugaguuuucuacgauuugaaaauuaugagcuucugcggcaacaaacuuggaaccuggggauggaacuuggggccugacuuguuaaguuccaauucuuuucauauucucuguaaguguaccagucuguuucaugucaucuggaccauucugaugugccuagaaaucaaucuuuuucccucccucaauccugcauggggucaggccuacaccucugcacaaacuauaaggccaucaaacauaauccuaaaguacaaauaaccuguguagcaagacuauaggacaucucuacagaugguuguccuccagcauauccugggauucuaggaaacuaagaugaaacagagaggagaaagggguggugcauaggugaaccaaugacuucaaacuaagggauuugcugguuucucuucugcugccacaguagcuuacauuagagcaggaaaacuacgagaccuucaauacuauagucaggacagcaacagcaacuuccacuuuaccuugcaaauauugagagcuuggacaauagucuaacaaauucaauuucaaacaucugucgagaauuggaugaugcugacauucuaacauuucaacaugcccccaaauuuguggaaaguacacguguuuacaccaggagaguucuaucucugagucagauguggggaaacuacuacucuagaacaggauucucaaccagaaugugacccccugggcacauuuagcaaugucuagagacauuuuuaguuaucacagcuggaguuguguuaauggcauuuaguggguaggggucagggguacugcuaaacacccauaugccuaggacagacuccuaaaaauuaauuauuugaaucaaaauguuaauagugcugagguugagaaaccuugguuuaguuguuuguaccacaugucagcgcaaaugaaggagccugagaugggacacacuuuggccagaucacauggugcaaucugcugacuaaaaauuggcaugaugcucuuugagagauuaaaugccauuaaggaguuggucuguuugccuuuugggaugcagucugauggagacagcaccaggaaaaaauggucacacucucauauuuaaaauauaaaugaauccacaaauauuuauauaauuuuauugucuacaaauacuauauuuugaagauuaaaugugaaaccuuuugcacuguccuaaacccaaaugggcaggugcaaaacuaaugucagaaauuaacucagcucucguaagauucuuuaucccaaaugagaaaggguuuuuuuuuaaugauuugaauuccuauguucacgaauaaaaugaaagcucucagccuuauauuugugguuuagauuuuuauuuaaaauaacaacaauaaaauaugucccuaaaauugcaaugcucaaaauugguuuuuaugacaaaaguuugaaaccuagaaaugccugauuuauggcaaauuauuguuuuuauaaugcaaaccaucauacauuuucucccuaaguguaaucuuuuaucaguucaacugaagagcuuuuucuaucuccuuucacauuuguuauuugacuagaagcagcuuagacugagcaaccuguaaaaccaaccaccuuugugcagaaauaucauccaacuggcucuagauuguugaaggagcaaagucaaguccaaguugcccagucuaacaggcuugcuuaccuucuaguucagcuccuuuucucugaauugagucugccaucugaauuugaccuccagaugaccaugacuuuuucaaaucaaaugugcaguuugcuauaaauaagaccacauagcugcacaggcuauaaauaacuagaaauuauauguuuuuuuccuugucuguuuguacuagcacugcaaaacccuucacuugcugugauugaauagucucuguaggcagacaagaaaauauagcugcccaaagcacuucauccuccuagaauggaaaggugucaggaucccaaauacacugcaaguagauggagaaaauuacugggaaggagaaaauuacaaaagagacuuucaguaucuguuuggaacaguggaugaugaaagugguaguuacguguacagcaugaaaauaaauuuaucagacaaugaugcuuguuuccaucaguuauuaaaaauggaaaaauagaauucuuauaaaugcuaaaaugaaacaagagaaaaauaaucacuguuuuauaaaagaaugggaaagacauuuaauuuacugaugcgugcucuauucauggcauuuaggaaaaaauguuaacauucuucauccucuuuucacuguuuucuguauucuuaaaaugugcuucugaaucgcaaaugugauuucacuaaccggcaaaacaaugucagaaccaaugcuuagccauuugguguggagugcggccaaaacgucauuuuggguuucaaagccugguccugccauguucgauggcuugggacaagucacuaagcucuugaagccucauuuuuucucguauguacaaaaggaaugaggaaaaugcccacaaaguguucugaagaaaaauuaaaugaucugugaaaaugcucgguacaaugcaacucaacaugcguaccuaugucaacacuauaguggaauagcuagagcuuuuuccuagucugucaacccacuugcuguacuuacaguguuuuuagagaaaaaugcuuuuuucacaacagcaaaagaaacguuuauguugcagcaguacaaaccacauccuucaaaaguuauacauaaugugaauuauucugaauauuuuauggaggccauuaaaaaacuuuauaguuuaggaugcagucuuuuuuaaaauaccuaauccuucaucuauaauuuaucaucuuuaaaaaagauaacuggcuucaucaguuuugagaugaggguuuuuuuuuuucaggauaauguacacaaaugcuaauuauaaaauaucuaaguuacaacugaaauugugccucuucuuccagcaaucauaagcauaaauggcauauaucaucccuaaccuaacacuggauaaaucuauuucuggauggaauccaaauucaaauaugaguacuaaaaccacauuuuaaaacuaaacucgucugauauuacaacugaaauaaaaacaaaacauaagacacuguaaguaaggccugcaguggcuggacaaugcauuucuuuauaggaggcucuuucucuacuuccuagucaaaaggugagcaccucuaaccuaccauuaugccuucugggagaggagaaagagggguuccuaaugucuaaaagugacccuucaugucuaaaguugaaaccgggucuuauaacacacauaaauugaaaucugcguguacgaauuaguccauguacuacaauaccaugaauauuaaguacuuuuucugaggaaacaaguuacuuauguauuauagucucuuguuaaaucauggcaucuugauguaaccgaguacucuauuuuaaagaucuuucuuccuuucuuuuccuuccaguuuuaguaaugaaaugguaaccuuugcucucuuucuucccaccaggcacucccugcacagcgcuuccauuaucuaauuacgcuuauaauuauuauuaaaauuauuaaugcuugcuuagaaguuccacugacugacuuaggcaccuucagaauucucccucaucaggagaucaccucaaggcugcaguuaauuuacaacccgauugugcgggaugcgccagcccacuuaccgaacuggauaauaacucaagucuuuggaacaaguccuguauagcagcaccuccucaccccuccuucaugcccugcauuccaagcuccccuuuuuaagccuuuguuuuuuaauccaaaauuugagaugguugcuuugaggcaggagccuggaccauuuccccauugcuagcuuugcuaaguaaagucacuuuccuuccacugcaccuagcccuuguucuucaguucugcaaaagcagugagaggcuaagccugcucucaguuacacugauagcuuuuaggaaauaaaauaguaauggcaaauacaauacaaugauguuguccauauaauauucaauaaaaccagacuaaauaaaaaggaaauuggucagaaauagaagaaacuuagucaaugaugcucuuagcccaacaucucaagcugucuggcaaaaucagauguaauuacaagcaagguaaugggaagaaacauuuuacuaagacagguguucaagaaacacaaaaccaugcaaagaaggugaugaugcuggaguuaugugaaccaagcagcauccuccuccccucuucccuucccucaggugaaugacaacguacguuuaacaggaucucgggcaagagguuccuggguagucuugaguaaacuuugggacacuauggaaaaaauaagagaacauaacuaaaaacaaaaagagaaacaugggaaugauggcugaaaugcacgaguccacugacaaaaaaacaaccuaacaaacaaaaucacucacuuagguuuggucccuccaacaaaaccaaaaugaacauauaaacauaagaucuauuuucguaagaaguuaacauuugagaaugcuggauauuuugucucugauaguauauccgaguaacaacagguuucuuaacagaagaggauuucuugcuccuuuugugccaaauauccccaauucccuucgaugcauuuuuucacaaaaacuccauuuauuucacucauucauaggacagcauguggcucucggcucuggcuguuugcugaggcuuauacucucuacuuauucuuguccacccaucuaacugaucuucagccuuugccuucuucauacauuauucugucaccuuuccccucuaaaaucaggcauagcuagccucaucuaauacaucucuguugggagcaucgaccuuuugcaaaacccucagcaaacugugugccacccaggacaccuggacaggugcccacuggucacucccagcccaaacugaucaaagggagagaguguuaggugaagggauggcaguacuggggugagguggagagaauuuuaaucucuugaagcaaauucaucacugcuaauaauuaaaaccaaauaaaucucuuauuaccaaaaacuauacaugauauuucagaaaaugaauccacccagggaaagggagaaaaaaguugcaaaucugccaggaaaccucucccaccggcuaaaccagugagaaucacuguaacaaaaggccuuuguuccaaaggcugcaggcaacagaauucuccauuguguucgcaauaccugaccuaauugacugcuuuguuugaaacugaagaagggaguccuuugauccagaagcugcaaucauccaaucagagccagaaaaaaaaaaaaaaaaagcccuugagguuaucaguuccuacaccuguucacacaugggacugaagcagucaucucauucacuggcgauggcaggagaccaacaggagcuuuuccauuacauuccucuuagauccugggcuccuuuacaguggggguauuaauggugcaggcccuucuguuguuuugcuuaauccuaagaucuugcugcaaaacaauuuauauaaucccuaggaaucucaggcaggaaauguggcugccacccuugcaacacagcggagaauuaggcaggagucucucaaaaaaguaauacacaguuauugaguuucauuuuuaguuaucaagcugagcugaauaauuacuucuugaguaguucauacuuccuacucaugaacaacaacaacaaauaaauaaauaaauaaauaaauaagcacaauugggaauuucacuuggaagucuguuaacgacauggaagucucacaucugguacuggaccuccugagaauuaccucuuuggggaaaauuucaucaugcacuuaagucaucaugacuucauauuuuuaucccccggaauuaugaaaagcuuaauguucaagagaaagacuuugaaaauuauguucuggcggggugcaguggcucacgccuguaaucccagcacuuuggauggccaaggcagguggaucacuugaggucaggaguucgagaccagccuggucaacauggugaagccuugucucuaccaaaaauacaaaaaauuagccgggcgcaguggcaugugccugugauccuagcugcuggggaggcugaggcaggagaaucacuugaacccgggaggcggagguugcagugagccaagaucacgccauugcacuccagccugugagacagaaugagacccugucuuuaaaaaaacaaaaaaaauaaaauuauguuccucgagccuuaugucauugaaaguuucucacguuaagucaaaaguuuucuucuacuuucaagagaagaagcagaaguuugaccuggcaaaugucugugugcugagcucggagggggcaagacgggcacuucuacccuccggcauuugagaugcaugagcucaauucaaucacauucccucaucagcacaauaaaagacauguuaugaaccaacuuaaagguauucaucacagccauacaccuuaucaaugcaacucaagcugcaucagccaggcuuccagugguagacaguaucugcacagguagugcacaugcauaaacaugaacacauauguacacggacaaacacauaaguaugcauuugcagaaacggcuggcugcagaagacaaaacagccacuccagcuuuguuuaaaagagaagcacucaaaagucccucuggauugcaagacauaugugcuacagcuaggaagagaacacauccauggccaugcuuuaucagggaaagacggagaggugugcucaugauugaacauacugcggagacucugagcaauuagagaaguggacagaaaugugguuagugguagcaacaggcccauucccaagaaccaggaaaaucaaucuguuacaaaaagcagagucaguggcgagagagacgaaagguggccaggcucgaagaaggguccacuuacuggcgcugccacacacggccaugcaguacucuucugugucaaaguuguuccgguugccgccacauccgccguaaaagaauggggcacacuucccuucagucacaucaaaguaccagcgggagaucauugcucggcacggccccgucucggcuuguucagagcacaccucuaaucagaggagauguggggaaccacauuuagcaugaaaaggcacugucucucuguucauguauacacguuuacuucuuuuaauccucccaguggcaaccuggacugguuuauuaggcagcaucuaccaaacauuuacugaggaauuuaacuggccaccaggacuagagauuuacaccucucagagcaugcacugucaucugguuuaaugagugcaggacucgguagcaauaaaaggauuccggccaaaggugaaaagaucauuuggcugcuuuuagaugaguaugaaaugacggaagguaucugcacaucacaacaauccuccaucauaaaaaauaaacuucucuuuuuaagaagucaacuuucauguaaggaaacugcuuugguuaugaagcgaaaguuuaagcccucacaaacaucugauugcuuuccuuaauaaaugauugccuuaacucaaauauaaaauuaauugcauauauuuugaauguuuuccaguguuggaagcugucuguccauugacuuuaucuggaaacacaugucauaucuguaaaugugacuuauacucaaugacauuaacuuaagaccauucauuuguauauuaagauauguacuaauauaaacggucuuaaauuaacucugauuuaagaccauuuuauuuguauauuaaaauauguauuuauauauuauacauuaauaauuuaauuacauaugcaugaaguacaucuauaacaacguauuauuaauucugcuauuuaauugauauuuauauauuaaaaaucuguauuauuuguauauauuuacauacacauuaaguacaacuauaacaauguauuauuuaauuaugcuacuuaauugauauuuauguauuaaaaaucuguauuauuuguauauuuuguauauuuaccugacccuugggcaggaauguuccaaacaauaaaacgcagucaaucaacuccaacugauuaauacacaccacgcacuguuauacauuaaaacacaucuuaccugucaacaugucuugccacccuccccaagaucaguuucacucaucccugauugccucaaagucaaucagugacccauccaauugcauguauaaagucaauccugaguagaauuauaacucuaccucccauguauaucccauuuuuauuggaagugaaacaacagcccaauucucucucuggguuugugcccugcccuugcuagacugacgccuuagcacacacagaugucuucuuaguuuuacugacagaggaaaaaacaccuuucuaaaagaugaaagccacgcaucacccauuacuuccaaguuaggaauauucaacagauucuuuuuuucuuuuuaugagacagggucuugcacugccgcccaguggcacaaucuuggcucacugcaaccucuaccuccugaguucaagugauucuugcgccucagccucccaaguagcugggauuacccuuguaccagcacgccuggcuaauuuuuugguauuuuuaguagagaugggguuucaccagguaggccaggcuggucuugaacuccuggccucaagugauacaccugccucagccucucuaagugcugggauuacaggcgugagccacugccacugguccuucaacagauugauucuaauuagccaaucaaagacaaggauccaucacaucuaggcauggcuuugagcuucacaggccagaagcugcucugucaguaacucagaggggauauggucccuagacccaauucacuuuuaauaaaucagggugccaguccuuuaauuuuggaagauaaauaaaauugcgaaguagaugggauacuuacgucaacaaguugguuggguuucauccuguaagaguauuguguacagaaauccaauuugcuuugggagcguggacuuugaaagcagcaguacugagugagauggccuuaaugauggaugauaaugagguugaugcuuucguagccacguuuccaucugaaaaccacgugaagagugucagaucaucuucauguccguugcauggcgcauuucuccugcggaguguuugacaccuucugggcuuagugcugacugucccuccuguugacaucaucgugaugguagccaccucugguuuuaccaguacuuuauugcaucuacugaaagagcaacguguauagggaaguaaaacaauaguuaguccccauuuguauugacauuguggaucccaucaacuauagccagcaguggucucugcucccagagcuuaccuucaguuguaacaaacaucuacagcuucacuuugcuuuccuucucuguaucuccuucaccaauguguacauauucaugucacaugcucuuuaacguuucuaagacacaacaauacccauuauuaaucucuuacucaggcaguguuaauuccaauaagacugcaaggcagcagugccuccagagccugcacugugccgggaauuggcacugggauugcaagcaccguggucauugcuaccaagggaggcacagaaucccuucaccccauagucacgggagcauuggcaacaaaauuuaccaugccuuggcaauuuaugcugacccucacauuuuggcauuaaaaaaaaguaucaucuuagaguaccaaauaugugucuucuuauagaugugugccacgggccucgcagugaacaucacagcucugcagaugcacaaaccuugucuuuaugagucuauauauuaaauaaaagugguagaauuuuggaugggugcaagucaaguaaugggauaaaagaaugaugaucgaaggagaugauucaugauaacuaugugcccuuaugugaaaccuagcaacaauuucuuacuuaugauaaaggcacaaucuccccaguccagaaucuaaauggcauuauauuaacauuuuccuauaccacuaauuaaacauaaugcuacauucauuuuauuuucuucugccucauucuauaacagcuaugaaaccauuuguuauagcuaauucguagaagccaggcuaaaugagcccuaaucaacuagaacaagcauucagaacucaaaauccauuuacauguuaauuaaguaaauaguauaagcuacacguugagccuacaacucuugcuggagucuccagcuguaagagccuuaacuccuuccuuucauaaaggccaagaaaagagugaguuagucccuauucggggaguguugguugguucucccaauccuguuaggggcaguuggcacucuugacuuugaacggcccccaagaguuucacugccuugguggaguccaagugggcaucaugggcaauagcaacagaucccacaauacucaaauacaaaaggcuaccugagauaaugcggucaggaauggguguaacaguguauguuaauuuaaugucaaauacauaauguauggagaagauguacgugaggcuggaagaacaggacugacagugugcuuuuguuacuucucaaucucuaagagacagcuaccuuguccaacugguucucaucugcugacauggaggaugagcagauaggccuucucuuaacaugcaaccccucuccuggugaaaaagagcuucucguuauaauucccccaauugucagcaacccugauuccccaucaccucaacucucacuucccaacacuuucccucagggaaauaaugagaacagcaacuuccuacagcagugaagcugacuucggagaggacugggaaaggaauggaacguauccucuaucacucauaauuauauuccuacucuacuacagggaaagggaaugcaacuguuuguuuucucugacuuuuuugcuaacccuuuauuauuccagaacaauuuuccauguaguagaaaagagaaucuuagccuacucugggagaagcugggacugaggguagggucagcaccagcgauguaugaugcuaaugcuuuuacacaaaguaugaauaagcacacaagaaauggccagugccucucagaagugaacacggagaagcagcagcauagacuuggguuaaagcaguguuaagggauuaaugucaauuuaauaguugugauacuguacugagugaagacuaugcagggucucuuuguauuaauucuuuuuuuuuuuuuuuuuuuuuuuuugagacagagucucgcucuguugcccaggcuggaaugcaguggcacuaucuccacucacugcaggcuucgccaagcuccgccucccagguucacgccauucuccugccucagccuccugaguagcugggauuacaagcacccgccacacaccggcuaauuuuuuucgauuuuuuaguagacacgggguuucucuguguuagccaggauggucucgaucuccugaccucaugauccgccugccuuggccucccaaagugcugggauuacaggcgugaggcaccgcgcccggccucuauuaaaucuuucaacugcauguaaaucuacaauugucucaaagaaaagauuuuuaauuuuuuuucuuuuuuauuauacuuuaaguucuaggguacaugugcacaacgugcagguuuguuacauagguauacaugugccauguuguuugcugcacccauaaacucgucauuuacauuagguauuucuccugaugcuuucccucccccaaccccccacccccccaacaggcccuggugugugauguuccccgcccuguguccaaguguucucauuguucaauuuccaccuaugagugagaacaugcagaguuugguuuucuguccuugugauagucugcugagaaugaugguuuccagcuucauccaugucccuacaaaggacgugaacucauccuuuuuuauggcugcauaguauuucaugguguauaugugccacauuuucuuaauccagucuaucauugauggacauuuggguuggugucaagucuuugcuauugaaaagauuuuaaaaagcccacauaaaaaaaugaauauaggaagccaggcaugguggcucaagccuguaaucccagcacuuugggaggccgaggugggcagaucaccugaggucaggaguucaagaccaacguagucaacauggcgaaacccugucucuacuaaaaauacaaaaauuagcugggcaugguggcgugcacauauaaucucaccuacucgcgaggccgaagcacuggaaucacuugaaccugggaagcguacauugcagugagccaaaauagugccacugcacuccagccugggcgacagagugagacuuggugucaaaaaaagaaaaaaauaaugauaauauaggaauauugauuuuucaguuugccuaagaguucuaaccuugucucuuuacuugacucagagauuggaagauuuggaaaucucaguuugagaaaauuuccuuuacaucccucucuagcaaugggauauuaguaagagaucuaaccaaucaagaugcucaccaaguagaagaguuuuagagcacugagaccugaaacacaucuucaauaagccgcaucuaguuucauggaagauaaaaauaucucaagagagaguucaaaugcuuauguuuacauuuucuauuuuucucaauagcauaauuucuuccuuccuaaucuacugaaacuucuaaaaacaucagcaaaaaaccuguuucacauuaauuacuauuaucacucaguggaaauuuauaaaucagccacuaaauguagaggaugcaaaauuagaccuuauauaacuaaacccaaauaagauuccugugaaaauuaaaaccguaucuucaaaauguauacuauauguaauuauuaugucaauuaaaaauaaaguugaaaagaaaacaaauuuaagaaaaaacaaaaaacucuucaucugccuucuuuguucucuucucaaaauguaaaauacugagaaaacuaacauuuugaaaucauuuuugaaaucaaacuuauuuuuugauuuccaauccaccuuucuguucaaaguaaauaucagagauaauaauggagaaaauuuguucagaaaaauaaaagcaagaauauuuccuaaagagaaauguuagaaacauaggcaaagacuuacauggcuaucuaaggaaccacaauccuuuauugauguugaauuucuuacacuuucaagaucacaaauagcuuuucugauauucacuuaucugaauucugcuggcaaggaagcauuaugccuucuuuuguaacaacucugcucacucuucaagacaaaaugccauuuacuacacugaaaugcugguguauacgaaacacaaagcaaaaucaugugcuucuaauaaaacuccacgcauuuuaucuuuguaagguaggcccuugcugagauuugugcucgugucaacgcuacauuccauuuucuaaaaaucaguauaacacaaaauaauacagaaucuaagccagagcucccuggauuauacaaaaugauuaugcaauucauuguucaaaaaauaaugcucaaccacaaaaaauuaguucugaauagauauuucaaauuggagugaaauucuuuguggacaaccaagguuagaaagcugauuuuacauauuuuaauaaauuuagaaugaacacaguugugaaacuggcaaccagaauggggagaaaaucuccacuuucaaauguacgauaauuauaaugccuucuuaugaagcaaaguuaacagauuagcaaauaauucgcuguaaauaaagugguaaauaaagaauaaagcugguuuuagaauaaagcaaagcugguuauuauuauuucauuuuuaaucauugaauuucaaguauucucagccuacuggaauguaugugaaauaaaacuauauuccaugugauguauaaauuuuaaauuuacaaauuuugggaaagcagucacaaucaaacuagucauuuagagagagcuaggaacuauauuuucugaacuuuuuuuuaaaaggcaacauuuuauagcauuauuuucuccauacucuacaagaauaucuacuuaaacuucacauaauacaacuauuucuccuuucugacagaaauucccuaucuugaacucuuuuucuccaauuuuaaguagaguaaaaagggcaaauguaagacaaauauaauuuauuuuuguaauaaguuacuuccuuaauguaacaguggaauaaaaugaaaacgacauaaauauuaaaauccacuaaguauacaaaacuucaauauuucaaauaaacguuauaauuuauaaauauaauuauaauauauuagauuauaauauauuauauaaaaacuuuauaauuuauaaauauaauuuauguauuauauuuauaaauuauauauuauauacuauauauuacaauauauaauuauauaauacaauauacaauuuauauacauuuuauauaaauguuuacauaauacauauaucugucugagcucaauguaguucauaacaacuuuauuuuuuuagccuaaguuauugcuguaauucuaaguauuacuacguggugacauuucaugagccuaaguuauuaaaaucaaacuuguauucuguugaaaaauaagcagacaauauuugcauuugauucuacugaugaaaaaauuuuaaaagccaacacaauagaaaacugguuauuuuuuaagaacgugauuuucccaauucuggaaccauguacuuuuaauagaaaagaacauuuuucaagugcuuguacguaguggcaagcagucgucaaaaaacauguuuagaaaauuacucuaauaaggcaauaaauuaucaaauauuuaugaccuaguaaucauauuuuacuaaauagaagcauguaaaauuaggcaagcaagcuugaacugaagucuuaugacaaaucucacuuaagcuccaaauauggauugaaauacaaacaaagaugaugcaaacagcugugcaugcuaaugaaagcacugcuucaguacaagaggauggugcuaauuugucacggaaguaacuagaagauauccgcaguuggcuagccuuuuuacugaauugcguuaauucucucaggcuagccaauacaucugucauucuaauuauaccugacccaauucucaucucuccaugaugaaagauuguuuauaaaaugccaccugaaggagauuuacuuguaaaguauuuagacuaaucaggacucccgugacgguguuagggaacacucacaaaaggguaccacugugguuuuuccucaaccuuuguuuccuguuuguuaugggaauaaacuugcucuucacugagcugcgugguuagcgugcaacaggcuauuaacaagaagcucaaaacucgggauaucauguccuguauuggaaaauaaggggaagugcuuugucuuacugaaugagagacaggaguaugcugggaaacuggcacugucuagaaaaacaaacaaauagaacacucuugaguuacaguguaugccaacugccaugguauaaauacucccaccauugguauuucaagcuacuaauggcuauggcuuacaaaauuccucuauacuguaauaauuagcuuuuacaggcuagcaggaguuggcuacacuaccauguuaaugacaggaaauaggggcacaagugaacacauguagggagacuguaagaguuuuucgguuuccuuggucuugaggugugaauuuaaggaaagaaaagcucaguagguagaugucucaggauugccucauacuuguugguaucuguaauauaccaagaacaauaacaccaaagguaagaaugguuuuccuuuucaguuucuuacuuccugucucaaugcugcaaaucugcaccauauggaaggcaggagacgcuacuagagucuacuacucaaaauaggaucauggaccagcagagucaacaccaccugggacucaggccccccauacagacucaacaacgauuguuuuccaagggccuuggauaacucgaauggauaucucaguuugagaagcagcaugaucaaccuuaucuuuuaaaugcaauagauaugucaaaacgugagacauaagauuuaaucauuuuccaaaagaaguaguuagggaagaauuaguaaaaguugcauagguuuuggcuuauuaaaagaaguacacauauauuugggaaaagacagauacaacaaaauuaguagucuuaagauucaaauauacagcucaacaacuuaauuugaacagauugaacagauugucuauacacauuuauuuuacucugaaguucuguccuaucucaagcaacauuaaaacagcuucgauaccucugccuuagauccaguaccaagaucauaauuuucuuacucauauuaagacuauugaaauaccagacuucuuagaaagcugaauucaagugguaucauuccuauaauaucccagaacaucagaaauaucaaaguuuuuauuuuuacuuguaaaaauaaugaagaaagccaagaucaauucaagggcuuagaauauacuuccuuuuucuuuucuuuucuuuuuuuuuuuuugagacgaaucucgcucugucacccaggcuagaguacaauggagugaacucggcuuacugcaaccuccgucucccggguucaagcgauucuccugcuucagccucccgaguagcugggaccacaggugugugccaccacgcccggcuaauuuuuguauuuuuaguagcgagggguuucaccauguuggccaggcuggucucaaacuccugaccucaggugaugcacccaccucggccucccaaagugcugggauuacagcaugagccaucgugccuggccagaauguacuuccuuauaccacuucucuguaaagaaagaauuagaugauauuucuguuccgguuuaaaaaaaaaaaaagaaaaaaagaaugccucuagauguaggucauggguuggaaggaugguccuacuguuucauguccuuuucuggggaagacugacauguacaccucuccauguuaacuggcuucuugucacaaucucuagcaggcaaacaaccuacagauuccagcugggaacagcagugucucugguuacagcacagaugcuaaucaccauuugcuauuuuauaacaguggacaaggggagagugaauuccuuuugaacaaaaaaaaaaaaaaacaaaacaaaacuaggaaagcaguuuaccuccauaucucacugucuacauggcaaauaugcauacgcaauguuucaagucaacauuuuauguuguuuucuguuucuaaauaaagcuacuagacuacauuacacauuuuaucaaauacuugcuuuuaccuuacuaaauguguauuuaucauauuugcuuuggcauauuuuuguuuauuuuacuuuuucuuauacaauaaaaaauguucacugguuaucuacaaugugcaaagcagugauacagaaguuagagcuuacauuaaaaugagaccagccgggcuugguggcucaugccuguaaacccagcacuuugggaggccgagauggauggaucacuugaggucagcaguucaagaucagccuggcuaacauggugaaacccugucucuacuaaaacuacaaaaaaaaaaaauauauuagccgggcgcaguggcaggugccuguaaucccagcuacuugggaggcugaggcaagagaaucgcuugaaccugggcagcagagguugcagugagccaagacugugccacugccuuccagccugggugacagagugagacuucgucucaaaaaaaaaaaaaaaaaaaaaagcaaaaaacaacaaaacaaaaaaaacacacaaaacuuagcuggucuuggugaggcacaccuguaaucccagguacucggagacagaggcaggugaaucgcuugaaccauggaggcagagauugcagugaacugagaucgugucacugcacuccagccugggcgacagcaagacuccgucuuugggggaugagacacaguauugcacggguauuucucuguucacuuuuuuauuuuuauuuauuuauuuuugagacggcaucucagucugucugccgagacuggagugcaauggcacgaucucagcucacugcaaccucaaccucccagguucaagugauuucuuugccucagccucccaaguagcugggauuauaggcacccaucaucaugcccggcuaauuuuuauauuuuuaguagagacgggguuucaccauguuggccagguuggccucaaacuccugaucucaaguaauccgcccaccucagccucccaaagugcugggguuacaagugugagccaccacgccugggcuucuguucacauaucuaaagcugcucaucacugcagaucucaacaccauagcccaguguuuugcaaccagagagagucuauccccuacuccucccaggggacauuuuugauugucaucacuugggggugcugcuggcaucgaguagaggcuagugaugcagcuaaacauccuacaaugcacaggacaaucauccgcaacaauuaucuggcccaaaacaucaauaguacuaagguccagaaacccugccauagcccaagcaaacaccagaaggauucgugaugcauuuuaguaacuuugcccaccaagacuacugggcagcagucaccagcacuucagaaauccuggguaacaaaugcuaguaaauuuccagaacagaugcaaucauaagaauuggcaagcaagacuuuucuuugcuccuaucaugaaacauaagaaccuaaagucacgugcaagcaacauaaaauugccauccauauucugugauacuugcauauucugucuagaaauuauacccaauaagaacauauauaaauuuaagaaagaggcaacccuacucucauaguuaaaacaccugaacagucuuaccauuauuaucaacuaaauauagcguaaccuuuaacauuuccucugccuuaaucuuuuuuuuuuuuggacagggucucacugucaccaaggcuggagugugguggugugaucacggcucacugcaggcuugaccucaccugggcuccagcgacccucccaccucagccuccugaguagcugggacuauaagccugugacacuacagccaaaacaacaauuuuuuuuuuuggucucccuauggggcccaggcugcuugcaaacuccuggggucaggcgaucauccugccucagcuucccaaagugcugggauaacaggugugagauaccaugccuggccuguaaacacuuuuuuuuuuuuaacacuguaaaagucucaauguuuacaauuugggcugcugucuugaaaauuaagggauucucuugagcaucauuuuuauaugagauucauucauucuugccuccccuugacuuuuuacucuucuacuaacagaaucacaaaaagucaggcauauuggaagaggugguuggaaaccaaagaugaauuuucaggagggcaaaaugguuaaaggcugagagaagcagcugguuaggcuguaagccacucugcuuuuggaaacucauuguucugcaagggaacuaaagaucuccauucaaauccacagcuuuguaaccugcucaaggaaucugacuguacuuaaucagaccuauggcuuggcuaaaaacgugugcccgguugggugugguggcucaaaccaguaacccagcacuuugggaggccaaggugggugaaucaccugaggucagaaguucgagaccagucuggccaacguggugaaacccaucucuaccaaaaauacaaaaauuagccaggugugguugcacacaccuguagucccagcuacuugggaagcugaggcaggagaauugagaauugcuugaaccugggagacggagguugcagugagccaagaucgugccacugaaucccagccugggugacugagacuccaugucaacaaaacaaaacaaaacaaaacaaaacaaaacaaaacaaacaaacaaaaaggugcacccagcuggugcaguggcucacaccuguaaugcuagcacuuuaggaggccaaggcagguggaucaccugaggucaggaguucaagaccagccuggccaacauggugaaaaccugucucuacuaaaaauacaacaguuagccaggcgcgguugugugcgccuguaaucccagcuacucaggaggcugagagaggagacucacuugaacccgggaggcagagguugcagugagccgagaucgcgccauugcacuccagccugggcgacaaacaaaaacuccaucuuaaaaacaaaacaaaacaaaaaaagugugcccauguaaauguaugcauguuuaaaugaaccugaaccucugaguugcuggauuucuucuuugagguuugauuuuuuuuuuucuuaauugcaaauucuugaguugaguacaguuauugugccugaggcaucugcacacuuuuuuuuuuuuaaagcaacugauuuggggaaaauaugagaaagacuaauauucuuuaaaaaucuaguuucuggccuuuaauuaaauuggacuaaaauuuuauuuuuaauaaaucuagauauaauuguauuaaaaugccuuucacugauuacuucugcuauucuauuuuuuuuuaauugguaaagccagguucucacuauguugcccaggcuggugucaaauguguaucuuugugaauauacuaaaccacugaauucucucucacacacacuucuauauggcucuauucccuagucucaucacauuuuaagcaaccuaauuaucugagugggcuuucuagauugagaccauuaaacuacacggaaagaugcuuguccauguccugcuucacucugccucuaucaaaguguguaucaaacaccucggaaucaauggcugccaugacauggggcacaaaauaacaggcuguuaccugucacaucuauggucagugcugacacuaguucucuugacaucauuagcaagcaugcuacaacccgggcgagaguagaagugcauccucuccaucuucaaaacacaaagguaaaggccugaggcuugcucuauaaggaggagccauuacccuuuugcccuguucccaaauacucccuggagcuuuaguuucauuuuuguacagcaugcuacuacugaggccuccaacugaaguaugugaguucauguucggguucacagcaaguuaaguucacaguuuaccccaagcuuuguggagaguuaaauauuaaucauaaguaaaaaucccguuagugaauuauaggauaccuuguaagugucauguccauuacaaacaaguaacaacagaggcaugagaauuaagcuaagcuuuguuucuucuccccuugagaucaauacaagcuacucugauuuacuucaaguauguauugcauucauucuauuuggugcucuaucacccaguaaaucccuauucuuccuuuauaauuacugauacgccaacuucucugcaacauaguaggugaaaacuuuuguuccgggcugagcacuuucucuucuccaugcugccaaaauuccuuccuaggcaggccugagagacucaucccucucaaggacaaugcagauauggcuagaagcaaccugagcaagccacuuuguuccuaucucugugcccccagcaaccaaugccaugucugguaccuacaagugccuuguggauauuggugaaauguauagcaauaaaucaaaugguacuucucccagauuaauugucaccagaagaagaaaaauaauuuaauucugccaaggucaaucacuuagcccaauauaagcaauauucggaucaaaccuuuuagcuuuuaucaucacaugagacggugaaagagccaucuguaucagugucucuaucuguucacuuaacagaagaacucccacaaggcuuaaaauaccugcaagaaauaaaacucuaucuugaaaugcaguggcaucuaauacuaucuuauccaauuuucagcuggauuuaaaauuuaagugcagauauuucaauauacaguguauauucacacaaaaaaaauuuaagcaagaaauguuucuuuuaaucauaacauaauguucucucuaaauaucagcuuuauuauaccaauagauauggauagguuacauuuaugccuuuuauaauuaaaagucaacuuauugguuuaccuuuaacauuccucauuaguaguaaacauuaguuugcuaauguuucaaaugcaauggaggaucggaaugaugauauaaccauaacuaagagagcaacuaagguuaauugagcaguuacuguauaccaggaauuaugcaaaguguuuccuauaaauuaauuaauuuaauccucacaaaauaguuaaauauuggauaggucuuauuaaucccuauuuuacaaaaagaagcaaugaggauucaagguuauuugauuuauacaaauuuacacaguuaguagcuuguaaggcaaagauuugaaucuggacagcuugaguuuguaaauugaacacuuacugggcaugaugguaagcguuuaacauaaguuaccuaaagucauucuuacaagaaacaugcaagauaacauuaccaucuacacuacacacauaaaaaacagguuacuuaacuggcccaaggucauaaaaauucucucaaacacuauacuagucuaucucuaaccaaaaaaaaacaaacccuaccucaaaagaaaucaacuugauauggcaguaugugaaauagaaagaacuucacagucaccgucuuauagugagaaucagggguuagcaaaugguuuacugaaaaggccagauaguaaauguuuucaguuuugcaggcaaaacaaucucuuuugcgauccucaacucuacuuccaaaacaugaaaacauccauagacaauuuuuaaacaaaugggaugggcugugccuaauaaaacuuuuguguagaaaacaggaaaacaggcuauuuuuggccccaauuugcugacccuugaucauuacucuuauuuguggacccccgaucauuuuucuauuuuuuuuuuuugagacggagucucgcucuugucgccaggcuggagugcaguggcgcaaucucagcucacugcaaccuccgcaucccagguccaagcaauuccccugccuuggccaccugaguagcugggauuaugggcacgcgccaccaugccuagcuaauuuuuuuguauuuuuagugaagacgggguuucaccauguuggccaggcuggucucuaacuccugaccucaggugaucugcucaccucagccucccaaagugcugggauuacaggcgugagccacagcgccagccugaucacuucaaguaaaaauucuaaaaauucagaaaugcacaguguaaaauaauagaugaauauaugccuauaucaaagguauaugcauuuacaagggaacacagguugaaaugaauuuguguguauuuauaaagaaaauaaaaaguguaauuuugacaugaguguagcagaaauauccuggccuaucuagguccaaauucugauuucaucacuuaaccaguuaugugacccaggacaauuuauuuuauucuuuuuuugagacgaaguuucgcucuguugcccaggcuggagugcaguggcacaaucucagcucacugcaaccuccgccuccuagguucaagcgauucuccugccucagccuccuguguagcuaggauuacaggcgcaugccaccacaccuggcuaauuuuuguaucuuuaguacagaugggguuucaccguguuagccaggauggccuuaaucuccugaccucguuauccgccugccucggccucccaaggugcugggauuauaggcaugagccauugcgcccagcccaggccaauuaaaaaaauuuuuuucggccacgcaugguggccuguauucccagcacuuuguggggggcggggggcggggggcggggggugccgccaaggugggcagaucaugaggucaggaaaucgagaccauccuggcuaacauggugaaacccugacucuacuaaaaauacaaaaaaauuagccgggcaucguggcaggcaccuguagucccagcuacucgggaggcugaagcgggagaauggugugaacccgggaggccgagcuugcagugagccaagaucgcaccacuacacuccagccugggugacagagcgagacuguaucucaaaaaaaaaaaaaaaaaaaauucuuggccuuagagaucuuggcuuuaaacggggaaguaaaauuuccaccacacagcauaguuacaagguuuaaagacagagaaucacugcuuuaaagcacaagaggccuguuuucccggcuacuugggaggcugagguuugaacucaggaguuugaauccagccuaggaaacauagcaaaaucccgugucaaaaaaaaaaaaaaaaaaauuuaaauuacauuaaagggcaagaguggugaccgugaaaaucuauaucugcaacaaaggcuucaaaaaucugccagucucccaggagguaaaaugcugucugcucugccccaacgaugccuuccacaguagcaaagagccuagccaucagcagggguacaacgaauaguugcugaauaaauggaacauaaggaagaaauguccaguuccucuggacagggcacaauuggcuagauuaaauaaaagauuaugccauuuauuacaauacccauuucaaucagaauuuagaauuuauggcucaaucaaaacuacccugauaucucugguuucugaaguacaaucccuucuugaagaacagaaaauuaggagcaaguaucuaaauacaccacuguuguacucaaaucgguaauggcuuauuccacuagaccaauaaccaauaauauccaaguauuuuuuuaacaaccaaagaugacaauaagcccccaaaaccagauagaucuugcaaucgugugcucacuuuuauuuuuauuuuuuugagacagggucccacucuguugcccaggcuggagugcagcgaaugugcuuacuuuuaaacaauaauuuuauucuacuggaaucagugacagagaacagacaucuucucauuuggguaucaucgauucuaacacaauauggcagagaagauuaugacuacgcuaaaagugucuuauuuuucuucccuccauuucuuuccgguuuuaacggguuaugaaauuauugaguuuuuuaugaagcacauuaaggacugguaucaguagcaauauguugguaaugaugacaauuuucuuagaaaggauggcuguaaaucacauuuuguuccagguacugaaacacuaacacugaaaacaagauuguaagccucccugcaguaucucaucuuugcaagucacuucuaauuuuuauguugaacacagaagcaaccuacuuguaauuagaguuuuacaaaaugaguaaucaccuauggcguugccauugcucucaauuagggaagaaccacaagucaccuuuuguaacagugaggaggaggaaaaggacucuuugcagcugaccccuuuaacguuacccucuaaaacaucuacuucuuuacuggaauuagcuacaagcacaaaaaaauuaucucgcaugggcacaacugaccauaacauguuucuguuaggcccccuuucccaggaagacuugccucaauuagagcuuuuguucaggaguuugagguggaaugaauggaccugcauuaaagauuccucuauuucuggggcauuaacaguugcuaucucucaaugaccagguaucuugcuuucagaagguugcuuuuguugcucuucuugccaacaaaauuauuaacuuguuauuuuuuaagguucauuucuuuuuugccuuuagccuggaguguuuuguuuaugaaauucuuuuaacugccuucgucuuucuacaggaaauaaaacaauacaacaucucuguguuccgucuuaauaucaaauaauacuaccugcaaaacucaagcaaaaagaacuggacuaaugcagacgauaaugagaccaauuuaucucaagcaaauugucuuguucuagaauaugggccuaaguuuauguggcauccucucauuguacugcauaacugaugucacuccuuguucaccuguuaccucaacaguacuagcaucaaaacaaaaucucuuuauugucuccuggaaaaaucugcagcgcacaguagcuucugaauuaauauuuguuaauuaaucaccugcaguuaaugcccaucuuugccagccuggcauugaaggucucuauauuuuggucccaaccuaaaagacaucugcucuagcuuaaauuggaccaauccugucuccuaaauaugccuuuccauggcaccacauuuguuuugcuaguccugaugacucuacagcaaaauccacugguagacacaccacccacccacacuuuuggcucuaguucaaaugucaugcucuccauggaaccuucucugaucaauccagaaguucccucuuacucucggaggcagguucuguguucacauuucuuacaacacagauggcuuuguacuucuuugacuucuauuuccuaagagauuuuaacauccacuaggguuagcuggucugugugugcucaucauccauuccacauggccuagcaaaauggcuuguaccaagcaggugcucaaaaucuaauguuucaaguaaaaugggacacuaaacugguucuauuaaacagcccagcuugauggagauucaccaaggacuuucagucccacugcaggcugcuagcugcuguaauuuguauucacacuucauuuagguuucgagaagagaagcccugaaaagcuguccuucccugcuacaggcaucaggcuaacaaguucauuugaccagaucugccauaguugguccuaacaguuguaugaaaaacacccugagaaagcaugucucaguauuugaaaaauggugguuuaaacaaaaugcgcauuuacuagcacauuuacuuaugugcuaaagugaguaagaaacugucauuaaguagggaaugauaaacuuaauccaucuugcacucuguucuuuuuuuucaaagaacauguaaaacuuucaauaaauuuuaagcuaacgcugaguguuuaauucagaauaaucucaauuuuaaaagcucaaguuaaagaaauguagaaccucaaaaauacuguguuaagugaaagaagucggacacaaaagaccauguauuauaugaucccacuuauaauaacaguccaaaaaagggcaaaucuauagagacagaaaguagauuaguuguugcuuggggcuagaggugaguagagggcuuaacugggagugaguaugugugaucuuacuggagugacgaaaauguucuaagauuagauuauggugauaguugcacagcuuggcaaauuucuuaaagccgcugaauuauauacuuaaaagcaaaugaaacuuauauguaaauuacaccuuaauaagguaaaaaaugcaacaaagggaagaaaauacuauagugacaacuaugaauauaguugagggagacaaaauagcccauguuaagcucuaauagaacaauaaaucugaaaucauuaaacuuuagcaaaaagugagagaaagccacuuuuuguaaaugcuguaacauuugugguugaccuuuauaaguauuugcaguacauuaaaauucagucaaguacauauucauucaaucuagcucuagaagcaucuuuuacuaucugccaagcagauggcagauaugaaaugcagaacucuuuaaggaacaaaugcauacucuuuaaggaacucaauccaacaguuuacucguuucuguaacauuuggucauuuaauaucaacugaauguuuguuuuuauuucauggagacaaguaugaccuuuaguucuuuuaguucacaauauuugcaacacaaacauuaauucaauagagaaagucuaagacauuaauacuauauuuacuucuugaagaaagcacugccguacuucccaauaaaacaauguaaacucaacauaaaucaccucuguuaaaauucauagcauaaaauaaugcgauacucaccaaaucuuuuuuuuuuuuuuuuuuuuugagacaaucuugcucugucacccaggcuggagugcaauggugugaucucagcucacugcaaccuccgccuccuggguucaagcaauucuccugucucagccucccaaauagcugggauuacaggugcgugccaccacgccuggcucauuuuuguauuuuuaguagagauggguuuucaccauguuggccagacuggucuugaacuccuggccucaggugauccgccugccucggccucccaaagugcugggauuacaggugugaggcacugugccuggcccaaaucuccuucuuuaaugaaaucuaaucacaacuacucacucaacuaagauuuaucgaaacuacaagccaggcacucugugcaauacugaauaaaaucaaguccuuacccucaaggagcucaucgucuaggugguaacagacaauauuauauaacaaacacucacugccaaaggaauaccaaggagucaccuaacucaguguuugucaaauuagaugacuaccugguugggcggagucuuguagaauuaacuugggauuugccaagcagcauauacaagguacaaaacaaacuguauaauaaagauuucacauuauuugaaauuguuugcuuguuaaaccaaaaaaauuucacaagcauaagaagccuuuuggaaaaaaaaacauguuuuugauuggggaaggcaguggugcuaggguggauauuuccaacucugguauuacgcuuucuuuuccuuggggguggggggaauccaagcaaaugguggauuaccucgaaccaccucuuccacagacucuguggugguggugguggugguggcaaugcuggugguucucucuguggcuucuucguaggguuccucagccucuuccucuaccucaucaccauccucaucguccucgucaucaucggcuucuucuucuuccaccucagccacuucuuccuccucugcuacuucuacuacuuugucuucacugugaaggcaaacacaaauaacagaaaaagucaauuaaacacauuucagggaaggaaaagaaaagucguccauauggaauuuuggcaauuugagaagaaacacacccaaaacuucaauucagcaggucuaaguauaaaucccagcucagugggucugcaaaaauuuuuauccuuggggacaguucuuaguuucugcaguugcuaaaaggggaugccaugagucuaaccacaggacauucuggaaaagggaaaauuacggagacaauaaaaagaucagcgguugccagugguucagggggaguggggaagggaugaauagguggaguagagaggauuuuuagaaacuacucugcacgauacugucauaaguaauaauagauacacagcauuaagcauuugucaaaaccaagagacuauacuacacaaaaagucgccucucauguuaaaacaggaauacugguuaauaauaguguaucgauauugguucaaacguaccauacuaaggcaaaauguuaauccaggggaaacuguuggggaguggggaagugagagguagagggaacuuuuuguaguuucugcuugaauucuuuguaaaccuaaaacugcucugaaaaauguaguccauuauaaaaaguggggugguggauaucaaaacugaguuugccguauuaugggaauuacuucucauagugcacauacaagagccgcaacgcauugcacgguagcggauacucaguauaugcugguggaaauugguuuaaaaacugcaacugagagcuuaaacuggacacacagguggaagaugaagcugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaucugcaaugcccuguggucagggaugccugcuggaacuauuuaguugcguacccuaugguuacuaacugcuuauguuuuguagaaaaccaaauauuucagugguucucaaauuucagugagcaucagaaucaccuggaaggcuuauugaaacacagaucaccuaccugcuaaaugugguggcucaugccuguaaucccagcacuguggaaggcugaggugggaaaaaaccuagaggccaggaguuugagaccagccugggccacacggugagacccugucuccaaaaaaauuaaaaaaaaaaaaaaaaaaaagccaggcaugguggugugcaccuguaguuccagcuacucagaaggcuggggcgggaggauugcuugagcccaggaguucgaggcugcugugagcuaugacugcaucacugcauuccagcuagggagacaaagacacugccuccuuaaaaacaaacaaaaaccagccaggcaugguggugugcaccuguaguuccagcuacucagaaggcuggggcgggaggauugcuugagcccaggaguucgaggcugcugugagcuaugacugcaucacugcauuccagccagggagacaaagacacugucuccuuaaaaacaaacaaaaaccaacacagaucaccaggugccuguggcaguuucuaaugcagcuccagaguuucugaaucaugaggccuugguggggccugagaaugugcauuucaaauucccagguaauacugaugcugguggucaggggaaaauauucugagauccacugcaauaugcugagaauaauggcaagagauaaccaguaacucagugaaauugggaagaggaucagaaauauuuaugguauuaaacauuuacaugcugaugcaucauaguuuguaaaaaauaagcaaauuuggauggcaaaagaagggcaugucuagaacaaaauuaaaaaggccuauuaggaaauccuuguggaaaucauguaccugucaaggcaggcaugguugacagcauuugaauaucuaauaguaaaagccuaucguauaccaccuagcaggacuagaggaauagauguccuugaucagaucacaaaaccaauacaggagaaagaccuagauguggcaggggguuucaaccuuucuggggcaacuaccacaggucuauucgagaaguaccauaguaauagaauuaaaagcugcuaugcugacauuauaauguacccagaaggaaaaaaaaaagcgagagggagaaagcagaagggaauuauuaccacagagcugauucuggccaacaaggagaagcucaucauugggaaaagugauaggaacccgggauuuguagccacaggaagccuuggacucguagugagagcacagcauuauguaggaaaucagauuccaaacacgugagacaagcgaacacuaugauuccaugaucuacgacaauagaaaggaagacuccuccauaaaccugaaaggcuuucaaagucuaacaggaccgccauaaguaguuuugcugagagugaaagggaaagauauguaaagagauuaauccaucaauggcaggaauucucugauuaccucaggauuuaaagcauguguuacacaaguuguauaaagauguguaugauccccauggaacaccugacucugauuacguaggauacaagaauaguauaaagggcguuuauaaaaguuucaaaaaaauguguaugacccccaaguggaacgccuuucuaacucugauuaaauaugauguaaggauauuaagugaagacauccgaagaaguuuagcauguggcuaaagaauaaaaagaaacugauuaagcagaauaauuuauuaauagcaacuuacucauauguuaauaaaugaaguguuaauacagagaaaauccuaaucaguuauuguaacauuuccacaagacuaggacgaaauaggugaaaagagaaacagaaaacacuggcacugaaaaucagauguuggaagccuuuaucuccucguagaaauaaaugaggugaaauaacugacuuuuuuuuuugacugcccaaauuauugcacgaaaguuuacuacguggggcuacauuucaaaagaauccuuaacaguugcucagcugcccugagcuucugccuuugcauuuuucuguaggaucucacuguuguauuacuggugaaucaaagaaagaugaccugaugcaugucaucaguuaauuuaccguguuugagaucucuuacuuauucaaucaaaucaugggcacuaacuagcgcuguuuuccaauuuaaguggaaaauucagggaaagucaggaagaaaaaucaaaccaguauucucuuuaaaucaugauguauacacgugaucuugaaccaugacuggaaugacgauguccaaguguaccauccaggguuuggacagcaccguguuuccaggugggauggugaaaacaugacccuggguauccccagguuccuucuccaggcuucuuuguuauuacuuggauguggcccuuaaagcucugaauagaaaccauguuuguaaaaacagcuguuuagugugaucugcauucugguaugugucuagccgugaaaaagagugaauuauaugcccaucauccaucccugcaucugccugagcaauuuacuggcauaauaaccaggaacggagacacguaauaaauaguucaaccggcuaaggaauuaaauuacuuggccuaagagaacucagguccaaguucuuauuaccauagcuuugauuucuggaauuaaauuuagauguccaugaauucaauuauucauuuggacacuauuuaaaacaagagcacacgguuuuguuugaauaaugcugcaucuucccaaagaaugccaaacacaacaacauuacaacuuuuaacugcaguuuucaugaacagcuagaaacacugaaaggaaaaaaaugacuuuuccaccacuucuucaaaugcuggacagacuguuguccuguggacuuguuuugaaaagcucaucacaguuuaaggaguugcaagggaggaacaguuuauggaaauauaaagcugagcaucauaaaacaauuuccuuacaaacaaucaaauaacaacucacaauaaaauaaacgcuuggcaacauaguggaacauucauaccacauucgcagacuuuaguggcuaucaauuuauaguggguggcuuuuacagcuuuuaaacaccaauaacaaacauuuuuacagaacaagggaaccaucugaaaaugcugaccauccccagaguaucugaauuuaauaaggucaaagggacauuccuacgaggaaauaaaucacugaugauaaaauuuuaugugucagcaugcgagauuuuacuuggaugaaggagaaaugacaucacaaaggugacucuccuucuguuucuaacuaaagcugaccuugauauaauuccacaugcaggugccgccugauaagucccuuuacagagugaaagauuuugauucacacaccaauuuucauuucuguuuauuaaagucaugccaaaaaagucaccauuuguauuuucuaagaaagccauaugacauucuagaaauggcaaaauuauagacaguaacagaucaguggcuuggaaagguuaaaggcaagagagggucgaacaggaggaacacagaggauuugggggauaguaaaaguacucaguaugacacuacaaugguggguacaugucauuagacaguuuuccaaacucacagaauaaacaaugcugagagaaugcuaauguaaacuauggacuuugggugauaauaauggugucaguguagguucacugauuguaacaaaucgcucuaagggggacgcugauaaugggagaggcugugcaaguguaugaacagggaguauaugggagaaucucaguaccuucugccuaauuuugcugugaaccuaaaacugcucuaaaacaauaaagucuauauuuauucuuucacagucucuguuaagacggacuuuuuucuucuugcuacagauaaacagggaggaaaugacagagagaaagcucugauucucaugguuaugugaauauggacuaucaugagauccaaccuacuugcacugaugagggaagagggaagacaaccaaugucaguuccugaaaugcaaccaaccaggggaaagcucagcaggaagagguucagacucuuccucuguggauaugaaaaugggaaaaaagagucuagaggcucccagagucagaagagagagaaaauacaguaguuuuuuucaagaagauaaacagacgguucuccuucucucugucucaacucuccaaacugccagagucuaaacuggaagguacaauggcuggauaagucaguuuguccgaaaggaaagcaguuuuugaaauuacugcuacuaaauuaggaaaauguuuccggggagggagggcaaaguaagaaauagccaguacuucucccgcauaaaggcacuguuagaagcgaaacacaaggggacacaucaccuaauucuauuugaauuaaauaugaaaacaagcaaacugcaggcaaauagaacucaggggaaaggccaguaacuggcaggggccaggagagaggauucuaggggccagcaagucucuguguucugguccggaugcuggcuaucuaguuguguggucuuaaaaaacuuugcuuacuugcauuaccucuuauguguacuucucucuaaauaaaucaguaaaaagguugaaaaggguuucuuguuacuugcagcuaaaggcauaagcccaccuggggcccuagguuuaaggccuccagcuuuaggaagauaaccacaugacuggacuaccaaaaauucaugacucaggccugaggagguggcucaugccuguaaucccagcacguugcggggccgaggcaggcagaucacuuggggccaggaguucgagaccagccuggccaacauagugaaauuccgucucuacuaaaaauacaaaaaauuagcuggacgugggggugcacgccuguaaucccagcuacuugggaggcugaggcaugagaaucacuugaacucaggaggcagaagcugcauugcacuccagccugggugacagagugagacucugucucaaaaaaaaaaaaaaaaggaauaaauaaauaaagucaugacacagcugauuaagaaugagcuauaaaucacaaucuugaucugaaauuaggcuauaucaucauucuuacacauuuaaugaauacuuauucugagugagacaauucacacuaacugcuguaugaguaacagacauacugcagauuaaacgcuucagaaauucaacagagaagugauuguugcgaccagaggcaucugaguuggccggaagugauagguggcuguggggaugaggcaggaauauccacauaaugcacaaguggaauaagaaguaaauaaaauauaaugaaauuuuacacaggcacugaguuuuaacagugaggaaggguaaacugcagagacacggggauucagguauuuuuuuucuuuagccaauggauaaauauuugaguugaaaggcauauguacaaauugaugauaaugagcaaaaaaguggcaaugcauucauucauucauccauugaaucauuccauuaaguaccucucuaagccaaccccuaguaauucaaucaacaauauucgcugugcuuuaccaagugccaguacuauuccagguagugaagauaaagcacucaauuucuuggaaucuaucuauuaguuggggagguguaauaugagcaagaaaaaaaauuauggaaaaguacuauagggaaaggagauggggcuaauugcuaaugaaugacuaugauagaugugugccagggauggguagcauuucaaacaggguggucagggaagggccccacggaagagccaugugaacuaaaaaugcugaagucgggcacggcaaaaccaagagagugcauggauggcugaggcagggguaagagcaagugcaaaggcccaggugugaggaagagauuagcacguucagcaaaaacaacaaagggccagugagcuuagggaguagcagaugagggaggaaguauaagaucuggugguggagacagacaggcauaguguuacccaguacgguuacauuucuuacagcaacuggaacgacucaaugagauuuaaguugcaaugaugucucuggcugcugggcacagaauggucuccagggaaaacaugaauggaugcugggaagcuggacacugggccaggagcuagggguacacuggaaagcaaagguggcucacaaggcaaguagccaaaggccagacacugaccucagcaccuguauaaaugcaaaauuacugcccugauaacaauuacauacagccagaagacccaaaagagugagugcuagugugucuagugaggcagagauuccaggugucuagugaggcaugacugaaaugugacccaaagaagguccgaagugaaugaaguccaggggccaaagauagcucuccacuaggcaggguggguagagcaugugcaaaggcccggugacaggagggagggaaaccugagcaccugaaagggaauuggcugacaagaacagaaagugggcuccaagaauggcaagucagcaguggcacagagcaggucuuggcaaacugcaacccgcaacuuguucuuguacauccugugagcuaagggugggcuuugcauuuuuuaaaggauuauaaaaagaaaagaaaggggguaaaaaugacagcaauaugugacagagauuguaugcgaccuguaaggccuaaauacggauuguaaaaaugaccauuuaaagucaaaccaacuucucucaacacaugcuccuguaaacccugccccacuuacguuagugaauuagugaauuucuaaaaaaaaauuacugaaacaagcaaagagauccgagaagcacuaaagcccagcuuuuguguaaaccagcaguuccugggcagaaccuuuaaaagacaaucucucuuuacucugcuaucucaguacacacuuaggguaacaugaauauccuagcaauagagcaacaaucuaaacaauaccccugggacaugauauaagacaaauccaaggaguggacaguuuauaggaaaacugguacagcuucuucagcaagucagugucaggauauaaaaagugcuauucugaauccuaagaauuaaggauguaagaugcuggcccuggugccggauaggaugugaaaugcauaaccugugaaggaccuuucuggaacucagggagaaucugaauauggacaugguauccaaugguacuaaaaauuuauguuaauuuugugggugagaugguaucaucuggacucuguagaaaaauguucuuagauuuuagagacauauacugacaucuuaaauaugcuuccuaucugaacuuuucuuuaaaauaucuuggcaucauaaaaaguauguuuaaagggggaaaaugauauucuggcaagacuuaaauuuggaauauaauuacaguaaaaggcuaaauugcuuuuuuaaaggcuaucuuggaggcaagaaaagucauauauuaucaaaagcagauuauuguucugacagcuuuaugaaccaacuagaauuaaggagaagcaccuaaggucauaaaaaguuuuggagucauuuuaaauucuugauaugugaaaaaguuugguuaaucagaugcuaggccagaaaacugugaacgagcaaauuccucauguccaaagguuuagcugcuacuaaggaugggugauccauauauauuuuggguggagaguuggaaguauaugaccuuuggcugucuaacaaauauuugaguuccagggucugcucuggagucuagggaugcugcagagaauaaagcagacaaaauucccugccuuccugguauuuacauucuacagggaaggaaagauauaagaaaacuaaaacaacgauguuacacuagcacauuacaaggugacaaguguuacagagaaaaugaaagcagcaaagcuaggggugggcuggggcugguaguuggccgggcuguugcaguuucuacagaagaugguaaaagaagaugcccugaaaaggugucaaugcagcaagaacuaugugccuggcaucuccuuccacuguguccauacacaugagaacuacuacacagcuauagguggucuguguccaaaauggcuacaaagcaaccuaggaaagucacaaaguaagagaaaagccugguccuuuucuuuugggggcacuuugugaagaccuauuccuuagaaagaagagagaagcugcaugcuucugggcuucucccccucuuuuuugggaaaaaauaauugguucuguuaaggaaguguaucagucuguuuucaugcugcugauaaagacauacccaagauuggggagaaaaagagguuuaaugggacuuacaguuccacauggcuggggaggccucagaaucauggcgggaggugaaaggcauuucuuacaugguggcggcaagagaaaaaugaggaaaaggcaagagaaaaaugaggaagaagcaaaagcagaaaccccugauaaacccaugagaucuugugagacuuauucauuaucgcaagaauaguacagagaagaucagcccccaugaaucaauuaccuccccugggucccuccacaacaugugggaauucugggagauauaauugaaguugauauuugaauggagacacagccaguccauaucaggaagcaaaaacaacaaacucugcuccuccuuccagcacgcuccccaaaaugcagcaauaccuuguccugccccagauucguaaguggagccccauuccuaggagaaaacagauacaucugcaccacugauccucaguggcagaauaugccagguaucuguccaggagaagaagccauguggcucaggcuacaggguuuauagcccaaggccucccuugccucugugcucugagggcuugaaguaaguagaaaaguacuuuaaauuguaucauaaagguaaagaugauguagcuucuuggguuagccacaacauuuaggaaaagcauguucuggagagguaagacuuuuaguugauuuuccauuagugagcuaacauuuuuccucuuccaacaagcccacuuucuugcauugguaaguauuaaguaucuuuuuuuaaaguaucugugguugguuggcaucugagaaaucuguagggucaaauaucaaauagacaccccuagcacaaugccacaaaugcacaagggaugaggcuaugaaauuugugaauucuuuuccuuucucaaggaacgacuacacuuacauauacuccaguuaauuguauguucuaguuauguagauccuagagagaaggucuaguguggugauuaauggugacuuuccagagcucagccacguggguuucauucucagugcugccaccugccagcuccaaugugacuaugaacaugucacuuaggcugcugugacuugguuuccucaucuuuaacaugggauggaaauauuaaccaccucaggggauggugugaacagccaaugauguaaauaacacacuuggaacagcacaugauaagaguuaaauacugugccuauuuacuguuuuuaacuacagcuuaaauguauacuuaugacauuucuuuucuuuuuauugcuauuagguuuugaaaaugguauaaaaauaucauuuguuuuucacagguaauguuuuucuuggggcuuauuauuuuagaaaaaaaaaaaauauauauauauauauaaagagcuauccuuuacugggcgcuaugccuaguaaguucccaacugcugacuauaggcucagagcccugcagagaugggauguaaacaagcauaaaacaguguuuucagugaagugcauauuaacaauaaugggcugaacaaagaauguucauugguggaguuugggagggacagacugaagaauaaucuguugaagagguaacagguaaacugggacaugaugaaugaauagaaaucuacaaagaagguagcaaacaggacacuguagaaacagggaauggcacccguagcagaugaagagugauaugguuuggcuguguccucacucaaaucucaucuugaauuguaauccucauaauccccaugugucuagagaaagaccuggugggacggaauuggaucaugggagugguuuccccaugcuguucucgugacagugagggaguucucaggagaucugacaguuuuauaaggggcuguucccacucugcuccucgcucuucucuuuccugccgccuuaugaagaaggauguguuugcuuccccuucugccaugauuguaaguuuccugaggccuccucagccaugcagaacugugagucaauuaaaccucuuuccuuuauaaacuacccagucuugguuauaucuuuauagcagugugaaaauggacucauacaaagagugcuacaggaauugccaauucucaguaugguggaggaggggguggacugcaggaagggagcugacuagcuguagcucugcucuuuuaugaagggcuuuguuucacaggcugaggagucuggaccaucaucuagaugcagagccuaguagaaaagccugaagcagaagaguggcaagguuaguuguauugcaacaaacaugagcuagcagaagcauggaggacagauagguggaggagcgacaguugggaugugaaggcggugcucgugaagccuacugagaacuuggauaaaauaacagcacagaacuggugacuggggaugaagggagugaguaagaggaggaaucugaugcuuugaguuggagaauaguuacuaaugguaacagaggauacaggaggaauuaagaaauggagcuaauggguucagcuuugaucaugguagacuugagauucuguaagaccccgcuggagaggcauacagcagacagcugaaaacaaagaacaaaaaaaucugagccacuaauacacaggcacugcuuuucuauuuccauuaaauaaacagugcugcacuuuguuguuuuuuaaacuaaagagcugccauuccugaaagaccacagauaauagaccagaugcccacucacuuucugcauggauaauaugucccacugugauaccauuauuuaaguagaaacaaaaucuagccuuaugaagucuaauuauaccauuccuccuccuuccuuccccucucucucccugcaagcauaauucaagacugcuuucccauucagagaucuaugugagaauuuuaaaacauuguugcugauuagucucucuaaucaauaaaagaaaucuacuaucggccaggcacgguggcucaggccuguaaucccagcacucugggaggcugaggcgggcggaucuugaggacaggagaucgagaccauccuggcuaacacagugaaaccccaucucuacuaaaacacaaaaaauagcugggcaugguggcgggcgccuauagucccaguuacuugggaggcugaggcaggagaauggcgugaaccugggaggcagagccugcagugagccaagaucaugccacugcacuccagccugggcgacagagcaagacuucucaaaaaaaaaaagaaaaagaaaaagaaaaaaagaaaagaaaaagaaaucuauuaucgauuagauuugauaaaucuauuauugacuagagagaccaaucaggaacaaugucuaaaauuguguaugaaaagccauucacucaucaaaugcuaguggcugcuaagugucuggcauucugcuggauccgaggcuccaaaagggaaaaagauaagcucccuguacucagagagauuacauucuauggggggagagaacgacaacgaaccaauaaaauacuaaaaugugauucauuucagaauggaaguaaauaggcugcuaggauugagaauaaugaagaagggguguuuucuucagaaaagaaugaucagggccaggcaugguggcucaugccuguaauucuagcacucugggagacggaggugggaggacugcuugaguucaggaguuugagacaagccugggcaacaaagugagaucuugucuccacuaaaaauuaaaaaaaaauuagccaggugcagccuguagucccagcuacucaggaggaucuccagagccagggaggucaaggcuacagugagccaugaucaugccacugcacuccagccuaggugacagagcaggaccuugucuccaaaaaacagaaugaucaagggaauucauucuggaaagauggcaacaaaacugaggcugaaggugggaccuuggaacauccauuauagacaaugagaucugucagcccggggguuagcaagcuggggauauugacuugugugacacugagcaggggagagucgggggaaagagaggcauggggugauacugcggagguagggaggagcugggucaaauacacuaauaccuguaaggaauguaggaggucaaaccugacaccaacuacguguuuguuaguuguuacccguuaucaauuauccucagcauauccaaauaaggcuucauuguuuucucucugugcacuugguuuuuaagcguauugguaagccacgaacacaacuuaaauuuggggguuccaggaucugcuuuauguaaauaaacacucuacauccuggcugcuguacagagaauggcuuggugugggagaagaaagcagcgcaugugucagggagagagaacgagagcagagauuagcaggauacggaaauaacuccagcaagaaacaaugggaguuuagauuagugcuggaaaagauggagauaaguggauaaauccagaauucauaggaugugcagaagagacgaugaugaguucuagguucucagcaauaaucccuaggagagggcauaggaccauuacugagauagaauagcuuugagagaaccacauugaggacuggguagcaggggaauuaagaacucucauuuggacauguuaggauucauaugccuaugaaauaacuagguagagucuggccuagagaaauaaaccuuggccuagucuacuuacaaaugguauuuaaagucaagggcauggauuacagcaaucaggaagagcgagccagaaagaaaaauaguauaauaauuguaaagagauagccagugucaggaauuuaauggaugaaaugucaaaacaaaacaaaaucagccaagacaggauaauuaaaaccacaaaggcuagggugggggugggggguagaacuggggggugggcacuccuaaagccugcauaaacaauguguaggaaagacaggcuggaaaugacagugacacacagguuacuagacaaagggcuucugagaaauggcaaagguaaccaauucuaagaacuuacuaaucuuaaggugauuuauagauaaaagucccauccuauaaaugucuggauucuugagcccagagauauucugggucugucuguacugguauucugcugggcagguaaagggguuaugaagagaaguacuaucuuacuugccugucaacuaauacugaugacagagcaaaagcgucaugcacuuuacagucguggucauagccaaagauugcagauguccuagacacaguauuugagacagagaauggaacauacauagccaaguuacuaauauacauguuggguaagaagauucccaaauggaaggaagguaaaaaagcucuguucuaguacaaccauuugaggauaguauggagauuccucaaaaaacuaaaaauagagcuaccauacgauccagcaaucccacuacugggcauuuaucuaaaggaagagaaaucaguauauuaaaagagguaucugcacucccauauuuacugcagcacuacucacaauagccaagauauggaauaaccuagauguccaaagagacuaauggaugaagaaaaugugauguguguguguguguguauguguguguguccgugcgugcaugcacguauaaugaaauacuauuaagccauacaaaagaauaaaauccugucauuugaagcaacauggauggaacuggaggacauauguuaagugaaauaagccaaaaacagaaaguuaaacaccacaugcucucauaugcagaagcuagaaaauguugauuucauagacguaaagaguagaacagaggaugauggaggcugggaaggguagguagaaacugaggauagagaaagauuuguuaaaggauaccaaauuacagcuagauaagaggaauaaguucuagugcucuacagcacuguaggaugacuacaguuaacaguaauauaugacauaaucucaaacagcuagaagcaggauauugaauuuucccaacacaaagaaaugauacaugccugagaugaauaugcugaucagucugaucugaucacuguguacccuguaaauguguacaauuauuacaugucaauuuuuaaaaauaaaaauuuuuaaaaagguaccuuuuaaugaacggucuaugcuuaaaauguugcuagguguguuucaacaccaaugaguuauaucugagguuggaccauaacuagacgaggcacuuagagaugcgguaacuguggucucagcauccuguuccacugcacuuaguuccaccaucauuguauuacaguaaaugcaauauugcuauccugugacuaccuuguaaacauauuuucauaaaaccaaagugcuucauuaccacuucugauauguguaugaguccuuggcuccaauuuuccaauaauaguagcuauacaauuauguugaaaaccauuugaggcuaaccauuaacauucaaaugacguacaaugggaaacgaaugaauaguauauucuaggagauaaaagaucaaaccuuugauauaucuucucuuacuuauuaguaguuagaguuuaagauacaauauuucuucuaaaaccauuucaaaaauauaauuuaaauauaaaauugaagauccuaaaaaaguauagaaguuuuaaaguagaaugacuuugcuauuugaauaccuauuuaaauuucuauuuaaaauguccaaaacagcccaaaucaauucuaccuucauuuuuauagcaguuuucuaaucaugagacaucauacuuucuaguccuuuuugcuucccuaaaauaaaaaaacuccuacauauuuaaauucauaaauaagaauuaucauuacuugauuacuaccaaaacuaauuuuaauaauguucucaaccuuaucuaggauagaagugcuuaaggagccauuacguauuauuauugauuaugauuacaagaccuacaauaauuuuaaaauaacuaauuaaaaagggaacauguuauaauagccaugauuaucaaaccagaggugggagaugagucauugagccccaaggagagucuuuguauucgacagugugagaugauggguagagaagugauuugacuaagaaaaaaaucaccccagcuggcgcggugucucacgccuguaaucccagcacuuugggagcccgaggcaggcggaucaccugaggucaggaguucgagaccagucuggccaacguggugauacccugucucuacuaaaaauguaaaaacuagcugggcgugguggcaggcacccguaaucccagcuacuugggaggcugagguaggagaauugcuugaacucaggagacggagguugcagugagccgagauugugccacugcacuccagucugggcgacagagucuuaaacaaacaaacaaacaaaaaaaacaucccaugcugcuggccugcucccccaacaauuccaaucuacgcauuuuaaacaaguccacuguaaacuuuaccggcuugauaugcauuuacaccaauuagucguuuuggaagcaaauaccgugauacagauuauugcaauuuuccccauguuugagguaaagaaauaggcucaaaaagauuauauaugaggguaaagcacauuuuaaaccuuugaagauauuuuugaagcaaagauuaucuuauuuacuuacaagucuuuucuuuccuugacuacuuggaugcgucuauuacaccugguuucuguuuccacccaaugucuuuuuaggcagguuaguucuaucaucaugaaaucacuguaagugcaauacugcccuuuccuucaugaugucauucaucucuuucccaguuuguuaucuaacacguauuaacauuuuaguauccaacuacauuaaucucaugacuacuagcauugaaagaacugauaaaaagauaaaagcaaacccuuacugccugguuugacaauaaguaacagcucuucacaaaggcuggcaauuaggucacuaagcaaaaaaucuuggaagaccaaauucgaccaacagcaaacaguggucucaaauguaaaagaaaacuuagguuauaugcuacgcuuacaauagcaaauuauguauacugcuugaauuacuauugaucuaaauaaaauggugcuaugcuauaaagauuauuuucaaauaauuucuaauaucaaacuauacuuuugaauacccuuggcaaaucuuuuccagaauuacacauuccuaaaacaaugagccaauccacaggcacguguggccuacuauaugcucaacauucacuucucuuuaaaacaauuuacaugacaaaacaaaguacaacagugaacauucaucaguugcaccuucaaaugucugacaacacaaucagaugaucuguguguccuuuacuuauuaaauugauaacaaauagaaaauaaaauguagaucugaaggaagcacuuaauuuuuuuaauuugcucaauugcaaaaaauuuauuuauauaaauauauaaaaugaauugcuauauuaaaagaauaauacaaauuaaaauacuauaaauaauaacuugacugccuuacaaaaucaauuugagcuacuguauuuacagauugaguaauccuuauccaaacugccugggaccagaaguguuucagauuucagauuuuuuucaaauuuugggauauuuccauacauauaagauauguuggagaugggacccaaguauaaacauaaaauucauuuauguuucaaaaauaccuuauacacacagccugaaggcaauuuuauacaacauuuuaaauaauuuuuguuucagaaaggaaguuuguauacauugaacacauaaagucacauaauuuucuacguuugcugucaugucagugcucaaaacauuuuggauuuuagggcauuucagauuuuggauuagggaugcucaaccuguauuuuaugguaauaaaccgcauuucuuuaaaaauauuguacauucuuggcugggcaugguagcuuaugccuguaaucccagcacuuugggaggccgaggccaguggaucacuugaggucaggaauucgagaccagccugaccaacauggugaaaccucgucucuacuaaaaauacaaaaauuagccaggcauggugguuggcaccuguaaucccagcgacucgggaggcuaaggcaggagaaucgcuugaaccugggaggcagagguugcagugagcccaaaucacaccacugcacuccagccugggcaacagagugagacuccgucuccauuaaaaaaaaaaaaaaaaagcugaguguggaagcaggcaccuguaauccucgggagacugaggcaggaguaccacuugaacuugggaggggagguugcagugagcugagauugcaccauugcacugcagccugggugacagagcgagacucuaucucaaaacaaacaaacaaacaaacaaacaaacaguacauucuagaguuuaagcuaaugaagacuguucucccaguaucucacuccauacaaaaauauauauuaaaaauucaggugaucauggcuuuggcuaaguggcauuagucuaccaccuacaauuuuacauugaaacacuggggauacugcaaauguuaccuaguaaacuaaaaguguuacuuuguaaacagggagggcaaaaaaggaagcuaguuagcucccacuugggacagauuuuguucacucucuaccucuacucaaaggaaauaguuugaacaucucuaaauuauuuucguaauaauugccuuccuuccaaaacaaacauggacuuauaauuuugcugaguuccuugugguaaguuacugguacuaguuuaagccacauggcucccaaguaaagccaacaguuuuuggcuugauaugcuaauauguagauuuugaggccacaguaaaauuaauuaacuaauuaaaggguuauuuuuccaugucacaauggagaguccuaucuaaauuagggguuuuacacugaagauacaaauauccagaugguuucaacaagaaauuaauguuucgguguacuauugccagagaccaguuaaaaucauaagaaucuguauuuucuuccucuuuuccuacuauuuuuaagccagggaauuuguacaguuuaauuaaaagauacuggagggaagaaaagaguccaugcaucaguagcuuaggauccuuagcacugaauaauccaacccuccaaauaacucuuacaaaugaauccuacaguauuucucauucagcaauauccuguuacuggggcaaccugugccauuaggucucaguaagcagcacagucucauugccagauguagcucagacagcagcaacucaagcccugcacuacagaggcaucuccucuuccagccaucaccugcuuggaaacaaaaacagaccccacugguuuggccacacaucuguaaucugcuuaaggcuauaaaaguguuuugcuuuucuuuuugacauacauguaguccaaguuuauucaauacaggaaucgagcauuucuaaauaaggaccucaaaacuggcagccaguucccucaaaagaaaaugcaaguuucugcuauucuccuauucgucauuuucaaaugaguucuccuauuucaguauagacagucagaaagccucacacaguccuggaagcugccaacccagcauuaugacagcugcuucucaaagccaugagccauuucauuaaauccacucuuacuugacucauccacuggcaaagauuuaaagcuuuaauuuaucuuuuguaugauucacuuugcggcccucuaaaguuguuagguuuuuuuuccuugagcauuuaauaucauuucucaaaaugcaaugcagaaaggcagcugaaagauuauauauucaaaaacuuguaacuccagagauacaaauaaaaagauauauagucaaauacagccucucuuucucucucaccuaauuuuaaagacaaaguacugaauagacauaaauucucaugacagccugagcucaucagguaaggcuaugaauguuucaacaucacuagcuaaguggaagaccggcaugugcauaauuuauuacaugauugaaugacaaguuuucacuaacuacaaaucauguauuugugaaaugcaccaucuauaauaccaucugguuauuauuuucugagaaaaguucucagagcacaaugaccauaauuaaauuugcuuuugacuagauguagcacugugccaccuacaaauugagccugugcaagcguuuuaugaugacugcauugauuauuguuaucaagauuucaccccuuggucuggcgugguggcucaugccuguaaucucaacacuuugggaggcccaggcaggaggaucacuugaggccaggaguuugaaaacagucugggcaacauagugagaccccugucucuacaaaaaaaauaaauaaaucaaaauaaauuaggcaggcaugguggcaauguguuuguagucuuagccauuugggaggcugaggcaggaggaucacuugagcccaggaguucaagguuacacugaucuaugguugcaauacugcacuccagcaugugugacagcaagaaccugucuccuaaaaaaaaaaaucacuuuaauauaguaucuggaacauaucaaaugcucaagagguuuagugcccuucauuacacuggaggaaaaaggugacauuuuguaccucugcaugcucagauacaguuuguuuuugaguuggaaauauuucauacuucaucuuuucuuauucuuacaauuuuccuuuauuuauaauguagccaucccucuucugcccauggaaauaaugaaacaugggacccaucaugcuauguuauuagacuccugaugcaauuuuacuuaauuacugcaugucuagaaugauauuccuuaguuuuucuuuucuuuucuuuucuuuuuuuuuugagacagagucuugcucuguugcccaggcugaagugcaguggugcgaucucagcucacugcaaccuccaccuccuggguucaagcgauucucuggcagucuccccaguagcugggauuacaggcacaugccaccaugccuggcuauuuuguauuuuuaguagagaggggguuuuuccauguuggccaggcuggucuugaacuccugacaucaagagaucugccagccucggccucccaaagugcugggauuacaggcaugagccaccaugccuggccuaguuuuucuuuuuuaaagaccaguuaguuuuggugacacuauuaaccuuaaguuaacaugaugacguagguguauguguuugaugugaaugccaaugugauucaacucaaauacuuguugagcaccuaacuaccuaacuuauagaaaauuaugccaaguauuuuccugcaucagguuguacaggccucauaauaaauguaaauucuugguaaguaggauaggcuguuaaccuuuagaauaccaucaggucuuggacacaauuuuaccuuugaguucugagcacuucuaacuacuugugggcugauauucucacuuuauccauucauagagaaaaagaaauuuaaucgacuaaaacucauucuagcuuguacuuaaccaugagucugagauaugguaugaaccucgaucuuuuuccuauauuguguuccuauguuacaaaauauuuaucauccgaagaauuauuucaucauuagccaucaacuauuuaaaaacugugcuaaagaagacaaaauaauaugagcaugaaagaaugauauaauugccuagaaaggugaugcaauagggaaauuaucacauuuuuauugcuguguucccaaaguacugcaucaucuuucaagaugguuuaaaaaaagucugcauagucccagcuacuugggauguugaggcaugaggaucacuugagcccaggaguuugcagcuguaaugcaccauacucacaccagugaauagccacugcgcucaagucugggcaacagagugaggucccaucucuuuaaaaagcaugauaaaaagaagucuggagacucacugaauauagucaaaaaucaucuuccacauauuggcaaauaggaacaacugacagaaggaggcauuuuaccaauuagauaaaccagaagaagaaugaaauugaucacguaaguaaaaccuuaggcuaugagccuucacaugauauccuagaugaauuuucucaagcucaagaauugacaagugagcaauguauuucuuucuuucuuucuuucuuuuuugagguggaguuucgcucuuauugcccaggcuggagugugauggugcaaucuuggcucacugcaaccucugccucccugguucaauugauucuccugccucagccucccgaguagcugggauuacaggcaugcgccaccacgccuagcuaauuuuguauuuuuaguagggaugggcuuucuccauguuggucaggcuggucucgaacucccaaccucaggcgaucggcccaccucggccucccaaagugcugggauuacaggcgugagcuacugcgcccggcugagcaauguauuucuaagaauaaaaaggaaauaugguauucucauccacuuagucauucaacaggaaggauaucaucacucaauauuaugugacaaaaacauuaaccaucauugcuaaaaugaugugacaguauuccuugccauuuuaugaugcuuaugcaacacauuuuaugucugugcaacacauuuauuugauaccauuaggaaguggacaaaugcccaaggcaggaaucucucuaaggugauuagaagagauaaugcagaaaaaaagggggaaaaaaagacuggcuugaucauuuuaauagcuguuuacaaauccaaacuugaaaacauuuuauuccugagggaagauggcuauauucucucuucaauaaaauuaugagcugucaauguuuuaaauaucuuaaauuuuuacaauaauuaaaugaaauugcaaguauaaaaaaaaaagaccaagaaauaugaugaaccuaauagagauguauuugaaauguagaaccaguauuuguaagacggauauauuucagguucgugcauggcaggugauuagcagcuagcugcauuccaaaggauaaugcucauuucagaaauccauaccuucaaaacugggaaaauacagaauaaacauguggguuuaccauauuuaaauucuucguaaaauuaaaauauuuacuauguuaacucuuauuaaaauugcuaauaguuauuucucacuauuccuuuauucuuaguucuguaaauuguuuaccaaauaaucuaaaaauaugaaacaauaauaauauaaacggcccacuguaucuagauagucaauggugcuggccugguuuucugguguaguuagagggcaaggugacgucuugccauaugugacacuccagcaaucaccagaacugaugaaguuuaaacuggguucaauacggaauuguauauuccaaugcacgcacaccugcauacauggccauacgcacccacacaagccaccccgagcuguauuaguucauuugcauguugccgauaaaggcauaccugagacuggguaauuuacagaagaaagagguuuaacuggacuuacaguuccacauggcuggggaagccucacaaucacgguggaaggcaaggaggagcaagucaugucuuacauguauggcagcaggcaaagagagagaacuugugcaggggaaccccucuuuuuaaaaccaucagaucucgugagacuuauucacuucacaggaacagcaugggaaagacuugcccccaugauucaauugccucccaccgagucccuuccacaacacaugggaauucaagaagagaucugggugggaaaaaagccaaaacauaucacugccccccaaaccagagaguaacauuaacuaaccuggccaacauggugaaacccugucucuacuaaaaauacaaaaauuagcugggugugguggugaacaccuguaaucccaauuacucgggaagcugagucaggagaaucguuugaacccaggaggcagagguugcagugagccaagaucacaccacuguacuccagccugggcaacaagagcaaaaacuucaucuuaaaaaaaaaagaaaaagaaaaagaaaaaaaaaaacucuuccaaguuauacagucuuaaugaaaauaagacacggucaaaaggaaucacuccuccagaucuuaagcagcucuuuaaaaaaaaaauguucaaagaaauagaaaaaaaaaaucaucuaauuauccagaaagauacaucaaguuaccucucagcacacgcucaccagugucugcaaaccuaaaccuaaaagaauacaucgauaauuaaagauuguuucuuaaaaaaaaugugaguaccuccucugcaagaggaaaagugugacucuacaacaauuagagggucuucuaacauuucauuugcuuuacgaauucagcaacccccauggaccacuggguucaaucagauucugcaguuccaggugaggagcagcucugccuccagggcuaggcugccuaccuggcuagucuuacaaguuagcuuuccaaaugaauuuucccauggaaaaaaaucuuacccacgauggcuggagucuguguauuauuaacauuauguacguaauuauuauuauuaacauuaugcuacauaauguuaguaacagucuggauuaugcuacauuacagacugcauaaauagguauuuugaggugaucugagaauaugaccauuacaacacuggagaaaaauauacucgguaauuuacacauaaauuucugaaacacuaccuguuuugccuauguuaaagauuuaccucuuuuucauaccucuuuuucaaugaggucauaaaacagagcucauccuacaaggaauguuucucuaaaugccccauuagcgauagaaaaacacucaucuucuaucaaaacaagccucauuaacuaccaaacaacaaaauacugugaaucaaauauuguuuccaggaaaaugguagcucguuucuccuucuucaagaauugucacguagcauccccugaagauguuuuaagucagguacguuaaacuucuauucugauuuuacauuucaagugucaaaaggagggcugguuccuggaacaaggaggcugccaguuggcaggagcccaccuuguguguggaucagugaugcaacaccuuucugguuuuguccacaugaaagaagcccugcccgccugcagggcuacaggaaaagaaguuaaaaaauaaaauggugcaagugaccugauauacuaauuauacugaauccaaaccaauuuuuuuaaauuuuaaaaacaagaauaguuaaaaacaauaauaaaaauucaguggcucagccuuagaaaacauuacuagguuauacaaaccgucugucuuaauggaaaaauaaagagugauaagaaauuucaagucauccaggaacuacacuguccaaauauaguagucaccagccacauguaacuaucaaacacaguguguggcuaguaugaauugagacgugcuguuaaauguuaaaagaaguguuaagacuucuuacgaaagaaagaaacauaaaaaaagaaugugaacuaucuuauuaaauuuuucauauuggucacaugauauuucagauauacuggauuaaauaaaauguuguuaaaauuaaauucaccuguuucuuuuuacuauuuuuaaacugucuauuagaaaaugaaaaaguaaggccaggcacgguggcucaagccuguaaucccagcacuuugggaggcugagguugguggaugacgaggucaggaguucgagaucagcccggccaacauggugaaaccccaccucuacuaaaaguacaaaaaaaaaaaaauuagcugggcaugcuggcacaugucuguaaucccagcuacuuaggaggcugaggcaggagaaucgcuugaacccgggagguggagguugcagugagccgagaucacgccacugcacuccagccugggugacagagcgagacuccaucuuaaaaaaagaaaacgaaaaaguauguggcucacauuacauuuguauuagacaguucuuugcuaaaagaugggaggcucuauaacagggccuauagaaaaaaaaaggcaaaaaaauuucauaauguuuuaagaaaguuuaugaauuuguguugguccgcauucaaagucguccugggcagugggcuggauaagcuuucuacaauauccaaucguggaccaugaaguccuuaccaaaagcuaugaaaaaaaauuuaaaauauacaauuuacuuugucuaauauuuauugaggaccuaugugcaagacauaccagacacauaaacuauaguuuggauucuaacagauaaaaagagauaugacuacaauuaauuggaagauaaguuauggucuuauaagaaaaagguaaagcaaggguaguauagcagagcaaggcaccuguaaagacuuguaaaggcugcaucuuuucaggugaacauuuauaaauauauagauuuugacgggucauaagaaguggcacuuuagaguugacaaauaucuuuaucauacauuaaccccauuugacaaaaaaaggaaaaauauuucagauggggcagaacggugggaaugaaagccuagagaaagaaaaggucaaugguuuuaggaugccaggagagucacauacauguauaaggcugaaaaugcaggcugaagccauguaagagacuucugaaugcccugcaagagaauuuggacuuuucuacagguagaauaaaccaucaaauauuuccuaccaacugucaacaggauuaaaaacacauaguagaaagauaguaacacaugggaaagaauuaucugggaggaggguggaugaagccugggggugugggggagagggagacugaaaaugcaagaaagggagaggagaugauugagaguccagcagaacauaaucauaaaagggaagacaggaaacaaagggauagaagaagguacaagaguugcugaaguacaggagaaaauucaaugguuuauucaacaaacacguacugggcaccuaccaaaugucagguaccauguugcagaaauucacaauggaugacgguggaggggucaucuguagagcaugagagagaguuacgcugggaaccaaggagaaugaaguugggcuggaucaacugcuauggggaagaugauaggucaucaagacagagauaauuaggugcaucuaguaacauuaagaucccagcugauguuacagcaugaauaagaaauggaauuaagugguaagguuacaugacuugauacuuuagaaaucccagaagcaacuaaagaaagaaauuaauuuuuccuagcuauggagaauugacaaaaauauguuuagaaaaugugaaggguuucagccaagucaaggauguucaauggaauagguaagaaugguuauccauugauuccauccugauuagaaaggcaggcagggaaaaagaggauaauggacuaaaagccugaacuggggaggugauuaugagggaagaucaugaucagagaggaauaucaaagcuauaaaccuuaugguacuauuucuaaggaauuucagagucuaaagcaugacuguguucagguacugaaaugggauguaaaugaagguaacuaggaaggagcuggcuagcauuucaacugaauaucaaccuggauagugacaucaucacugaagacuguaauugguggggguaaccauaugacccaguuugccuggauccuucaguuuaugacuguggucccaguguucuagcugauauagacaauaaacucuaugggggcccuaguagcagauuacaccagaaauuaaaagaaaaaaaaacaagcauccuguaguuugccgauuauaaacuuacaacuccuauugaaugugcuguuuggaaaucuguagcucuagggaacaucuaagagaauacugaaggaauaagauaagugauacaaucaucacccuucgggggaugagacagcauaaaaucaaugccugaaccagauggcauuuccaacccaaagauucucauuuuauaauuuuaugauuugaauauagauguuugccuucaguuaagaaugagaaucagguaagaaguaacgggacuaagcucccuaagaaaaagaggcgaaaauagguuucuuuacaaucaacaaaucaaagguaguuaaaaaaaauuaacaagcauuuauuaaugccuuugacuuccacuaugaaggaaaagaaaugauaaaaggccaaaaaaaaacccuuacacauccacacagagaacgcccaaaaucucaaaccaaaccuuuaacgaaaauucaccuuaaacuaaugacugacaaucccagagagcauuuaaaaauauuuuuaaauuaaugaccaaaacagaacgccauuauuauuucaacucccuguuagaacuaccaguaaccuaugauaguuaucagugggauuuugaucccaaguuuaauauuaaauaguuaaaauuaacucugugaugggugacugauauuauuaauucaacaggaugccauaaaaauucauaguucagauuuuugcauaacagcagacucugaugggagugggcagagaccuuuucagugauaaacagaaagauuaauuuacaggauacaaauacuccauacaagauguuucagcaucucugaggcugaacacaaaggccaccuuaccucccaucugcauagucugugucugcuccgccccaccagacauccgagucauccuccuccgcaucagcagaauccacauugucacuuucuucagccagugggcaacacacaaacucuaccccucggaacuugucaauuccgcagggcagcaacaugccguagucaugcaaguugguacucuucucacugcaugucuacaaaguguaaggagaaaacagugagugguagaguagauguguuucauuguaagaaaacuccacauaaaauaaucaacaugcagacccaauauauuaggaaccaauuucacaaaggaaaagauuauuugcuuuuugagugaauuuacaacaggauuuuuuuuagcauggguuacacuuugguacucuuuuuauucuuguuuauuauuuauuuaauaagaccacgauguuauauaauagagguuuauacgaacaacuggaauggaaacuaauugggaaauaagauguagcagucuccacuggugaacagauaccagagaauuaaugccuucuggcuuaauucguguauccagaaauugugcgcauuccagguagauccccagcucacuccuaccucccuuacagauggaaguuuaucucacauggaccugccuuauccuagaaauucugacucucuugguucacuuucagaguaacaauccugggaagagaagaaauuauccccugcagccacuaagaaucagaacuuacagucauuagagauuucuccuugaaugucuuuuugcuuuucugggauuugcuaaauuugcacaaaucuagauuagcauaaaguucugagagcauccacuagugauaaaugaaggaugaauaauucaagacauaaagguagacaaugaaaauauuacagacuguauuuugaccuuaugggagucauuuccguuucuuagagacaaaggauuuuucuuuugaaaacacagaaggaauaaaaaaugagguuaucaaauagguagcuggacuucaaauuauuugguuuguuuucuuaaacucagcaagcucuuaaaccuccaaaacacauuuuuacauaaaaaacauuuuauucuacaguggauccaaauauacuauuuuauaagaggcauaaaauaauacuaaaucuucagugguauuuucugucuaacagcuauaaagcuaugauacaaugguuaagcuaagcuagaucagauuucucaaccccagcacuauugauguuuuggacugccuaauucuuggggguggcgggugguuauccuguugacuguaggauguuuagcagaaucucuggccucugggcacuaucagaugccaguaacaccacucccucaagcuguaauaacaaaaaaugucuccagacauguuccggugagggacaggggaucaaaauugacucaagugaagcacuaugagcuagauaaaggagccuaauucuaguuagccuaagacugaucuugccacaaauaaaccuauauaaauuuauuaggaaaccuaucaaggggacacagcagcugugaagguggucuuaccacacagugaccuuuucaugcuaaguaucuuacaucuuuuauuggcuuagccaaaagcagagguuaaccaagugcucggucagacucacccuguggaaaaaucaagaugguaggcauggccugcugaauauaaaacuggaugguauaacugagaaacugaauucuaacuggagcuuucaggcugguauaaaaaagcuacuucacuguucuaccacuguauucacuaauagauaacaggggaaaaggcuaaauuauuaaaaaauuguauaugacaaaagaaaacaacaggugcauaaaaauaaucugaaggguaaacuuuaaaguuauaacuauuagagauuauauuuuuaaguuauaaggcauggcacagacaacuuauauuuuuaaguugcgaaacacggcacaggcacauaaugaaucuaguucaacuggcccuauuuuugacuuuuuaaaaauauucauggauggggaggcugcgcauguguggggacaggggguacacgggaacucuauuuucuguucgauuuugcugugaaccuaaaaucacucuaaaaacuaaaaucuggguuacggauaguagcacuggguuuuuuucuuaaauaacuuaucaacauagcuguugccucaaaauaccccuaaaaugccauuaagcacguccccaggaaaucuucacuuugcaauaagaaagaauuuaugggcugguaccucuuuggcgacggugugccagugaagaugaguuucgcaaacauccauccucuccugguguaagaauuugcacuugucaggaacgagaagggcaucacuuacaaacucaccaacugaaagaaaggaaaaccacuucccgucauuccaucuguaucacaguguucuuaccgcagaagacaucaaggaaagauagacuucaagacaaguuaaacagccuuuuaaugccuaagcaacccaaucaagacccuacuaccuuuagaauguuacgucuggccuccuuaagcaacuccguuucuugccacuucaaguuugaugguuaaaauaaugccuaaaugcugcaagugaaauugucccuuaauuaaucugaauuucuugcuucaaaauuaauccuaaaaaagcugcuuaacuagagaaccaauuaccauucuacuacaacaggggaguaaaauauaaauauugacauugucuagguaagcauuugagcagaaucaauauaaaucccuacuuuucuuucuuggacauuuuaaucugcuuguaaguaacagaaauuuuagcauuuuucuacuuccuaagcaaaaaacccaaaaguguauuuuauauauauguuuacauaacacacauaagagagagagaguuuaauucaguuuauucugaaaacugucccucagacuuuuguuaaaucuuuaaagaaaauguauauuaugcaaauuauuucuaggcauuucugguauugaagauauaaagauauuacauaaaguccuacaugaacucagucuaaugaagguaaaagauggauaauuaccacauuauauguaagcuguaaacuuaauuuuuguuuacugcaauauucccagcuuuuagcacagauucuugcacauaguaggcaauaaauaucuguuaaugaaugaacaaguuaaauucuguaauagagauaaggaaagugucaggccaguaucuugggugcagugggaaaaaccucaaagaagaaacaauauucgagaugaaucugaauggugagaaguaguaugccacaugggaaaugaauugaacuuccauaacguaaggauagacucugucuugcuugccauuauacccccacaauuccuggccuaguucugucaaacaucaagaacucuauuauagaauccaaauggauggauggauggguagcaaaagacccuucaaaaugagggagccuccugugcaaagacagaguaaagaaccagcaaggcauauuugcagcccaucuggauauggguggaagcagaaagcaaguggcaaagggaguccagaaggaaguagcacuggggaagcaugcuggacuccaauuuuaaagaggcuuagguuuuggaugccauuuuggaagaagcaacauaggccaaaaguuuuuuuuuuuuuuuuuuuuuuuuuaagauagacucuauaauuaagugaaggauagaucagcauagugaaaccaugaaagcagggagaccaccaaguaggucacugugguccuucaggcaaaacaugcaagaauagacauaaacccacaacucccacggagcaaggaauacagaucguccacacagcagcaaagacaggaaugaaugucuuucuuucauaguacgcuauagggcauuuucugaaaugcaacauaaagagggauuaaaagcccuaagaaggggaaggaaguaacuuuucauucucauaaaaggguuuaaacuuuagucuguuucuagcucaaacauguaagauguagcaugauacugaaguacuuauuucaauaaguacuauuuagauaaaaaucuaagcaaaucauaggggagaauaagcacuguaucuugucauuccuuaaaucuuuaaaaugaucaaugaugcccauagcaguauaguguguguugcagggaaugcaaaaauuaugagacaugguaccccaaaggcugcaggugucacuuugcagggaagaaaccagugaguacugagcacacaccccaugcagcuccacagggccacaucacggguucuuuuauaaaccucacuucccaggggaggaaucuccgccaagaaaccuaaggcuaccuaacucaggagauuauaaccuagccccagagauaagcauuaagauauaaauuauaaggaaagaaauaacaugauaaugcaaaugauaccacauuucucuuuuacauagaaugauauaaaacaaaacaaaacaaaacaaaaacaaaaaacacaagaagaccuggagaauggaaaguaaagguaaucucauccaaaacaaauacaccauucccagguggauuucucaggguuucugagggcucucaggguuucugaggucagggacuaacccuagcugcuuggaagaauaccugauaucugaggcaucccaauuuucuagguuacaggaggccagaaguacccuauggccugaagaugcccaccucaucugucagcucugcucagucauauuugcaaauguccaaacuaagaagugaugcuuuucuauuugacaaguaacuacuggaaagauuaaaugccugucauguacaaauaggucaaagaguuuaaaaaaucuaaugcuggcccaaagcuacuaaaucaguucgugagaagagccagagcagguaucagauacacucgaccuuggccugcaagaguucuugggggcauaaaucagacaguaagugccaaaccacaaaaccaaaucaucuuguuuuaucugcccuuagucaaucugcugacgacuagauuauaaugcaaagcuaaaguuaccaaaacauauuuacuuauucaccaaaaggacauguacugcauuaaucuuuuuguuuguuuguuuucagacaaggucucacucugucacccuggcuggaauguagugguuggaucaauggcucacugcagcuucgaccuccgggggucaugcaauccucccaccucagccuccugaguagcugggacuacagcugugcaccaucaugcccagcuaauuauuucacuuuuugcagagacagggucuagauauguugcccaggcuggucucgaacuccuaggcucaagcaaucugccugccucagccucccaaagugccgggauuacagacaugagccaccacgaccagccagucugaacauuuuuaaugaggaguugguaaacaagcuuuucuuaaaagccugaauuaauuaaaaguugccuuggauauuaggaguucauuagcuaaggauguuacucuuacuuucaucuggcagaaaaucuauccaagagaaccauauucuugaacuuguguuuaggacagagguuggcaaacuacuacuuguggaccaagucugcccacccaccaccccccugcccccaacaccuguauuucugcauuagacugacuauaacaauuguucauuauguuuauaagugguuacugaacuuucuaacuugcaaaacauuucauuugauacugccaagauggucuuagcuucuuauauugcacaaagcuaagaaauaugugucccucaaaaugagaaugguuuuuuaaaggauuaaaacugguuacuuaauaagcucucaggacuaauggcaaaauagaaaccucauuguauucuaacauuaaaauaaaauuuagcaguggacagcacugcuuacauuacuuuuaaaauuugaugaaacauguuagaagguuacacaucagaaauuguaagcgauucaaccacaaaaaucuguuuuuaaaaacuuuuaauaagcguuaagagugcuaaaaguauaaugaagccuuuuucaccaacuggcuuagcacgguuuauauuuucucuuuuuaauuaaaaaauauuguacuuaaaaaucuuugcuaggacagcaguuacauggaaacuguacuuucuacucaaacuugcugugaacuuccacugcuuuguuuuuaaaaacaaaguuuauuaauuuuaaaaagccuaugaucguauauaccuggaguuucucuccacagccacguauaccuuauuuuuauaaaugcuucugcuuauuugcuuugaucuuucagguaaaaagaguucuuaacagaauucugauguaagagaucaaagacuaaaacaaauuaaacaucauaaugagaaaucauguuccuguuuacagcaaacuuuaggcaauuuggcaccauuuauuucaaguggauaaauucaucaauauacaguaugcauguuuauugagaaacauacaaccugguuucuugcuaaaacaauucacaauuuauauucaaaacgcaugucacacaccacacacacacacacacacacacacacccaacugaaaggguguuuucaaagcuaaugaacaaaaucugggucuggcuucuuggcuaugaagucuuggcaaggugaacaaggauggcaaauucaauaggagucugcaggccucaaucugcuagcucuuugguggucuuugggaggacugucuagcucaaauuaccucauuuugcagaugggaggaaaagagcucaggucaagugacuugcccacagagccaacuggcagaagaacuagacugaaaauccaggucuccaguucuccauccaagagugguaacucaacucacucauuuaaacucuguucaaaaugguucauuuggcccauuuccuuuggcuuuuacaaaaguaguucacuuuuagacugugaaguacuuuaauauuauaaucuacaauguggucaauuugacaauaaaacuagacuuaaauuagcuagcaagccauauagaacagcugggaaugcagucagcggcagagaauagaccacaugucaaaccguggcuuaaacacacgguaggauuauguaucucaccuaagaagugacacugaagcuagggccacugcagauauuccaugaugccaucagggaccagcguauuccuaucuuucuguacugccauccugagcacguugguuuuauccucguguuuuauggucacagaaauucaagacucuguguccaaguuccagacagaaggcaggagaaacaagacaaaggugaaagguuuucuguuguuguuuuuuccucuaauaaagcuuugcuguuacuugggagggacauacuccucagcaaauuccacugaggccauaugugccauuacugugaucuggucacaugcaccugcaagggaaucugugaaaguauuuucagcagagcacauugucacccugaacaaaaaaaaucuggaauucuuuuagaaaggaaaaaaugggaaugaauaucaaacaggcgaguagcagaggcucccacacuauggaauuuaaaguauauuuuucgauuucuuuauguugucuuuucaaaagacagacagaauuccaggaagcaaacagaauucagaguaaaaaguacugcaacuaaaaccacaguaacuucccaauccaugacauugggaagaaugagaagggaaagauguaucaaaacugacucugcugccaggauggcggcaccugggggugucaucccagcuacuugggaggcuguggugggaggaucacuugagcccaggaauuugaggccagccugcauaacuuagagagacccuaccucuaaaaauaaauguuuaaaauaaagacauuaggccgggcgcgguggcucacgccuguaaucccagcacuuugggaggccgaggcgggcggaucacaaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaauaauaauaaagacauuaaaauaaaaaaaaaacagacugcugaaguuuugagcaucagagugggguugaguagauuaauguaaaagauucuagagccauacacagguucuucaaggcacagauuauuugaauaucagauuaaaagacaauauuucuaugaacugcuggggacuaaaaugauguuggccagaaucaugggaaugaaaggccaaaaaugccugaggucuuuggacuucugcccgaggugugcccucucuuccucaucucucaagagguaaagaugauucaagaaagugggggaaauguucuggcaauguaauuacuguaaaaugccaaagccucgguuuccuugugcuaugggcccagaucugccuugugaagauaaaacaccaguauuguuaguaacucugaacugugugccugccaccacccucaauacuucacgugcgucuucucucaccguccucagaaccacaccaaagcagcuacaaugauuucacuuuauaagagaaggcaagggccgggcacaguggcucaagucuguaaucccagcacuuugggaggccgagacggguggaucacaaggucaggaguucgagaccagucuggcuaauauggugaaaccccgucucuacuaaaaauacaaaaaaauuagccaggcgugguggugcaugccuguaaucccagcuacucaguaggcugaggcaggagaaucgcuugaaccugggagguggagguugcagugagccaagauagcaccacugcaguccagacugagcgaaagagcgagacuccgucucaaaaaaaaaaaaaaaaaaaaaaaaaaaaaaaaagagagggugagacugagagacuauguaacaguccaggucacauagagaguaaauggcagaacugggagaauuaaaugaauuaauaucccuaaaguacucaacuagugcccagaacaaaguugcucaauaaauuauauuaauaguauccuucuccccaguaucuaucucaucaaccacaguaguuucucauaauaauaaucauaguaaucaaaacagcaacagcuacucuucaucauucacuaaucaccuauuucgcaccuacugaagacacugggguuuuauauguucauugcaccaucaccaccuacuuguagccccacagagaugacaugguacuguuuuacaugugaguacugcuuaugauggggugaauacaugacagcaaucaacacagcgggguggagucccuacgacuggagaagcagagaaucugagugaucaacucuuucaacucuugcaccgagugcugguccuggcugggaggggguguuuccuaaauccccucuugcagccacuguccuuuauccacuaacucuucacugcauacuuacaauuaugucucagugcuaagaauacagcagugaacaaaacagauaaaacgauauaugauccuagcggggaagcgauaaaaaauacagauaaaaauacagugucuguuggaugguaauaaauguuacauagauaaagcagagaaaggggugguuuguuuguuuuuucugaggggugaaauuuuaaauaggguggucagggaaugccuacuugaaaauaugacauuucagugaagacuugaggaagugagggaacaaaguauucagaaucaaagggaagaauauucuagccagaggaagcaacaaguauuacacaaagucuugaggcagaugcaugccuggugaacucacagaagaacaaggagaucagugcugucguggaggaaugauguggaagagaucagugggcaagcgagugagugacagccaggacaggacagggacagcugacugcacggggccuuaaacauuguccaacucuggccaguacucagaguaaugcuggaaggcucuggggugguuuucuaagcuaauuauucuugcccuagggggucaagacuagaagugagaagaccaggaagggggcucuggcauuaauccaggugggagaugacaaugacuuggaccaggaugagagcaguagagguggugcguguucucagauucuggaugucgucugaaggucagaucuaaauaaucaaauagaaaggagucaagaaucuagcuuguuucuauuccaacagcuagaagaugcuuuauacugaagaugauggaaaagucuggacaagacuuuccuaauuuuucuguguagauguguagacagguagaacuuuugagaauuauguacuuacuaacuuguauacacuagauauguguauaugaaaaugacagcuacagauaaauguuuucuuaagugauuuuuuauuuuaccauuucagacucuuacuccacaaauuuuuuugucuugaaugugcucauuauaugcuaucuuuuguaacuuucacauuaacaaauaggcugggaaaauuuuccugggaggcaucuguacucaagagacgggacgauuacuucacagaaacagccaaacauuucucaacaaacuuuccaugugauaaaacuguuaugguuuuagcuucagagugugggcaguuacuggguucucaaagaggacaugagggugaauuacacauccuuuuaaaaaguggcuguugccgucaccagcauuucacuguaacuauuaccggauaauagugagaacugacagaugggauucuucagaugagaacuauuugccagaugguaggaacuaaauggaucaagauaagcaaaaaggcaaaagaagugaaaacuaaaaguuuuaccuaaaucaucucuccaacuuuuccaagugcacagauccagccucacauacguaccauauacacacacagauggcagagugaguauaagacagaauagugcuggccgggagugguggcucaugccuguaaucccagcacuuugggaggccgagguggaucacaaggucaggaguuugaaaccagccuggccaauauggugacacuccgucucuacuaaaaauacaaaaauuagcugagcauguuggcgcgcaccuauagucccagcuacucgggaggcugaggccgaagaaucucccgaaccagggaggcggagguugcagugagccaagaucacaccacugcacuccagcaugggugacagagcgagacucugucucaaaaaacaaacaaacaaacaaacacacacacacacacacacacacacacagaauaguguuuaacccaggcucugaauaacacuggucuuaaaauaauaaaaauagugcaaaggauuuacuuuaaaaaagagaaaagaaaaaaaaaaccacgggaacaaaauaaguauuuauggccaggcaugguggcucacaccuauaaucccagcaauuugggaggccgaggcaaguggaucaccugaggucaggaguucgagaccagccuggcuaacauggugaaaccccgucucuacuaaaaauacaaaauuagcugggcaugguggcgggugccuguaaucuuagcuacucgggaggcuggggcaggagaaucgccugagccggggaagcagagguugcagugggcugagauugugucauugcacuccagccugggugacagagggagacucugucucaaauaaauaaauaaauaaauaaauaaauaaauauuuguuagcagucuugcagcuuuuaaaaagauccauauagguguggguuaacaaauuuuuuuauauuuuuuauuuuuuauuuuuuuaagaaagagucuuacucugucucccaggcuggagugcaauggcacgaucacagcucacugcagccuugacuuccugggcucaggugauccucccaccucagcuucucggguagcugggacuacaggcacaugcuaccaugaccagcaauuuuuuuguauuuuuaguagacaugggguuaugccauguugcccaggcuggucucaaauuccugggcucaagcaauccaccugccucagccucccaaaguauugggauuacaggcaugagccacuguacccagccuggguuaacaauucugauacggcuacgcacauauacugaaacugaacaauuaaguacauagaugguggauggagugagaauuuauacauaaccaaggaggagagauauaguguccaugugguaauacguuagaguaggaaacauccggaugaacuuguauuuagcuuaauauagacuagauauuauagcuuaauauaaauacaacuaguuagcuauagaaauauuuauagaucugcauaacauaagggugaacauggacaaauacauugccuugcucuaucaacugagaagucuuaaaagcaaagaaacuccaguggcaacgagcauccuuaacauccagauuuuaauacuauucuccaauaacauuacucuccaauaaaaggaacaagggcuccuuggaggaacagcugauucuaggauuagggcugaaaauaugcaagaugagacugcagcaucuuguaagaaaaaaaaaaaagaggcuaugucaaaugagcauaggaaccaagugaaagggcuucuaauagcuaaagccggaauaauuugagcaauaaaaauuaugaaguagugcuggauuagaaaucaaaguacaauguaaauauccaugagucuaaaugacugaaugaaugaauacauaaauaggaaaaaagagacaaaucuccugcgcagaagaauuccaaauaauuuauguagauacucugcccucaagaaaaugaagcauaauucucugcuccuuaauugugggcugugcaaacugacuuccuuccaaagaguagagcacauaaagugggaagacgaguaauuuucaaguggagaaacucaacaaccaccaccugagccaggugaucaaggucaaugccaacagggcuguaucauguugauaaacacguacccuugauaugaugugaugaaaugggcauuuuaccucuguggucuuccuucuuaaaaccaauaaccccaggcaaagcaugagaaaauucccacagaggggaauccuacaaauuaucugaccaauacaaaaccuuuaagguuauuaaaaaacuagagaaguauaaagaaacugucauagccaagaggaaaggaggcuauggagaccugacaauuaaauauaaugcgccuuccuggauggcauccuggaacacagaaaggacauuagacaaaaacuaaggacaucugaauaaaguauagacuuuaguuaauaaccauguaucaaaauugguuuacugacugcaacaaauguaccauauuaauauaagauguuaacaauagggaaaacuggaugcaaagccuaugggaacucucuggacuauccucucaauuuuccuguaaauuuaaaacuguuguaaaauauaaagucuauuuuaaaaaaauuuaauggcuugauauaaaaguucacauaauaaggugucaugccaaacuccuacugacugcaauguggauggcaccagguucaagagccagaagaggcccagagcuagugaaccguaugucucauaggguuuuacugggggcuugcauacaggguagagaguccaguggugguggguuggacagaggaaccgcagccgcuugcaaaaggcauguggucucuacagcauucucauuuaacacccucccccuaacaaucuccaccuggcaacuuccacuuaacucauaacaaagggucucaauccccggcgaggcccauguuccacagaaggagaugagggcucagauguuccuuacagauaaggaauggcucucuggguuagccacuccuggauuucuuuguuguuguuuuuuuguuuuggguuuuguuguugcuguuguuugaaacagagucucauucugucgcccaggcuggagugcacuggcgugaucuuggcucacugcaaccuccaccucccggguucaagcaauucuccugccucagccuccaaaguagcugggacuacaggccugcgccaccacgcccagcugguuuuuguauuuuuaguagagacgggguuuugccacauuggccaggcuggucuuggacuuccgaccucaaaugauccaccugccucggccucccaaagugcugggauuacaggcaccggccaccccgcccggcccacucccggauuucuuaacucagaacucagaaucaggugcaccugccacacaggaucauugucagggcauguucaagucaagugaucccugucaggugcaucuaccauacauagaggcauaccuauuugauuccacaucaacauucuagccuucaaaaaaaagucuauaaaauuauuguaguugaaaagaacuagaauuaaaaagagcuuaccaacucaggcaucucaucugugguaucuauuaauaacuagacagcgcuugguuugacuuuuuuuuagaaaaaaauauaaguaauguggcauuuaaauuuuuuaaaaauucaagaauuucaaaauuaucacauauauaccgaaaauucuuugcuuuccaaauuuaaccuugucuuaggaauguaaacuaacuggucagagaauucauuccccuuuacaaaugaggaaucuugagccugaugagguuugcacaaagcuaaugacagaggugggcucaacucugaaaaccgacucucauuccaauguucaggaccccaagaaauguuacaguagucuuacuaauuuugaaugacagcuuccucauuaaccaacccaagauaaguuauaggugcuuuuuuguugccucuuuuugacugcacuauuagucauaucuugauuuuaucaauaacaggacuucuuguuacaaguauuuaauaauuccaacauucguuaaaagauggaauuguaagaguaauaguuguuaaagcuuuccagauuagggguuuucaaacucaaaccaugcuucaaaaucaccugggauccugaucagucugcagauucaucuucucccuagcuccacagccuagaucugauuuacguguucugggacgcgccugaaaacagaccuucccaggguggcucugcuucagguggcucauggaucacacuuugagaaaugauauuuggagcagggcuucucaagcuuuacagugccuaugaaucaccugggggccuuguuaaaaugcagguuuugauuggacaagucuagggugggacugagucugcuuuucuaacaagcucccaagugaugugauucagcuguuccuuccggcaguaagggucuacuuaagauaacccauuacaacuaaucucauuaagguuuuuaaaaauuuuaaguuacaaguuauugcuuuguaagacacucuuugcuuacccacuuuuaauuauacaguuuaguguuaaguagauucauaucguuguacaaccaucacuaccuuccaucuccagaacuguuuucaucuugcuaaacuaaaacccugcacaccauuaaacaacuccccauucccccaccuccacuccccauucccccaccuccacuccccauucccccaccuccagaaccuggaaaccaccauucuguuuuccaucuuuuugaauuugacucuucaaauucaaaaagguaccgcauauaaguagaaucaaguaucugucuuuuggugacuagcuugcuguguccuuuuaaaaaauaaaaauuuucaugcuucucuuccauaaaccugcaucucauccuauagauuugucacuuuuggcaccaacuuaaggacugagcgccuuuucacacaucccuaagagccaagcugcuccugguucgccuuuuguuuaauuauagaaguuacaaaauaagguagaaagaguucuagauuugaaaacaacacaaugacucaagcagaucaagugauuuccaaauauuaaaaggugauaugauaaaugccuccuggccagagaggugcacauagggugagagacaagaauaaaaauuaaaacuuaacauaauuugauaagagaucaucucugcuacugcugaguauuacuaaauaccauucuaugcagguccauguaggauacaaaagaaccgagauauaguucuggaccaaaacagcuuggagcagcuuugucucacagaaauauaauagaggccacauaucuaauuuaaaauuuccuguagccacauuaacauaaaaagguaaaaagaaacagguaaaauuaauuuuauuaauauauuuuaacccaguacauccuaaauuucaucauuucaacaugcaaucaauguaaauaauuaucauuaagacauucuacauuuguuuuuuucucccagacuaacuuuuuaauaucugguggguuuuuuauacucacagcauaguuuggacuagccagguuucaaauauucaauggccauggguggcuaguggccaccguugggcaagacagacuuagcaucagauuuuagagaucaauaauauauuucaaggaguagugacuugaauguggacagguugggguuaugggagaaaaucuaaagccaaagacacaaaccuaggcagagaaaccauaauaagcuugaauacacugagacugcaguacaccauuuuaugcgcuaugcuaucuuaacgcauacauuuuagucaaugggaggcauaucacuaggauucuauguuaccaucauuaacccuauugaucagcaaacugcucaucuccccccauuucucuuguugcaguucucauaucauaaauuguauuuauaggugugugauuaauucuaauacagaaauuaauuuaagguuuccuuuagacuugaaccuacuuuagcuuaguucaguccucuguaucccgagagaugagcugaaaaagcagauauaguagagauaauucuaaauucccuacuuuguuucuucaaaauauagguauucucacugguugcuuucuccuaacacuuuccuuucuuucugccuuauuuaaaaaaaaaaaacaaaaaacucaaagccugauagauuuuagagacgcaauuaauuaagguuauauacggggcuuuuuaaaaaccacauaauugccgacaaaauaccaaccagguugguguuccgugaggcaaaagaaccacaagucauuaccaaaaccuuaacucauaugggaagguaaaaauauacagcaugcuguuuucacauaccauacucagaaagccaugugcgagggaggcuauaaucaagacaggaagaggcauuuucacagauaacuucuuaacgggguuguagacugucacucucacgccccucacuuguucuuuccaaccuauuaccaucuggccuugcuccaacaaucugcaacucuucuuucaaggucaagaacaacaaaugccaucagucucuucucagcccuccaguucucugacuacucugccacauucucuuuuuuuuuuuuuuuuuaaagagacggggauacccucugucaaccaggcuggagugcagugcugugaucauagcucacugcagccuccugggcucagacaaccuuccugucucagccuuccaaguagccgggacuaccggcacaugccaacaugccuggcuaauuuuuuuuuuaauuauuuuuuguagagacaggggucucgccacguugcccaagcugaucucaaacuccuggccucaagcaacucuccuagcuucagccucccaauuugcugggauucuaggcaugggccacugaacuuggcccacuuuucuucuuuaaauucaaucuucuccaguuuccaccaaucuaucucaagccaaucauucuuucccucucauuggcuccucuuuucauaauucugauuauaaaguaaggcucugucuucuacucuucuugcuuucucacucagacauaucauccaugccuaagggucaacagccuccuccacucuuucaauucugaccuuucacuuagcauucccagucgcuugcugcaugcuuccaauugcaggguauuaauuacuuuuagcaaauguacuagaaucaagugcccaacugauuaucaaauuccggaaguguacccaaaggacaaugacuaauuccucauugggucaaagucuuuccuauguggaagcaagagaaaggaacagaacuaacacugaacauugugaggagcccaaaacaugacuccugcugaacacauucuauuugguuguagaacccaaccaauauaggccccguugaucgauuuccccacaacaagaggaggucauaaaaaucaugcuuccacuuucucaauagauacuuaucgcucaugaaugucugugaaucagaagaccaugggacuauaacucuacuccacucaaacucuccauacucccaaagcuggaccucaugguccucagaucauguaauacucagacacagcacuccaguaaaccacuuucuggccagaaacucauccuucccauaguuccucucccuuccauccacuacagcuuguucaucaugauccugagguccuggaugcugcagcacucucugcaguuaucaggggaggcuucacugccuucaguucauuucccugccagccuggucuaggacccucagcacacacacucaucacugcacauaucaccaacgaccacccacaugcuuuugaugcccaggcucauuugguccagccuauuucucuccuaagugugagacucaauaaauacacaaccaccccacugugcucuucaagagcuuauuaacugccucuuuuagauucuccuggguauaguccagacuuaaaaugccucacuuugggagacaauguaauuuaaccauuggaggaacaaauguuggucuauauauuucaggcauuuuccaaauaaaaaccuccaagaaaaagcaaacuuguaucuuaaaagaugcagaacuauuuagggcaaaaaguacacagagaaugagaaagaaaaaagaugucacugcauuuaacaaaagaguuaacaauauuguuaacaauaacaagaguuagccaugaaguaauuaggauauaguacuugaaacuggcaccaccuuuuaccaggcauuacaauauugcuaugaguucacaaagcucuguuagagcagaggaaaaagaaggauuugaauucugucacuguacuagcaacaccaccuagggaugaggaagacaauaucuaauagaauaacaaauaaaguaaguauacaugauucaucaagcucuucaauaaaaauguauuuuagaauuuaucaacaucccuuuugaaucauguuucaaaaaucacacaaucuguucaaacacggauagacccccagauaaaucagaaucucucucucuguuaccacgccucuguggacuuagaaaucaccacuuagauuuguaaacaaggcuuaguuucauuauuguaaaucaauuuggcaggacuuaucacuccacagagagcugaaauaauugaauuucuggacuucuaaggaagaagguuuaaguacauuaaggcuuccaaaaggaagaucaccaacucuucuuuagcagaaaaugccccuggagaauuuugaaccauuucuugaucuaguggcaacuggauguuaucaguggcaacuaagguaucugucuacaccugcugaggcucacaaguaaaaacuaaaaaguacugugaaucucugugauaauggagcguaaagcuaccacuuaagucuuuauuacuaguaaguaacggauuuuaagaaaaaaagagauacucaaaucuaucuauagauaaccaaaaaaccaaacaaaacacccagaaaaaucuaagguugaagaacauauauaauuugagacuuuugaaacaaaacacccagaaaaaucuaagguugaagaacauguauaauuugagacuucugaucagagccuuccucaauaauguaaguuuaaaaacuauuaccaaagugacaagaucccaugucagauagcagaaugagaacaaggcuacucuucaacuuagucauccucuuuuaucacuacaacuucaaucauagauguaaauggaaauuucugcuuccuuugcuacuuuucugcuugacugaauuuuauaaugaaaaacgucuguuccuuccaggcagagcacgagugucauucaaauuguacacaccaggcaaagagugaaugcauuuguuuagaugcaaaaaucauuuaaauaugugucauuauaggcugcagcacauuugcggauucggcaguuuaaaauucucuuaagcaauaaagcaaggcaucaaaugaaagugcacucaggcuucaaacaucuucagacuauguuuuccuguuugcacacagcgagccccgccuuccuuuccugaccccacucaaacagaaagcaguggaaccaugcccuagcccauccuauuaccccaaacgucuuccaggucagcaauccaaagucacgugaaagcuccaucuucaguuucccucuccagggagcaaauauuuugaagagcaagcauuccaagcaagcagaaacucagccuuuaaaucaaacuaagcuuaaaaguaagguccugccgcacacagaaggcaacagaaaagugucugaagagauagcucccauuuuauauuuaacauuuagaaaugagaaaacugugugugauuaaugcuuauaauuagaggggguuaacccuuauuucaaauaauguaguuccugucuuucauuuaaaauuauaaagaugacuaaaauguacaugaaaggaaaauuacaguuaggaucugcuguguuuuaacccagaacugugguuuuuugaagaaaaugcuggaaaagauucugauuugguaagaauaucuggauaugagaaucuucuaagaaaggugauuuaccauuuucaggccaaaggcagagaguuucuaacaaugauaaaauuaacaggcuguaggaucuucauucucuaagcuucaggugacccuuuuaaugacuaaauaaaguguguacucaaggucacccacgaggaagaaaaaggucaguucccucucuugagggacccccuccccacucacgcuauuacacagcaauucuagagauucacuucauuuuugguuuauguucaaacugucuggauauuucagggccuucgcuuuuaaguuuccauaauagggcaguugacuauuuauauaagucccuggaaaauguguauuuuuaacgucaucuagaguaggccaccuuugggggaaaacagcuaauggguuaaaaagccaacugguguaccaaguauguacaaaagacaucuuuuauaacaguucucacgugcaaaagaacauucauuaaguauaacaauaaauaacaggcaauaugugcauuuuuccagacccuaagcacuugauaaagccauauugucauuuuacacucauuuuuaguagcuguuuaauugguauuccuguauaggacaguuuuguagguuuccggauuauuucacauucucuucuuccuaguuauaaauuuugguacaacuguaagcucuccucacacuguaauaauuacauugcugagaccacaucuguuuuuuuaaaaaagauauuuugcaaaaaauauauuuaaguugaaguaucugaaauacuuuucaacgucaaacuuugagaggauuaugcuuaauuauauaucuucacaucuuuaaauuguuaaaaaugaaugcauaaauauuuccuagggauuuaugcuugauucauuugauucuuacauacuaguuguuauuuaccggcagagaaagcaaaagcaaaaaaaaagaaagcaaaaacaacaaaaauaguugauucuggugcuaguccagaaucagguugauuucugcaucaauagcaggguuucuacauuaaauucauucaaauuuaauuaguucucugcauaaaaucaagggucuaggagaauuuaauaaaagcugaaaacaauccuauccuuugccugaaacagauuuuuaucccaaaugguacucagcaauaagccaacagagaaaaauggaauaacagacauaugccauguucacgaguucucuguuuaaccuaagaagucugaauuugccauuuuuugauaaggaacugguguacaucuuagaagaaauauuccauugagucugaauucuugguggagcacccgcagaaagagaaccaguaaauaguauguaugaggccuggccuggacauaaugacucaggaaucaucaaugcaggccucugaaaaaccacugcacuuaugagaucuccuagcaaguauguguugugugagaaaauggacaaccccaggguacuccuauuaaacacugauauuuagaauuucugaauucugauucuaaauauuuugcaauauuuggaauuucugaauccuaaauauugcaaaagguggcgcggggaggacggggaagggagccugaaaggaaaauggaggacagcagaaagaaaaucagaagcagcagaaugacaucaguguggggagaaugcacccaucaaccgaugccacugagagacuguggaggacacaacagugcccagugaguccgacaaccagaaugauagcaaagagcucauucccuggagcucaaggaacagaugccugauaacaggugacuguggagggaacuggagguuacgaagaucacacaggaacuucugacuaccauauaaagaagcauaucugugaagagacagagcgaggguggaaguuaaaggaauacacagaguugaaugacuggagugagggaucagggagcucuaaagaagaggaaaaauaugagaaggcuaaauacuauugagaugugaaauuaaauacagggucaguaggccaagggucuuuaugaagucaaagaucagauacaaugagaguaaaggaccuacugaagaagcugugugcacagaugcccaggaauucagacucaccuaagaauuuagaacaaagguggaaaaagaaaacuaagcucaaauuauuuaaauaguacaacaggguaacuucuugacauacugaacaugagccuauucauguuaaauaugcuuggagaauaucauuaguccauggcuuacaaucaauucuaagcuuucaagaaagcaagagcuacaggaccuauucauaaaaauauagcaacauugggaaacuaauuaucuucccagcugauaaagauaccauccaauaaauagggggaucuucagugacauccaaaccuucaaaaaauauauuuuaaaauguuauaccacguucucggaagguaguuaacacuaaaaaagauuugggggaacugaagcugaguaauauucuugaaaauacagguaccuaaucaauaaauaaagagaaugccccccaaauuuuucauggcaugaaaauacuuaaagguuuaagaggggaguaccuacaucuauuaauacaccaaacaccuacugaaacgccacauucauguaaucacuuaauaaagacauuaaaauaggaugacaggaguucauguuuagcauuuauaaauaguauccuaaccuuuaagguacaacauaagaaucugaaauuucuaaaaucuauuaucacugaauaauauuuagaagcagauuucugugaaaauuaauucuuaaggccaggcgugguggcucacgccuguaauuccagcacuaggccgaggcgggcagaucuguugaggucaggagaucgagaccaucgugggcaacauggugaaacccccucucuacuaaaaauacaaaaauuagccaggcaugauggcgugugccuguaguccuagcuacuuggguggcugaggcaagagaaucgcuugaacccgggaggcggagguugcagugagcagagauugcgucacugcacuccagccugggugacagagagacugugucucacaaaaaaaaaaaaaucuuuaucauuagccuuaaaaacuaaggacaaugaaacuauuauaaaugaaucuaaugguauguuuuaucucuaaacacagaugccucugauacacugacuuuuuacuagacauguguaggauagguuuaacccuauuucuggaguugaauguucuuuuuauuaagauccaaagacacuugguuucuucucuucugagaucccuauguuacuucuugguuguuacauaaaaccugcucuuccuuuguugaucaauaaggaguaaguaaaguaaaugauuuugccauaaucucagaaauucuuuuaggcaugugaaauugcugcuccacaucuucugucuuucuaauguuugggcuauucuuucuuuucccuuuccuuuuccaauauuuggcuacauccucaauucauucauuaaaucuauauauuuauuaaauauguacuauguaccagacauguucaagcucugggaauauuucagugaauugacaaaagucucaauuaucgaagagcuuacauuuugaacaaaaagcaauuauuucccaauguuugagcaccgcaggaaaggguuaaccaucagcaucaugcacuacuuauucacaauauagcugcacaauuauuguuuccucuuaucaggcccucaaagccacugauuauaauacuuugucccaaccuauuacccuacaaguuugcuaguaaaauucgaagaugaccaggagcuauuugcaggauacuacaggcuaugaaaguauuacuccagaguauaaucaguuuuuuccccaauccaauuguaucaucuauuaaaagagcuaacauaauaaaaagcuauauccugaugcccagaauuuacagcguaacaaggacuaagaaagcagguaucuuagagguaacuuuagccuauuaaugacaugugcaguacaaauaaaaccacauugaauguacagauauuuuucuggacaucgaauaagagaaauaaucaaaugaauuaaugucuguccaaaucaaaaaucucuacaaguguuccaacuuuaaugaaccaacuuaguucuauucuaauuuucuauuauuauuucucaaggcuaccaacacaaacuacuuucccuggaacauccccaugaauauauuuauuuauuuauuguuuaauuuuuuuugagacggaguuucgcucuugucauccaggcuggcgugcaguggcgcgaucucggcucacugcaaucuccgcuucccgguuucaagugauucuccugccucagccuccugaguagcugggauuacaggcgcccaucaccaugccuggcuaauuuuuguacuuuuaguagagacgggguuucacuauguuggccaggcuggucuccaacuccuaaccucaggugaucugcccaccucggccucccaaagugcugggauuacaggugugagcuaccacgcccaggccccauaaacauuuuuaaaucuacaccucuucauuuucuuuacguaucccucaggauccacaucaugggucuacuuucuuucaaacaacuuuuaccauaugcuccagcucacacuaccaucucccuaccuccuaugcucacaacaaccccucauaugacuuacauuaaaaaguuuacaauuauuaauuaggauuggaaguuuccaacagauuuguagucaggagagacuauucagggaacaugagucuaguuuugaucacauugaguuugaaguuccugaacaaacacgugucacuaaaggagugaagauaaacaugcuucuagaguaaaaacaaucacaaguacaaaccucuacaacaucuuacacagggaaauucagcccuaaagucuaucaaaugggcauaaagguaauuuuauauuuguauaaucuuagguuauagccaagaaaaagcaaacaucuugugaaguugagauauagcauacaacaaacucagcucaauuaaaccacaguuuagcuuuaucuaauucaaaguuaggacgccuuuaacaguaacuugacuugcaacuucuaagcuuaaaagaaauuuuaggcugggcgcaguggcucacgccuguaaucccggcacuuugggaggccgaggugggcggaucacgagaucaggagauggagaccauccuggcuaacacgaugaaacccagucuccacuaaaaauacaaaaaauuagccgggcgugguugugggcgccuguagucccagcuacucaagaggcugagacaggagaauggcgugaacccaggaggcggaggcugcgaugagccaagacugcgccacugcgcuccagccugggcgacagagugagacucugucucaaaaaaaaaaaaaaaagaaagaaagaaaaaaagaaauuuuccagauuaaaacaaaugucuggaaaccuuaaacucaacuucuuccugccaucaaauauaggccuccuugaucgauuucuccauaacaagaggaggucauaaaaaucauucacggccaucucauuuaguugucucuucugcaacuuacucccuaaacucugugcuuaaauaacuauucuccugauuuuuccgcuguaggucuucccacuauggaacaugagcccaccccuuucccuucccaccauccuacugguaugguuuuaccccauauauggcaucuguauugugagucugccagaacgcucauacuuaggcguauuuuuaucuucguaucuuacaacgcuguuauuuuguacuuuuggcuuuucuuugucuacaguuaauauuugccccauuuaaaaaauuugccucauuuucuaugcauccaucaauacuguaucuuucccaaacgcuccaguagaacccuaagaagcaugcuaaguacaggaaaaucuuuaacgcagguaaugcaucaaugccauuuuuuccuggaggccucucuccugcgaccagccucguucgucuccuccaaucuggacuagcugcucuccagacgguugcacagcuguugccugagauuucccuucacuauaggguuucaaagccaaagccuaagacucacugacaggagaaggaaaaaaaaaaaaaaaaaaagacagacacuccugggaugcaucaccaacaaguugaaauuuaucaggggauauggaagagggaauguuuaaugaaaccacucagugacuaauaugauaaaagagaaagacgacagaauuuauccuuucacugaacacugaaacaaauauugagaaccuucuuugucaaguacuaaaaucugaauauuuccuaacagccuuugacacugaaauuaaaauacgucuuaauccagacuguagauucaucuuuaugucguuucuuauauccaugaugcuuauuuguguaccugaaaaaaagcauauucuuuuccucagugcuaauugagaacuggcuuuaaaaauucauucuuuauuuaaucacaaacaucaaauaacuuuuuaaaaauauaauacgugagaaaaaaauuguccuuaauuucauuucaguauucccuucauaauaaguaaauaaacaguucugcuuuuauggguauuaucuggaauuauaaagauaugcuguaccuaauucacaauaguaaacugaaaaauuuuaaguccacaaagaagcacuuguuuaguucuuuuccuagggaagaaauacaucaaaaguucccauaauuuauuaugagaagucuaugucuaauauauuuuacauauuuauauacuauuuuuaauguaguucauuauuuaaaacauaaugaaagcuuggguuucauggcaaaggcugaaguuaauucaguuaaugccauuauuuuauguuguauguaagcuacucuucuaccccaagaaucguaauaauagcugucuguaccacucuaaacacuuccuuaaauuucauauucuucaucuggcuacaauuauccacauggcauaaaccauagagcucucaaucccaaaaucuuaaguuuugucacacacaaauucuguuuucuacuacagcugucuggaaaguuauuuacuggcuugaaugguuaaaaaaaacaucaaacucggcagggugugguggcucacgccuguaaucccagcacuuugggaggccgaggcgcggaucaccugaggucgggagcucgagaccagccugaccaacacggagaaaccccgucucuacuaaaaacagaaaaauagcugggcaugguggcacaugccuguaaucccagcuacuuggcaggcuuaggcaggagaaucacuugaacccaggaggcggagguuggggugagcugagauugugccauugcacuccagccugggcaacaaagagugaaacuccaucucaaaaaaaaaaaaaaaaaaucaaacucaagacaauaucucaagauuuuuauuugcuuuggaaaaugacacgaugagaagaggguucugaagacaaaggggaaaacuguuuccuuucucugcuugggguagggacugauggaaacacagugcuugagaaagaugcucagaagcggcuagaguagaaaaagaacuuugaagaaaguccacuuucuucuuugauuccucaucauaaccauuuguaaucauuuaccucagaauaaaagagaaaauuccacgacaauaaacacagcuugagguuagcuagaaauacuguucacauuaaauuuaugguaaaacagcaagcugaaauggugugggaauuaucuaauaauuuccaagacugaauuacgcagcuauaaagcaacagcagcuguuuacugguuggcccagaaaaguucacauuucagaccaccagaucagacauaacaguauuaauuccucauacagggagaaauuuuugaagacucaacauaacagaaauccaguguucagcugauacguuauuaaaucugacggcauuuuuauggcauuuuuaaacuaugacacagcuucaggaaguccugaaaacuugagccucuaaaggcauuuuugucuuuuuuauacaacauaggugcaaaaagcugaaaaaugugaccaugaccgugugaaauuuaaauuauaccuuacuuuuuauuuuuacuucuguggaugccagugucugucuuagucuguuucucccuauauacacuguauauggaaaccaacuaaaagccuaucuaggccgggaaugguggcucacgccuguaaucccagcauuuugggagaccaagguggguggaucaccugaggucagaaguucgaaaccagccuggccaacauggugaaacccugucucuauuaaaaauacaaaaaucugcuaggugugguggugcacgccuguaaucccagcuacucgggaggcugaggcaggagaaucacuugaacccgggaggcagagguugcagugagccgagaucucaccauugcacuucagccuaggugacaggagugaaauuccgucucaauaaacaaacaaacaaacaaagcagcauccauaagaaauuaacacaaaauauguuuagcuguucauuugaaagcaaaugacugggguuauaauucacuuguaacacuuaauaaucucaaaguuuugauuugugaauuccauuaucucuuggagaaagcuacaacacacauauaauuaguggucuaacucaaauagugcuggaauuuccuauagaaauggcuaagcaugaauaaccaaagucgcaggugauuccuaagauucugcucauuuuuuaaguuuuuuuuuaaguuuuuuguuucuuucugcucauuuuuuuuacaugacugaauuaaaauagcuuuuaaaaaauuuccugcuuuccgccggguugugguggcucaugccuguaaucucaguacuuugggaggcugaggcggguggaucacgaggucaggaguucaagaccagacuggccaagguggucaaauuccgucucuacuaaaaauacaaaaaaaaauuagccaguagugguggcaggcaccuguaaucccagcuacucgguaggcugaggcagagaauggcuugaacucaggaggcagagguugcagugagccaagaucgcaccacugcacuccagccugggcgacgaagcuagacucuaucucaaaaaaaaaaaaaaagaaaaaaaaauccugcuuuccaaagauuacugguaucuuuuacuggaaaaugguuccuaaagaccauaaucuaggugcaguacugguguuuaccgcuacugaguuggucuuuuaggccuuuucauuauuuuuaggccugcagcggacaguauuuauggggaaaaaauguuaucugaaaucuacaacaauauguuauacugagaaaugauaccuaaaagucaaacucaugacuacaggguaucuuuuuaauagauuauauguuacaugugaaucuucuuuuaccacaucaaaauucugauucucaaauacaugggaugauugaauuaaaauaucacacaacuauucacuuauguuacaccauauuacuuaugcaccaggcucagaauuacacacuaauacuaccaccauuaauagaaaaacaguuguuucuuuacccacaucuucuucucauucuuccccauuaaaguuacugucacaacaaggcuguuuauuucaccugggugcaggcaggcugaguccgaaaaagagucaggaaagggagaugggguagggccauuuuguaagauucggguagguaaaggaaaauugcagucaaaggggguuguucucuggggggcaggggugggggucacagggugcucagugggggaguuuuugagccaggaugagccagaagaaggaauuucacaagauaaugucaucacuuaaggcaaggaccggccauuuucacuucuuuugugguggaaugucaucaguuaaggcaggaacaggccauuuucacuucuuuugugauucuucacuugcuucgggccaucugggcgaauacgugcaggucacaggggaugguuuagcuugggcucagaggccugacaguuacagaaucucuuuauugucacagcauguagcuguggaauacuauauuaucauacuuuuuaccaucguugagucuuaguuuuuauguuucuccuuaaugcucauuacccauccuuauaucaguuuuucucuagguauuuuggguaucugaaacuuguucucuagcagauucuacaggaaaauaaugugaaaauaugcccugaguuauuguacguugauauuuauuucaugugaucauaucugaaugucaguuugauugaauauaaaauccuuguuuuggcugggcaugauggcucaugucuguaaucccaggacuuugggaggccaagauggguggaucaccugaggucaggaguuugagaccaaccuggccaacaugaugaaaccccaucucuacuaaaaagacaaaaaauuagcugggcgugguggcgggugccaguaaucccagcuacucaggaggccgaggcaggagaaucgcuugaucccaggaaguggagguugcagugagccgagaucacgccauugcacuccagccggggcaacaagagugaaacuccaucucaaaaaugaauaaaauaaauaaauaaauaaauaauccuuguuuugcauuggcuuucuuugauauguuaaauguugcuuuauuuuccuuuggcauaaagcacugcugucaaaaaacucuuauuaaaauauaguuucuuuguaagugaaaaacaaaaauauuuccugcccucaaaaauuauaaacuuaguuaccaaaaagcaaaaaguacuauguguauacauaaaagcaauauacauucauuaccaucuugaaaacaauuauuuggauauaaacuuuaaaauuauaaaauaauaguauucauuauaaaugaaugaaaacaguaaugauuuuuaaaaacuacuacucuuaucaugaccaauuaccucuucuuuuugaaaagugaacuaguuccuaccuuaaagacuuuguugacccucugucugaauaccuaaaauacaucuccuuucuugccuugaaaucuuauccuugaaaucuuggcucacaaugcuacuuccugucaagucuuccuuaaauuccugagcugaaaucccauccccuucaggcccacuaucaacucuguaagagggaggcccacauuucacccaccuccaggggcucacacacugugggugaucaauaaaacguacacaaugaauacguaacugaccuuuuauuggucaauuuuguaggacuuauuucucugagaauauucaauuaacuacuuccuaagguggaaauuuggaaaagcaauauuuaaaauuguuuaaauagauuuaaauaguaauuauuuuaaauggccuuaaguagaaauuacaggcgcuuuuacucuaucaauaaaaaaaucauagcuaaauguagggguauccaugcuuauguuaaacucaggaucauaaaucaguauuaaaauuuuccuccauauuuucauaaacaauuauguggcgcauauauuuuauuacaccaacuauaagauuugcaaggcauuccgccaauaacuguuauauaaaaaucaacuaaacacaaauuuaucuaccaggauguuuaucacagcaucauuuauaacaacuauuacaccaccacaaaauaaagaaaaccaccuaaaugaccauaaaaaagaguaaacacauuacagugucuggugugaugcuacauuaaaaauuaugcucuccaagaauauuuaauuucacagguagaguauucuaaaaauguuagguguaaaaagcaagucacaaaacaggaaacgauuaaauaacacuaaaaacaaaagcaaaacauacaugaaaaaaauguagacugcaaggaagccaaaugguuuugauuauuuuuagcuagugguuguauuuucucaacuuuguacguugaauauauguuacuuuuguaaucagagaaauuucuuuugagcacacauuugcaauucuuagcauguacuacaaaucagauguccauuagccuugcuauucauuuuucaaagcaauuacuaacaagccuugggacaauaucaugccaaauaagcuggguuucuuuuucucaccuaucaucuaggaccuacagagauagauaaauucugugcuucaagaaaauaucagcaaagcccacucauaagccauaacagcaguuuuucaaaaguuaucguuucuuuuuaaugccucguuacuuaaugacaccugaauacaacuccaguaaagaagacaaaacugaagauguaaugaaguauaaaucacccaugcuauuagagcucuuaucaaucaaaacauuaguuguuaaaagucccagaaagaggacacaauaccagguacaauaauuaaaaugaaaagaaacaaaacuggaaacggagccaagaaacaccacuacgcuuccuucuuuucaaaaugcgauuguuaaaaaagucagucuccucaacucauccucuguccugaguuuuagaaagcaaaucaagcaggagccaaugcaauugaggcaauuauggaacuugggacagggccaaggaagugcugcagugagccauggaggaugaccuaccuagaagggcuccauuuuuuuuuuuuuuuuuuuuuuuuuuuuugagacugagucucgcucugucccccaggcuggagcgcaguggcgcgaucucggcucacggcaagcuccgccucccggguucacgccauucuccugccucagccucccgaguagcugggauuacaggcgcccgcaccacgccuggcuaauuuuuuuguauuuuuaguagagacgggguuucaccguuguuagccaagacagucucaaucuccugaccuugcgauccgcccaucucggccucccgaaguucugggauuacaggcgugagcaccgcgcccggccgaagacaccauuuuuauagguguucuugcuuaaucaaauggaagagggcuucacuuucuaagucuuccucacccagaaggaaucugugagauaaauguaagcucuucccauucuuccuucuggccugaaacaaauguggcugccauaugcaauuuuggagggaaaaaaaauuaaggaagaucaagaaucuuccugaagaaucagugaugauuaaugcugcuuaaauuuuguugaagaucguaugaaugaacguuauuuucuuuuauuuuggcaucaugguguuuucaaaacuaaaguguauuuucccauacuguauguauaaagcucauaaaguacaacuaccaagagauaaaacaaauuaaugaucauucugugucgacuuucaagucuuuugacuuuuuucuauuauccuucaaugguacuacauacaaauacaaaauuauauguacugauuucauagucuaucuuuugcugauuauaaaagcuacucauuuauuauacaaagucauagaaaauugcuuaaauaaaaucaaaaucaccuguaaucccacuguugggagauaaacacugauaagauuucuuuuccggacauguuuucuuuuacuuaguaugcugguucugaagcaugauuaacguugaccauucaaaggucccaugggaaggccacauauaaaggagucugaugucucuccaaggauggcugauuagccuuuccugaugaagaaaugcccagcaauucuggucauuccuuaugagaccaugauguaaacaaucaagaacauucaagaauuugcauccuucuuguaugcagcagcugggcucauuaaauaaugagaaugaugaagucaucauucucaucacagugcauguauaggucccacacaugcaucucccaugacuucaaaauuaguaggauuuccacagugcaggucgguggggagaggaggcgccaugggcaccaauucucuagcacacuggauuacauacggggauuuacaagauccuuaaagucuacaauaaaaauguuuuuccauccucaucgccaucuuuaaaguuuggugaacucucaugugacauuucugacuauuguguuguacugaugugucucaagagaguuguuguuuacauaaauucaaagaauuacccugguauaaaaugucacaguauucaaauacauccuuuccaugcuaaagaagauagcuguagauaauugauacaaaggcagccaagaaacccagaaaacaaggcaugcuuuuccuaaaauuguauuaaaacaauaaaauucaaaauuaauaugaauugaauaccuuucucauuugaccauaucugauaagauuucuggucauuacuacuuacacauuuggaaggucuuaauuacaaaaugaaacagaaugacauuuaagguaaaauucuuucacuuguaauuccuuuuuuggauuaagcuauuaaccugacuuugccccaauaauucaacaguaauuuauuuuacgcaauguuccuugccuuugcuggucagagacaaguacagaaaagugccaauuucaacaguggaucuauuacaccaugaagagcagucauucaaauggaaaggguugaaagcuuugcaaagaaaauauucuccuugaguaacaguaaugaugugcuugaaucacacaugagauaauuaauaaaauguucacaugauuaagaugaaucuuacccucugguuccagagguacuaccaaaagcaaagggugagaugagaaagccaacuuauucucaagggaaauuauccacuccaugggaagaaaguggcaacagcaaccugacauacuuuccccaugcagacaagaaauguauagcacauauguccgaggcaaaauauuacagaaaaauaauccagugccacacuggauccuucaucugauaaagagguuaggaagguuguaugccacacauaacaagcauuuuucucucuucaagcuuuguuuugaauuuuaacacgcuuaauguuuaagauaauuuuauuuuguuugcuaggucaguaaaaaaaaaaaacucuugucuaaaacauauauuuggauacagucaagagauuuuagagcauacuuauguuaaugcugaacaguaauucuuuguuaagcaggaauaauauguaagaauguuaccuacuacuacuauaaaguagaaaacauaucacauggagauuuauccuauacuaggucaugguugucuccucugucaacacaacgauagcugugaguuucuuuuuuagugcuauugucucuaauucauagugaauauuuguuuuaaaacaaauuuuuguguauacuguaaaaaacacuggaccaauaaucaagagagcuuggacuguagugcugacucucccauuuauuugcugugaguuauagcaagaaauucaaccucucuggaucuugguaguuguauagccugugaagagagacgaagaacuaacacugccugucuauuaagugcaaguaaaauguacaucaguuacaccuaugucccuauguuaccuauguuacaccuauuggaaaaccuauguuuuucaguuccuuuuccugaaagacaaggcaugcucuacauacucuaccagguuauuuuaucaacucuguauuauacucugggcuugagaccuuuggaaaauuugccacuaccuaagaaaaaagcagcaccuauauuccuuaauucuaaucuaagguuaauaacaaaguaagagacaacauaugcucuacuugucauauuagggucuaauuucagguccaauggaaaaggaccagugauucauaaaaugagaaaauaugguaaaaugauucaacacgccaaguaccuacaggaaauagcaaaugauuaucuagucccauaguagucaagaacaguuagugucaacgugcucauuucacaucagacacaaccagaacugagaaauuugcuuaacaugucacaagugacccaacuuuuugaauuauguaccuccacaucaaaggagcccagaaucuguucggaggaugaaagagaaaucugauaaugguugauggcaaagccuuggcaggaauaaacuccuucccugagaaagaauuauuuuauaggcuucucuccauuucuccuugccagucuccagccugugcuucacagcuggguaauuaucugucaguggaaugauauauuuucaagugguucucuuuccauaaugguuaaaaacauaaggugaggacaggucauuaacuuuacuaucaaacagguauuugguagaugagauuaauuauuuaaaaccacauuacuuaggcuguuguuucccuaaauggugcauaaugcaguguagcacaacaaauacaaauauuuggacagucuccguguaauuauaauauuauuauaaaaucuucugacuugauauugagaucugagaacaucuuuuauauccuuuauuacuuguuguacuguucguucacuuggagguuuuuuuguuuguuuuuguuuuuuuaagagacggggucucauuauguugcccaggcuggucucuaacugcugggcucaagcaaucuucccaccucggccucuuacagugcugggauuauaggcuugagccaccacacccaguggaaggagagcuuuucagagaugaggaggcuugaagagcaggggcaaaggaagugaucaacagauaggauaaaauagaccugggguucaaaggauauuugcuacaacaacuggcacuagguaguaaauaacaaucuuaauguggauuucaucuuuccaucaacuuuaauacaaaucauucugaauagaauaugaagcagaaaaaucuauguaaaaugauaaguucacuucugaaacaugacugcaguuuugagugucauaccaggagcaauaaugcccauccaaagcccuaccuguucucagugagcuuacauucuaaugaaaauauauuuggaauacuucauagaacagguaaguaagaaccaaaagaaacaaaucauuaacaaagccuggcccaucaaauuaacagacucaugaucuacuuccuaacuuguacugaauuguucaaucucuguguguuauuucuugguguaauaacuaagugaguauaaaauacacaguuccuggggacagaugacuucuauauuuuuuugaguaggaguucuguaucuagaauuuaagugcugcuuauuuucaucuaauuaaacugcacuuuuugaugaaccagaaaagaguugaggccuuauaaagcauauaggaacaaggaauaaggaggaaaaaggaaacucuugaauuaucagauguuuaagaaaucuaguuuucuacacucucuucaucaauuacauuguaaguaaauucaccaggugaaaucuucuuucuaaugcccaguguuuucauuuuaugucucaaauuaugcacaugaaugaacagcaaucaguaugcucuuaggacauucauuuuugaccauauauuacauagaucuccggaaucuucaguaaauauccuuacuuuguaaguuugcuguuggauuuucuuugaaauauuccuuuuaaccuuuauaagaagucaucagaauauacaucaauauuuguccacaaucuccacagacaaucucuauauccuuauuuacaaccugccuacugaugaauacacuuguggaaaacaucuagauguaagauaccagagcaaagaacuugacuucugcaaugacuggucacauaaaaacaacaacuaggaacagacuaauaaccaaguuagauuaaauauggaguaugacaguuuccagaggaaaagagcacgauaccacauaaaacuacucaauuuuuuuaaauaaaauguugagguaaauuugagguuugugacaaaacaaacauuaaacauuaguaaucagacuguuuccuccaguuugauguaagcagaaaaaaagccuucccaauuccaauuccucuacuaucaccaaauaagaggaguaguuauuguagaacagccuuuuuuuuuuuuuuuuuuuuuuuuuuagaaauuaacaaaaugcugcagcuucacauuagauucuuucuucuagaaagucuaugugaagaaacacacaaggccccuguucaugagaaucaucuaugcgauacgguaaaauaagaauucccggauccgcuacuauaggcauuuuucauucaggaguccuggaacuggcccaggaauuuguaauuucaauauacacccuggguaaauucauucugaggcagggaacucaaaaauacugcuccuauagggucagugcacagaauguaacugcaagaguccaaaacacaguacaacacagaguggcaaugugcugaagaacaagucuguguaugugaccuaacaggagcauccucuuuuucuucccucaagaccaggcccccaaucaacaccagccccacggccggccggcucaccuaagcagcgguagggaaucacaaaguggggaugggucuugcacugcuugcggccccgcuugcaccaguucuggauggucacugguugguuggcuucuaccacauuggugaucugcaguucaggguagaccugggagagcacacaaaaagaaucaauuguuacuugaggcaggggcuggcauuuacaagcaucuaacaagccuccacuguaagguacagguggagugucccuuauccaaaaugcuugggaccagaagugcuuucaaggucucugacuuuuuccgauuuuagaacaucugcauuauauacuuacugguugagcaucuggaauccggaaaguccaaaauccaaaauacuccaaugagcauuuccuuugagcaucauguugacaugcaaauaguuuuggguuuuugagcauuucggacucuggauuuuuaaauuugggauacucaaccuauaccacuauccacuaagagucaagccugcucuaccucugaccaagcuaaagaaauucaguacaaagaaaaagauagcaaaugaacaagcaucuagcuauuccauucaaaauauuaagcaaugcaacuuuuuaauuuauuguacucauuuagacuuaaaauauuauuuuuccaggggagcuaaaauagaaacaagagggggaaaggaggauucuuacaagcauggggugauuuuugaugugaaauaaauugguguaggauaauagucuguaauguccuaaacaaacguuacaguagauauggcuggggauauuauguuuaguaaaauucaaccucccccuaucucucacuaaucggacaaacauuuuacaggauaugacacauagaaagcuuucuauauaaaaauccugcucuuauuccaaguaauuuacaugaaaauaacuuaucgaaaaguuaucaagggugucauuuagauaaaaauaaacucaugaauucucuuugcuccuauaacuaacuacagccccuugcuuugauuacuguugugaauacaucaugguguuuaacugagcacuuagaaugaaaugugaaacuugaucaauuaaaucacauuugugaaauaucaaaccacuucuauuuauuaaugaguagagauuugaaagaaaaacauaaacauaaaaaucuauuucgaaaaugugcauucccuugcauaaaccuugcauugcaacagggugguuguuuugccagauaaauaacaacgaauagagaagugacgguauaagcaagggaaugauuagaaugcugggccaugcaaucucaaguggcaaaagugagaacaugaggggaauuagacacagguaaaaggugguagggaccaguggaaucugaguccacugaucacacuccaggggcuaaagaauguauggcgcacaggacuggagaaagugaggugguaauaaguaguacuuggagagucaaauaauugaaauuaaaauuuuggaggaguugcagugauuggucauugcaaggaguauaauaugaccauuguaagcaaugggugauggagaaugaugaaaacaaggucacuggagggaugagaaucaugaacugacaaauuggaauacuggaaggaucauugagaucaauauuaggaucacuuaagaaucagcaaaugaagcagcuacaccugaugacagcaaggcaggagcuaaaaucuucaaagucugaauggugaacaucgaugagguagaaagaggucuggagaugaccaacagguggaggagcaaagugauuugucugaaagcaugcacuucaagcugagguaggggggcuuuuagggaagagaaaggaagagugguuuggaaacaaaaaugaagaggaaaagaggaaaugaagaggaaaagaggacauucccaccucuaggggcaacgcugugaggauuuugagaaaagaacuucgaccugagaaggcuacaggagaaguagugccuuccuuggagggagaacaagguuucugagcaagauaacauccauggggaguuagacgauacacggaauuucacucacaauuguccaugacauucagagggcuugacaaaucuaaauuaauaaucccuuaucuuugaauaaaaguaacugaaucaggcugaauuuacugcuuccauuuuaauaaggcaguaggagaacuaugcauggcuugaugucaauugagcgugacucaaucucugucuaaaaaguugauauuuuguucaucauggaguuuuuuugcaguaauuuugauuuuuaaaaauauuacauuaaaaauucuuaaucucaauuccugacugccuuguuuaccucaccuuagucccagaccccaaaaaaaucaguuaaaaaauaagguacugugaaugaauaaauaacacugugggguacacaccuagaaaauggaaugucauucaacacuaaaaggaaaugggcuaugaacccaugaaaagacauggaggaacuuaacuaauauugcuaagugaaagaagcccaucugaauaggcuccauacuauaugacauucuucccacuauaugacauucuggaaaaggcagaacuauggagacuaaaaagaucagugguugccacggguuugggugguugggggcagggggaggaugaacagauagagcacagaagauuuuuagggcagugaaacuacucuguaugguacuacaaugauggacauaugucauuauacauuuguccaaacccaaaaaauguauaccgccaagagugaacccucagggaaacuauggacuuugggugcuaaugauguaucaauguugguucaucgauuguaacaaauguaccauucugugggggauguuuauaauaggagaggcuaagcaugugugcagguagcaaguauaugggaaaccucuguaccuuccucucaacuuuucugugaaucuaaaacugcucuaaaaaaccgucuauuuuaaaaacaaaaauuuaaaaauaagguaucaaucaguguagcagcaggggauaaacucagugguagagguauaugcuaagagaacacacaaagaaaucucuaaaucagaauccuggggugggugcugagagaguuauucuugaaaccacugccacaguaaccuagcuccaaagggauccugcuauuaauacuucucuuuauuuuacuuuguucuuaaguaucuuaauaucucaaugcaggcacuuuagaucacagaaaaugcucuaaaaaugccacuaaaaauuuaauauucccauggcuuuuuuccuauauaaugaaaggugaaguggcuuuuuguacaggaauauaauucucccaccgucuuuacuuguuuauuagaucacaaagcugcagcacucaugagucauaaacuguaugacaccugagaguccacccugagggacaugacuuuaugugcaguaaagugugaguuacugcaucuuucuaaaggguucuuuucacugaaagacaacccugcugagaauuuccucaggagucaucgguuuucuauaaacccaguggcaggcauauucacaucaugguucccucuauacaacuuaaaaccaacgaauuguuuguaggguacaaacugauuaccaggagaaaaggaucucuuuuucauguugguugcauaccaucuucagauuccuaugguaauaguuggugcaacagggcaguaacugauuagguugacuauuuccaaguagguagaauugcaaauugacaaauuaaaauccaugaagacggggcuuuucccuaaagacuaguacuagaacuuuauacagugaucagccaaacacagaauuuacuuccaguucccaccaggaaaucuagaacaugcguguuauuuucugugcuucagcuucucucucuauaacaccaacaaugacaauuguuaauaugcagauggauguggagauuacaaaauuugaaccaggccggagacaguggcacacaccuguaaucccagcacuuugggaggccgaggcgggcggcucacgaggucaagagaucaagaccauccuggccaacauggugaaacccugucucuacuaaaaauacaaaaauuagcugggcgucauggcacacgccuguuaagucccagcuacuccggaggcugaggcaggagaaucgcaggaacccaggaagcggauguugcagugagcugagaucacaccacugcacuccagccuggugacagagcgagacucggucucaaaaaaaaaaaaaaaaaaauuugaaccacauaaagcccaugcauaguuuuuuccuacuguccuauuaaaauggaagcaguaaauucaaccugauucaguuacuuuuauucagagauaagggauuauuaauuuagauuuuccaaacauaaugcaauuuugcuguuccaacaucaggagguuuauuuaagggggagaacauuagcaaucaagguaacaaaacuucuucugaagcagagcaagacccuuuugauaaagcaacugccacaugcacagccaacucccagcucagaaagcaaacaacgaaacaaaacaaaaaaagaaacaaacacguuaaaauuuaaaauuccaacaaaaauucccaauaucaucccuagguuuuuauuaaauaaccccaguaaacauccagagaggaaaaaaagccuuuuuauguuuacauagauauaaaaauauuuauauuuauauaaaauauaaauauauagcucauuuauaaagauauaaauauaguucauuuauauuuaaagauauaaauauaaauauaguucaacauuuuagacaagaauaaaaauuucaucagaaauacaaauguucucguggcuagauuaaguuccugauuuuuaucauaacuauaguaguccucccuuaucugugguuuugcuuuccauaguuucaguccaaaaauauuaaauagaaagcucuauaaauaaaugaguuuuauuuuucuauuuauuuaauuaauuuauuuuuuuuuugagauggacucucacucugucgcccagguugcagugcaguggugcaaucucagcucacuguaaccuccaucucccagguucaagcgauucuccugccucagccuccugaguagcugggacuacaggcacccacuaccacacccggcuaauuuuuguauuuucaguaaagacaggguuucaccauguuggccaggaugcucucaaucuccugaccuugugauccacccgccuuggccucccaaaguguugggauuacaggcgugagccaccgugcccggccuauauuuaauuuuaagaaagagauagggucauccuauguugcccaggcuggucucaaacuccuggccucaagagauccuccuguccuggccucccaaaguaccaggauuacaggcaugagccaccaugcccagccaacaauaaguuuuaaauugcgcaccauucugagcagugugaugaaaucucaaacccacacaguccagaaagugaaucaucccuuuguccagcgucuccaugcuguacaugcuaccugccauugaucacuucaucacagcgcuuguguucaaguaacucuuauuugacuuaauaacggccccaaagugcaagaguagugaugguggcguagugucauaauugcucuauucuauuauuaguuguugugaauuacuuacugugccuaauuuguaaauucaacuuuaucacagguauguaccuauaggaaaaaaacauaguauauauuggguuugguacuaucuaagguuucgggcauucacugggggucuuggaaguuauccucugcagauauaggaggacuacuguaaguaucgguucaauguuuuaauauuuucuuugcagcaucucaaaucuuacauaggaaauaaagauaaaaguuccuuaagcugcuuaauuugcauguguuuuccaaaacauacauguauugcuaauaugacaagcauugcaaauaauuugcuaauacagcaaacauuagcaaauccuaacucucauacuccccuucuuuucuaaaauguuuuuuaugugaaacccaauuccaacuauuuccuugauuuuccuuuuuaaaaaaggacucgagauacuuauacuuaaagcagaagcaaacccaagccucugucagcuaguagaaaaauaagcuguccucaaguccuacaaauuuuccuaaauuauagccacacagagcauuugcuguauaaauacguacacuguguuccaaacacacucuuaccuaagaucccuuagacuacacuucaaaugccuacgcccauuaggguccccccacauggacaaaccuccucugcacacagugaaauaaugcuaaccccucuuacagaauguuuucugguauuuaucagugugccucacaucgcuauuaaguuuguaucuguacugccugccuggugaaaagaagcuuuccucaagggcagaaaacauaacguggcauguuauagccuccccguggagccccacauccaucaucuuuggcuuucagacuaucaggaggcugcugacccccaacuccuuuuauguggugcucccacccucagcucucugaaggaggacucauuagugacuguauuucaaacucugcagcaccauccccuauagcuuauuagagcccaagaaaaccaaacuguacguagcauucuuucccucaagggcuuucacgaacacacaaaggcugucguuagauaaggaagaaacuugacuggaggugagcauaagucugagccacagguggcaugucaacacccaugggugcaugguggcuugcgccuauagucccagcuacucgggaggcugaggugggaggacagcuuaagcgaggaggucgaggcugcagugaacugggaucacgucacugcacuccagucugggcaacagagugagaccccgccucaaaaaaacaaaaaacaaaaacagaacguaacaaaaaaacaaagaaaagcccccaaaaaaccauggguggacucaaacuaggcaucuggaagaagcaguuaguccaggaaaggaaaacagggaauacucagagagacaagggaagaugagaaacagacaagacuggaucuggcagagaccggaucugacagggccugccugugcccucuaacucuuuuaagucuugggaugugcauuuggauucuaggagaugccuuguccccuucaauaagcccuauuucuaaacauaagcuccuuuaguagcuuuaugcuccuuccaauugaacaaaagccaagaaaaaggcccggcuugcaugcuaguucacuaauucccaccacaugaugcccucaaucucugugcgcagaccauucuguccuaccacugcauccuccacuugccuugaucacuuuaucugaucccugaccacuugcuaccuccuauucugcugaugggcugucuguccuauuagaauauauaauccuugaaggcagggacaauaugauucaucugguguucccucaacaguggcaaacccugggauagcacaguaagugucugauaagcauguaauuaauauuucugguuaaggucagaauccauucaaucagggacuuucaguauacauuaaguucccuuuggguauuauaaaccuaucucuuaaauaagauauucuaaauaguuguuggauuaugggcuuuugagggaaaguaaguaucucaaugccuuucaauauuguucuuccaaguagauauggacagcuuauacaaaucauagcaucugcuauaagcaguagauuacuguaaauaagcacucagcugaggaaggcauuuaggaagagugacaaguuaagcucucacuugggcuaauggggcccauucaguuaguacaggagucugaaaagcagccuaccuaccuggucauacagccauguuuuaucauugaaagugaauguaucaguacaugaaauaauuuuaagagugcauaggccgggcgcgguggcucaggccuguaaucccagcacuuugggaggccaagacggguggaucacaaggucaguagaucgagaccauccuggcuaacauggugaaaccccgucucuacuaaaaaauacaaaaauuagccgggcaugguggcaggcgccuguagucucagcuacuugggaggcugaggcaggagaauggcgugaaccugggaggcggagcuugcagugagccgagaucgcgccacugcacuccagccugcgaggcagagccagacucugucucagaaaaaaaaaaaaaaaaaaaaaaagagugcauaagaaauuccaaauccuaacaaccaggaaagagggggaauagaaacaaucuuagaucauauuauauuaauauuuuuauauauaauaauuauuauuaauauuaaaagcuuaucaucgguagccuaaguaguuuugucuacugaagaaauaccuuaaaaccuggucaccaucagaauguuuuguuccacauuuuaaaaaucugaagucucucuucucacuaucucuccaaguuggaaauauauugaucucagacaagaugacauuuaaguugcuaaauacguaaagcaagaaaagacauugaugauauuuaagaaagccaagaagagaaauguauauauuaaaaaaaaacuuuguaaagccauauguugucagaguccuacagaaacuuugucucuauucccaacauuaagggcaaauggagaaccgaaaagucccuuuuguaaacaggccaccuaagacaggugauuaaugccaaaaguccuaaaaugaccaaagguauuucaaaaacacaaaaucaaacauggcuaacaaaaggcugaaaacaaaguuaaugaacagaguaaauggaauuggaaauugcuacuaauucugaaaacaguuugccuacuuuucuacuuagucauucaauuuuuaaaauucaccuuuagccaaauucuuauuucuuuuugaaaacgcuaaaaauuaugugguacuaauaaaauguuuuaaauauauuaacaaaacgucaaugaguaacaugugaugcuuuagcacaucuuaauuuacaggucacugaaagagaugagcugaaacccgcauguguuuugccaggauugcuggagaaccugaauaguuaagggaaaaaaccugcauuccagacugacucaggaacaagacugacuagauuugaucauuacugcaauucagugacagauagaugggaggguucauuuuacuauucuuucuacuuguacauaugcuuguaauuuugcauuuaaagcacugaaaauuuaaauaaauacauuuaguccagaggaaacagccagguuucuaaauuuauaacugcaugugaaaaaggaaaaaaaaaaaaacccagauccaaauugugucugcaugacugcagcuagcauauaugaauauauacaugaaacagagaaucaaaugcucuauaccaaauuguuucagagauagccuaucuuguauauuuucaucgucucaaagcuuuuccauaccagucccuuuuucaaagaacauauccaagaagaaaguaagaaaaaugucauaacugaggguuuccuaaguaccagacaucacugcaaauguuuuauguguagcacaucauaauccugaguuaguaauuacuccaauuuauuuaagaugaaacuagaacaacuaaaaucgaugccauuucuaagcauucaaagaguauauuaaucauaaauuuuaaacuacucggacuuaggcauauaaaccaagacaaagcauguccuagacaauauauacuucuguuucuggauuucaaugacauucuuuaaauuuuccuggaauacaaagaaauaucacaucuuaaacuauucucaacaaaaauucuuuuaauaaugaggaauacugaaaauacaaucucuaacuuaauugagaaagagaacuggaaaacgaaaacguucucugcuugcaacuuaaugaggcgcugagaggcagcgugcagcugaugaaacgcuacugcaauaaugggagguaucagcaugcuauguuuccaaaugauggccuuauguaaaagcaaaggcgguaaaaugcugcagggcguuagaauauuucccaauaaucuggccaaacucugcuucugacauucuauauaaauauauuguuauauccacacuuucauacucagaguuggaaaauccugucaaagaaccuuguuugauagauaagcuauucuaauuucaaaguguugaaugaaaaacaaauugugggugggagggaagagaugggagagaaauaaaaauaaauaggacaggacacaauugugaaaacacaagcagauguguacacauagccuagauuuuccuauucucucuuucaauguagggcuaauuuucuuauuuuaaaauauccaaacugccuucaacuuuuuaacccuagaagaaaucuacggucaguaaagcaauccuuacauuuauacagaccagaaaugcauaaaauauauccacauauagacagccugaucccuccauucaaaaacugucucacucaauaugaauuugagaucuuucaaauuccaaaaccacaauguauacgugccuaugauuugccaauuuucagccuacaagggugaagggugcccauagcaaaguaauaauggucaagaauguaccagaccuucuaccauaggauaauguauauaguauaccuuccaacucgguaagauuaaaaagacuaccucuguuguuugcuuuuuauuuaauuuuaauuucauacaacuguagaauggaaaaagaaagguugagaaacaauucgugucugggaaucccauguucaguuauguauuuuagaggagaaaguugggcaaaggaaaugguuuugcucaacucaucuaacaggcaguuucugcuuugugcaggcacugcugugcuuuguuugcugauccuguuaaucuauagauuaagcaacuguucauuuaaagccagaagguuaaaaaggcagagaacagauaauguuaaauggugggaaagaaaacaggaaaaagagaaaauacccauaaaccaauaaaagagaugauaaagccacguucaccuaacuuucccaauuggaaaucucugccugcauuugaggcuuaaccuguucaaaguucccuccagagaccugcccugcaguguaaguuaccagagacaucaacaccuucaagaagccccuagacccuagccccuagcuccaagaagugcacugcauguuauuaaaagaauagagaggcuggaagagccuguuucaaguuaucucuuuuuuuuuccuuuuuuuuuuuuuuuuuuuuuuugggauggagucucacucugucgccaggcuggagugcaguggcgugaucucggcccacugcaaccucggccuccgaguucaagcaauucuccugccucagucucccgaguagcugggacuacaggcgugcgccaccaugcccaucuaauuuuuguauuuuuaguagagacgggguuucaccauguuggcuaggauggucuugaucucuugaucucgucaccagcccgacucggccucccaaugugcugggauuacaggugugagccauggcacccggcccaaguucucucuuuaaaagaggaagaauaguauggggacucauccaauuucuuguuuaacugacaauauguaacucuuacaacacuugccuguguguuucuaucauaaagugaggauaugguuuaagacugugaggauacagucuaagacugaacaggcagccuuccuggacugcucgggugacaaagagcaaugaugcccuuaauacagcaccucaggauaucaugaaugaggggauggacaggaugaucucccacaaugcuuuucacacuauuauuuuguaauuugaauuccuucucuccccaaucuaaucuacucuuggaaacaagcuaauuuuucuaaaagugucuugaccagaaagcauucaugcuaaaaaucugccauagcuuccaccuaucuccagaauaagacccuccaauuugcaaccucauucuaccuuugcaauuuucuaaauuuucuucacaauuuaauuguauuaauagauuuauaagguccuuaugggccaagaaugguaucccgccacucagcaacaccugacacaaaaaccuaacagugcccaauaaauauagacuaaauuugccuguauuaaauuugggaagaaauagauucuugagauguagaauugaaguacacuuccuuuauucuucuggaaucccaaagccuuugguuuaaguaaaacuaugugguuuuuuuuuuuuuuuuuuuuuuggagccggagucucgcucuugucgcccaggcuggagugcagcggcgcgaucucggcucaccgcaagcuccaccucccggguucacgccauucuccugccucagccucccaaguagcugggacuacaggugcccaccaccacgcccggcaaauauuuuuguauuuuuaguagagacaggguuucaccguguuagccgggauggucucgaucuccugaccucgugaucugcccgccucggccucccaaagugcugggauuacaggcgugagccacugcgcccggccaaaacuaugguuuuuaaaaaauuucauuucaucccaaagaaacaggacaauaaaaucuaacaauucuaacuuuuagccccugguuuuagaauauguuucaaggggaauauuauuuuuguuuuguucuauuuauauuuauaaauuccucaggccaaaauuuugguacuauaauaguuuauuaaagcaaguggccacuuuaugcuguuaaaugaugaauaacugccaggcacagugguucgcaccuguaaucccagcacuuugggaggccaagacagguggaucacuugaggucaggaguucgagaccagccuggccaacauggugaaaccccaucucuaguaaaaauacaaaaauuaucugagaauggugugggcaccuguaaucucagcuacuugggaggcugaggcacgagaaucacuugagcccaggaugcaaagaaugcagugagccaagacugcaccacugcacuccagccugguugauggagugggacucugucucaaaaaaaaaaaaaaaaaaaaaaaaaagaugaauaauugacguaguuguauucgaguuguuuccauaaugcuaugagagauacuuuuugcuucuaguauaaauaacagaggaaaagcacuguuuucuaucaaagaaugucaaaagaaaauaacaacucaacagucuacuguggucaucuaugauucacacaaacuacccuaaacacuaaacaaaaagaacaauauaaggauuuugcaugcuuaauguguuuggaagcauacuuuguaauauuacaaccaaauauuuuaagucauacuauggauuuaugacuuuacuauugaauuaucauggccuuugcauuugaagcggauaaaaacaaacugaaggcaaaucuggacuacacgccaacauuccaccaacucuugccuaaacaugucuuuagaauucugucgauggaaggcugggugcaguggcucaugccuguaaucccagcacuuugggaggccgaggcagguaaaucacuagaguucaagaccagccuagccaacauggugaaaccccaucucuaccaaaauacaaaaauuagccacaugugguggcgugcaccuuguaaucccagcuacucaggaggcugaggcaugagaaucacuugaacccaggaggcagagguugcaguggguugacaucaugccacugcacuccagccugggcgauggagugagaucccgucaaaaaaaagaaaaagaaaaaaaagaauucuaucaauggauagaaauggucucugcaaaaggaaaguauaggcuccauuuuaugggaagcucucucagcauaagcuggauacagaacuccugcccauuaccgcuccaaucucugugccagaaacuaccauccacaagcauuuaccuaacgacgacuagcgugcucuaggucagagcuaaguguuggauaaaauccacuguaaggcaugaucccuagaaauguuaauucucacaacacuuugggucuguagggcuuuugccuacagaagccacaguaggucuuugucuuagcucaaaaugcugccuuacugugaauggcuuaaacaacaaaaaugucuuuugucacagcucuggaagcuggaaguccaaaaccaaggugccagcaugaccgaguucuggugaggccgcucuuccuugcuugcagacagccaccuccuugcuguguccuuaugugacuucuucguuugagcagggagaaaaaggcaagcucuuugguaucuuuucuuauaagggcacuaguuccaucacgggggcacauacucaugaccucaucuaacaguuaucaccucccaaagguaucaucuccgaauaccaucuccgaauagccugggguuaggguuucaauaucuaaauuuugggggaacacaaacauucaucccauaacaguccucaauacauacuugaaaaaaaaggggggaaaaaucucaaauggugcuaacacaaaauauuuuuuaaaugcauugaaaggcagguauuugaccaaugacuaggcagaagcaaaacuauuacgauugggaaagaggaaagaauacauaagcacaaagaauuuggaagacuugggauuaaacaaagacucaauuuaaaccauaagauccaaguuaucuucucaaucaaacuuuacaaggguuuauaaccaagagcaaaaauaaaagacuguguuuuuacuuuuucucuugaaccuugcccuugaccaaaaccugguucaaagaaucaagggcaaaaaaaacacuaugaaugauaacaacaaaacaacccaguaacacaaaauacaaauucagagaagcaugagacuaugaaaggagcagaguagauaauucacagucaaaguuauguauuuaucaucauguuaagcuaugcaccaacauguauacugcaaagcaauccuuuggaaaaacaaauuaaacaaugaguuaaacuugugagcaaaaagucaaaacgacgugacggugaugaguucuguugguuuuguucuauccuaggaccagacuguuaacagccaccucagacuuagccagcuaguuaucucuaaaauauuuuggucaugagagacacaaagugagaacgcaaaguaaaaaauucauccaccacuauugggagaaaaaaaaaaucauuaaaugaguagcucugucaaugguaacuaaugguuuccacgcauuuuuuucaaaaaaaaaaaaaaaaaaaaagaagaagaauuugcccaaugacagauaccagaauaccgugaauuuucauggugcugaaucaaacacccaucaaccaggaauucuauaccuaaugaagcaauuguucaauaauaagaaaaacauuguucaacaauaagaaugauuaagaugaaagucauccaacaaaacggaaucaaaauauuaauguaauacaggguuugagaugaucugaugaaaagacuagcuguaaacaaugaguccaguuaaagacagacccuaugaaugagaaguauggcaacagaggagaugguaagauuauaacuuugaaaauauaaaaauaauacaacuuauaaaaccugugagaaggaaacgugguaacauugugagaguauucuuuuccuugccguuccuagcaaugaauccaucaauacgguuuaaaaaauaaaaacaugaaguuaaaaaaaaaaggcaaaacgaacacuuuccaacacacgcaugaaaauccaagccuacaaaugagaacuauucauuauuucuaauuauaaaagaaaaacaccagaauagcuacaauguggaaaguggcaggaagauccugaaauaucuauaaagaauguucuagagaauucaagaugcacaauuugaaagaaaaugucaacacugucuaaaacuucugagugaacuugucuccccugccaccugcucaauacuccccaaaaagccacuuaaaauccuaaugcaugaugcacucccucaccucgcccuguccagccuacaagccuuuucuaauccauacccacuguguugcagcacuggggucauucuucuauuuugcccaugccauuccucaucccucuucuggcaacagcuccucuccccacaucacacggccacacccacaaggccaagaugggcuaguccugauacugagucccugcagauacggugguggcuccaagggcagacguguaacucaaagcagugccaaccagaagcacucccugauaaugcccaugggcagaacaaaguugggaugccaaaccaggacuaacacuaccagaggucguggcuaccaacaucccuggucuccuugaggacacccaucuuagcaggagaaaaggaguaaacacacagcaggaagguaagcagaaacaaaagagacccuaauggggaaauucuaggcaguacugacccucgguuccagcaccuagggaucucauuucuguguacauuuuuaagaaauuggguaagcaucccccacacuacgauccuucccaucagugggagaaaauauucuccauauauaaaauacaaauuguuuaggggguuuuuaucaccuggcaaaagaaacugccuaauuaacccacccuaucuccccauucuuccucagaaaaggagauguucccuccccuuuccaagacccaggcaaucacauauccacuggaucuccuuucugccuaguucuuacagaacugaauaccauagucauagcuuacuguaaccuuguacucuugggcccaagcgauccucucacucaaagcgcugcgacuacaggucugagccacggagcucggccaaaaccuaguucuuaagagauaccugcaacuagugcuuaggauggguaucaguccuucccacaguuuaguuuaagcuuccuuaggcccaaauuccuuccauuuaaaaaucaaaaucacaaagccuuuccuuuugucuucaaugaccucaaagcuuuuugccucuaggucuuuccuccaggaguccacagcugacucaccauugacccacguuguuuuuccugcaauggacuacaacguaacuucuccccaugcuauuccacagggucaacaaugaccuucuauuugccagauccuaacaauguuuugucacacacacauacaaauguccaaaaacaagauaugagcaaaagagauugcuggguguccuagcauugaaaugcagguguugucuugcagacccugaggguggcggggaaaggauuaucugauucuacagcauguuccuccaguugacuugcuacuaaauaagcuauuuuacgacuuacacccuuaaaauucuuacacccuuauuacuuacauccuuacaagcuauuccacacccuuagagcuuuguaaagauggauacugcagacaccccauagcaaugcaaguguuccuguaccauggaaauaauuugacgauauuccagauaauuccagaugauuccuguucauagccaugcaacucaagugugcuggggaaggaauuuuaaaucucuccaagucaaaaugaaccauuuuucacaucuuacaguucaucucauuaaugaauugaauaaaauauuugacauguguucagucugcaugacagacaugauuuuaccaugucaaaaacuacacuucaacugcuuuccguuugcaucaugcuugcacucuuaucuuuccccucauuuagaaauuuacauggcuugccuuccagcauguaacgccuccuacuuccuauccuaucucucuggccacugcucaucucccucauggggaaucgucucucuuuguuugccuucaaugcugcaauuccccaaggugcuuucuucgguucuucuccacaggugucacugaguggguaaaaugagugcaaguacuuagcauaguagcugacccuuugugacccuuugugaaugcucaaugcugaugguauuagugucacugucaccauguaguuuuuagauugcuaaaauuaugauuuuacaagcuuuucucccccuuugaagaacaggcccuguguucuguucaucaaugcacccuuaguauccaaagacauuaugucugaggaggaagagagcaccacaggguucuagaaaggcauauaaucaucuuacauccaaauguauuuaaugaaagauguauuuaaaaggaccccaaacaagccuuguucccugacuugcaacaugcagugaaguucugguugaagguauggagggacucauuucuaccucccucucccacuugccagaucaugggaucuaagacccuuacagcucagagucacugguggcucgggauagcacagagaacagcacuguuccacggaaacagaaugcaacugccuauggaaccucaauuuccucacugccacgugaaacgucaaaagaaacaagugaaaucaauuuuaaucacauaguuacaacucaguaacauuuaugauguauuuaacaacauauucaaaacauaacuauuucaauguuaaaccuauauaaaaaugaaugugaucauuuuacagguuuucucacauuauaucuuugagauacgguaucuaucuuacacuuauagcacacaucaguuuccacuagccacauuucaagugccaaacaaccacauagggccaguggcuacaguacuggacagcacacggcuagaggcugcagcauggcagucucugggagaacgaagauauaugguaggggacauagugauaaagcaagaaggugauuuguuuaaaugcaaaucuacaaucacuccucuucucugaaaaaauaaagucuaggccgggugcggguggcucacgccuguaaucccagcacucugggaggccgaagaggguggaucgcaaggucaggaguucgagaccagccuggccaacauggugaaacccugucucuacuaaaaauaaaaaaaaucccggcgugguggcaggcgccuauaaucccagcuacucgggaggcugaggcaggagaaucauuugaacccaggaggcagagguugcagugagcugagauugugccacugcacugcagccugggccacaagagcaagacucugucucaaaaacaaaagaaaaaaaaagaaaaaaauaaauagauaaaaaauaaagucuagugacuuccuguugcuacaaaauaaagcccaaauccauuaaaauggcucacaagguaugauguuuuggcccuuucuuacuuauggcgccuaauguugaagaaucuggcugguguguaucauccaacaagacuuccgugggugggugguaggcagaggacagauaauaccagaauugcaagaggaaggugacagcaaagggcuaauucuccccacucaugguggccaccaacaaucugguaaaguccagaacugggaagaaccacucugugcucaacccuuugauacaguuuggcucugugucccuacccaaaucucaugucgaauuguaauucccaguguuggaaguggggucuggugggaagggauuggaucaugggggugguuucaauguuuaagcaccaucccucgagugcugucccgugacaguguucucaugagauccggguguuugaaaguguguagcaccucucccuucacacucuuucucuuucuugcucuggccaugugaacaugugucuucuuccccuucaccuccugccaugauucuaaguuuccugaggccuccccagccaugcuucccauacagccuuuggaaccgugaaccacuuaaaccucuuuucuuuauaaauuacccagucucagguaguuuauuacagcaaugugagaacagacuaauacacccugggacaaacaacaggcuaagacagaaaguaaagcuacccaggcauuaguaggaucucuaagugaaacgggaaaagagggguguuccuggggucaagaagaguaauuuuugguauggccaccauacaaaugugaaaacaucugguuauucauacgugaaacuaagggaagaaaaacuuagaugcaaacuaugacacauguaucaaaauagucgauucaccagaaaaggacaauuuggucaaugucauaaacuaaauuuuaauucuagccuuuaaaaaaaguuuauuugacacucagaauacauagucuguaugcauauaucaaaaaaaugguaucaaaaacauauaaguaugcacagaguucugauuuauaaaauuuauaacuuaucuacacaauuguacuacaagaacucuucagcagaauguaaauauuauuucuaacauugacacuuuauaaaagucacacccaggcaaaagcugauuuauuaucaauccauacuuaguaaaucagcacacagaauguucuuguaaaaauacauauaauggaccauacgugguagcucacggcuauaaucccagcacuuugggaggcugacauggguggaucacaaugucaguaguucaagaccagccuggccaauauggugaaacccugucucuacuaaaaauacaaaaaaauuuagcugggcgugguggcgggugccuauagucccaucuacucaggaggcugaggcaggagaaucauuuauacccgggagguggagguugcaguaagcugagauugcaccacugcacuccauccugggcgacagagcaagaugucaucucaaaaaaaaacaaaacaaaacaaaaaauacauauaaugaacuuaaguauuagugauuuccacuauucaucauuucacaucaugguucauacuccuuucaagauaaaaauuacuuaauauguaauauauugugauaauguagaugcuuuuugcuucucaaaacaccaauuaguaauuagagcuuguccuuucuuaaacagagcgcuaucaaaacaaauuaaaccuuuuaauaauaauaauuuuaguauuuacaauuuaaaauaaaaggaucucaauagaauaguaauauuaauuaaacaacaaacauucauuauccaaguaggcuaaagaaaaauuucuaguacaaaaaggauuacaacaaaagaaaauguugccaggcuaucugcuguuuauaaugagugucgagaauucugcuuugccaacaagcauaagacuaauuacuucuaauguucuuaagaugcagucacaaugcagagauaacuaucuaagaagugugagauaaaaugccuggaacuccagcuauuuuaaauugaauaagaaaggagcacccuguauaguaacagcaaaaagacuacaaagaauuaaacaaaaaugaagaucuccacgaaaugacaaaggaugauuuccaggauacaaaguuaaguuaaaaaaaaaaaaaaaaaaaaaagcaaagugcagaacagugaacuuuguacuuuuuuuguacaagaaggaaaaauauguauuuucuuuugccaaaaaaauaaaucaggaacaaugaaaauguuuaucaauagagaaugagugaaaagugagcuuucugaguauauuucauagaacuaacaugauagucaaaaaguaaaauuaauaagggaggaaaaaaccaaacuauaauagaauacaaacagauacaaaugaacuaaaauauguaucaagcugguaacagaaaaaaauuaaugcuagcacuuuuaaccaaaagaccuugacuguagagccguggugagauauauacugaagaugaaaggaguguggagggcugagcaugguggcucauacccguaaucucagcacuuugggagguccagccagaggaucgcuugagcccaggaguuucagacagccuggccaacacaaggagaccccaucucuacuaaaaauuaaaaaaaaucagucaggccugguggcaugugccuauaguccagcuacuugggaggcugaggugggaggauugcuugagcccaguaggucaaggcuacaguaagccauaaucuugccacugcacuccaaccugggugacagagugaggaaaaaaaaaagugcugugacaucuuaaacuacuguuuagugauggucauaauacgacaucauaauuuuaaaaacauuuauauguauaucauaggguaaugcaaauaaauauauuaaugguauggugaaucauuaggaaccaagauuuuuacuguaggguuaaaauacugaugcaaaauacaagaaguuaaauuuuuugaaaacaaaugcaugugauccaacgugaauugcuagccaccggacaggacuuacuucuuggcaauacugcaggaugccuuccuugguaucaaugcagguuuuggucccugauggaucugaaucccacuucccauucuggacauucaugugcauguucagucugccacagaacauggcaaucugggguucagccagcaggccagcauuaccaucaguggguaccugaaagaagaagcuucaguuaguuauaguauccauagcuccaaggcagaggcuuggaggaagaacagggauaacuaucaaaaagaguucuauucuugcucauucucaauuaggaaucagcccggucuucaacacuccuuuagauuaaguguuauguaugcuacagauguucuuagccaccuauaaggcaaugcuuucuuuuauacuaaaacagagaaggaaauuaccaauaccgaaaggaauuuauucaugaaaaauuuacacguuuucccauaugagauuuugugguaccugcugaaagguucugacaacaaaauuacacguuuuccuauaauaaauauaaucacuguggaggcuaccgcauucuuauaauaaacuccacugacucacacagagcaugaugccugccaggcccugccugaugaccaagacugaaaauaauauuugugccaccucucagcacugagagcaaguauggcguugguaguuagcaagugacuguauuaugauuuugaacagaaaaauucacuguagaauucaccauccacaaauauaacugaguauguuggcgaucccuccugguuucccccagaauauucucugguuaucagucucaacucuuaacaagucuguuaagagugcuggugucuccucucccaaccaucugcaaggagccaacauuuucucauuuggagcucuacauagugccugcuggguaguaaguaagggguccuagcuauuaccauugcaggcaauagaccacuucacaaaauaacuucaugaaaaagggugccuucuguauuuucaaacucuucuguguacaggcauuaccuuuacaaaaauauuuuuaaaagagaaaauggaaguccugaaauaucuauaccgugucacuuaacagguucugguaucucaaaaagaaaaaaaaauucagcaagaaaugaaaaauauauccacaggaguaaagguguuauuaaaccaaucaauuagaaggcauauuaaucaugauaggcccucccuugucaaauccagcugcuggggaaaugugagacacccaugccaagaagaauuaacuuccagcagaagccauucguucacacacucaagaacugggugauuccacgauaacuuguaucauuccuaaaaacuguccacaggaggaaaaacaccaacuaaaauugcacugagaaauuuucaguuaaagaaaugaaacaguuuccaaacauuucuucccacauaaauguaaaauaagauaccucuggccauuuuagucauuuuuacacauacuucgucaaaacccaacagaggacuuagguccuuacaacaaaaaaacaaaacaggucuuagauugaaccaagucaugagugcaaaagcugcuggcaaaaucucuagagccauguuuucaaguaacuuuuccaauauuuaacgaaauucugccuuuacauugccagaugguuaagucaaagcagccgaugccaaaauauccagaucaucugcagaaauagcuagaaccccucaacuccaucugagccccuugccacuuccugugacuuccaugaaacuggggggucucauucucugacagaugcaaagcagcaggcuaaguagaaugcucuauaaauuuaaauuucacagcuuuccugagggauuaagaggaaauucauugucuugaucuuagaaaucgaaaugcaaauguugucaaucuuacugaaauaaguaguauagauaauaacacugcaaaaacauuaaagaaagucaaauaauaaucagauaccuguggauaaggcccuacaucagaugcuauggagggcccugcccguaaggaauguacaauccacuaauggaaucgccauuguucccacaguacuuuauucuguucaccuuccgaauucauuccugucccaaagauuuccagucuuggcagcauguuguuaacuguacggagacacuaaugagccuuuaccauagcugguaaauauucuguugaaacagucuccuccucugccucaaacucucucuguacuuuuguuuauccacaaucuguucauuacaaugucuaaggaaagcguucuaccuucuugucaauacaaaugcacuugauuccauuuccuccccgcaaggagaggaaauugacaauuucucuccccaggguagccagccuccaagaaggcccccaauagucccugccuccugcuauucauggacccugggaaacuccacaauguaucagggucugucugugcaacaaauggaguacagcagaagugaugaugguguaacuuccgagcauguauauauuagacuuaaagaugcugcaacucuuuuaaaaacaaacccuuugcuaccagaaaggucacugaagggcaugaugauguguaacauccaaaacaaggucaugaagggcaucacaauucuucauugcucucugggaucacucacugugagggaggucaucagcugccauguucugagacauuuggugcuaaaaccaggaaaguuuuuggcaaaauacacuggaucacccuaccugacaaaccaaguaaaugcuucauuuuuuuuuccucuuuugacuuaacuuccuuugauuucuucuauuuuucacuuugucauccucccugcuucuugacuuuacagcuauuuuaaugucaucuguuggcauauguguguaugcugacuaucaaaaagugguaauuuuuuaaacauuuuuuucaaauaaauuuauuaugacccuauaauugucucauguucuugccauuuuuuaaugccaucuguuggcauauguguguauguugacuaccaaaaagugguaauuuuuaaaacauuuuuuucaaauaacuugauuacggcgcuauaacugucucauguugucuucauuuuaacaaugagaguuuagacuagaaaauauaugcuucaguuccugucagguuuuccaccagaugagauuuaauauuaacuuuaaaaauaaauguuuggagaaucgugaugauuaacaugcucuauuuucuucaaguggagaucauuuaauaauuuaaacugcgaauccucaauaauaggguaagcuguugaauuagaaauuguaaaauugguuguguguauagaucuucuuacauuugacauuacaagaggcccuucacaaauaaauaucaacucacaaaagccauguuucucaaguaaaauuuuuuccccccgaaccaacaccagauguguauauggaaaucagagcaauuagcuuggagauacaaauugaaccagaaaccuuccuauucuuacugaagcccaucugcaaacaauuccaugcuuucacuacauaugccugucucccugaauuaaaacaagacaaacaacucacggcauccucaccugcaucaaauaacccauuuaugaaacaaagccugguugcuaagcgcagccacucccuggcauucagccagaaggaaauguggccacauuaaacauugccauccaaggguuaacucccuuuuccugagugaagccuccaagaaaugacuuaauaaaugauacacaggguccuauucaggaucuguuaauauggacacucuuaaaauugaaaucuuuuaagauucaauuuaccugccaaauaccugaaaucuggcagguauuugcugccaguaaaaaagcacagucuuacaaagucauccuaaagauaauuauuccuaauuuuuuaaacauuuuuauuuucuaaaagaaaagaaauauaaauaccuuaguagaugggaaauauaaccacuuaacuacuacauuuuaguucuauuuaugucuuaacacuauucuaaggugaguuaagauuacuuugcaaaaaucuaagacaacauuuaaaagaugagaacugugauauaacuggccguuuguggucuaugcuuuucuaagacugaauaugaagguaauucuuguaaacugaaugacuugccacugacaucauaaaacuggagaugcuuucccaugggaaaacaguguuccugacaaugaacaaaauaaccagcuaaaaacaaugaagcauucauaaauugccucaaaagcaagaggcuguuuaccaagugcucugaacuacagagacguacauaucaaacuuaaaaaugcuacaagucuuaaaaacagaaagaaaauauuuuuguuaccagaaaaaaaauauuuuugagccacaauauaaagaauacugaagugaaauggacuuuccaaagcaauuuuuagaaauggcuuuaaaagaggcuuaaggggauaacauaaacgaauauaaacauauauaccuaaucuggaccagucugcagaugugaaucuggaaacccuacgccuacaguugcuacaauuuucaauuaaaugcaaagccaccuucuugaacaaguucucuuguuguccuuucaaacaggguguucccuuucuccaaaaaguuucucucuguuaucaucuaggagaucaaaauuccuuauagagcaggcuuggcagcauuccuccccaacagggucucaacuaggagggaaaagugaacaaggagcucucuguuuugcuagcugagagguccuguuuggcaaggagagggcacagauccauagcuuaguugcauccguggauuuauguaauuuuaagguuucuggcuaaugaaagccaucuguuuucugcauuugaaccacccgcugacuagucuaaauagcuggccucauauaaugaaguauuugguacuuuuuaaucaguucaaacuucuucgagucagauucuugcauaaucucaguauuuuuuuuuggauacacugucacacuccaccacccagacuagagugcaguggcaugaucucggcucacugcaaccucuccgccuccuagguucaagcuauucuccugccucagccucccaaguagcugggacuacaggccugugccaccacgcccagauaauuuuuguauuuuuaguagagacaggguuucaccauguuggccaggcuggucucgaacuccuggccucaagugauccuccugccucggccucccaaaauguugggauuacaggcaugagccacugugcccagcuuuguagcgauacuauuucuaucacauccaugguuuccugacauaaauacuggauucccuuaaccugggcauaauucaacuauaccccacaagagugcuuuacauuuucauauuaaaacauuuaaauucuccauugucaaauguaaagaacuauuuucuagaaucauaaucuagaaaaucugagugaaccccuuucaggggaauaauucaucuguaggguuuucuuuuaaaugccaaaaaaguauuuccaguguaagcggaacaucugcaguugcucauuucaucacuaacagagaacugaaauuaaaaucagaaucacaaaaguggaccauaagagggaggaaagggcaccagguaaggauauguccaaggccaugggguuauagggacagagaagggaauucaaccuauuccgucaaggguucuguuaaugugaccgggcugucucucaaauuaaaauggaaaauugcaauuuuccaaggcuuugccccugugugugugugugcauguauuuguggugagcaaaaauagagaagcuauuaaaaaagaaaaauaaaaugugaugacugaaacugcaagugguuucuauuuacccuuguggagaguugccacaucuauucacagccacuauuugcuacacaauuauuucagagcuugaguuucggcuuaaaaaaugauuugccaugaaagcgaauaggagaaaaacaauuccuuucagaggaguaaucuacauauuucacuccuggaaaccugaaauucuuuuugggucacuguugaucuggcuucuaauuacaagcuauccucccuugauguuuuucacggccucuguugauauuagauuggugcaaaaaucgcaauuacuuuugugccaaccuaauaccaagcuuuuuuacuacucaaaggauagauguucucaaguugacccaaaacuccuacccacucauaagaaggccaguaagucaugcuugcugcuggugcccaguaggaaaucaagaggucccucaauaggagucuuuguuauucacuacucgugaaauuaauaaccaacauuugaagcaugcauuuaggcaggacccaguaagaguggcaucuacugcuaggacugauauaaaugaauauaaaaguggaauuacaaaaaauagagccuuaugcauggcaaacaaacucuuagccucaaaaacaguuuacaaucuagucaauguccauuuagucuuaaaaggugaauguuuucuuuuaacuucauauauauacauacacacacacuaacauauaugaaaccauacacauacuauauaguaugugaugaaaugagcgagauguaaaaaguucaucucuuucauucugucuuuacaguuuuucugugugucuuuuguuuuguuucguuuucugagacagagucuugcucagucgcccaggcuggagugcagcggggugaucucggcucaccgcaaccucugccuccuggguucaagcgauucuugugcuuuaaccuccugaguagcugggacuacaggcgugcaccacuacgccuggcuaauuuuuguauuuuuuaguagagacggguuuuugccauguugccacuccugaccucaagugaucugcccgccucggccucccaaagugcugggauuauacgcaugagccacaacgccuggccugucuuuaaaguuuuacugacaugucucauacagucaccaaagggaaaaaaaaaugaaaaaaaaauauauauauaguauuugagaucuuuauccuauucugacucucucaauauugccauaucucaucagccuugaccuugugaacaugcagauagaaaaaggguuagaggcaaaaaucaaagaccuacuaaggccuuugcucauuaucucauuugacucagaaaaaccaagauaagucacuuccacaucuauuuagauaaucagaagggcucaaaacccgccuagagucuacucaagaguguuauuccaaagcacaugcuugcuuuuugacagaacaagccagcuggcauuccugguacuagaugucaagcuuuuuuaauucuucaaucuugaauauuauuuucaaguaauuuuucccccauggcaguacuauuuugcaugucuuuguuacuggcuuuuaaaaaaauuacuuuuagagcaaguaaaacgggaagcaaacccacagcuuaaaugucuaauuugcauuucucaaauuuaaaucacuagauguuaauaucuacuaaccucugguaguuuccucuuuaagaaaucucuccugaaaugcaaacacaaauuucuccaaaguuaguucuuuccuuaaaucuaaugcagccaacugaaucugcaaaguagaaguccaaaucucccaauguuccaacuacuaauguuuaucaacccuuacuuuauuuaauguguauuuucuaguuuuucaacaguugacauauaccuaccuauguacauauacacauguauauauaccugcuauacagcuacuuguaugguauguagugggagugcuagaaugaacacacacacacacacacacauauacacacaguuuaagagcucaauuugcacaaaucucaaaugcugguacuuugcuaagaucucauucuagaauuagugcauuuaaguccauguugcuaacaagguggaggacuugguaacugggcuccucagagagagugguuugaauggcauucacugaaauaaauuugauaguaacaaauaaaugauuuuccaguauggcuucuacuuguucugacagcuaggacagauuagcacccagcacagaauacaacaaagaaaaaucaaaaucuauuauuccucuucauuuuugguacaagagauauucuacauauauucaauuucuaaauuucuacuguuuuauaucaaauguagccaagcuaagccgggaucagcugacccuugagcuugugggcuauaauaaaugguuauuguucuaagccacuaaauuuuggagugaguuuguggcuuugcagcauuuuuguggcaaaagaaauuaacacagucauguauuugauaggaauaacuaaaauacuaagugauagaaucaaggcauagauuguuucagaagguagaaacuuucucaaguugccuuuuuuuaggcagcugggaguacaggcccauaccaccauaccuggcuaauuuuucuguagagacaaggucucaguauguugccgaggcuggucucaacuuccuggccucaaguguuccuccugccuuggucuccuaaagugcugggauuacagaacuggucaccaugccuggccauaaauauuuuauauuuaauguauuauguaagguaggaucaguuauggcuuaugaucuauacacuuuggguuguccuagaauuggaaagaaucugagcagaggcaaauagaaugauacuguaaacacauguacugaagcuuuuaaggagaugguaaucaaucuuugcaaucuuuagaucugauugauuuugugagcuucuuuucuccuacauuuuuuagaccucugcaaaugauaaacaauuuguacaaaggcauaguuuuuaaaaaaaauuaaacauauuuuguuuacacaauauauuucuaaaaggaaauauuucaaaucugaaagcaaucuaaugcuauuaaauagaccccguuccugcucauaccucacauguggcuaugugaauacaaaaaucuuauaauuauacuucucccagcaaaggacaugcaaauuucaucaccaaacauucaugcuacugcaaucacacuccaucaagccauauguguugaaaucuguguaacaaaagcagugagggcucuugccacacguaggcucccgcccagcccucuccgggagguagguauguaugcagagaagagagugggcugagaaauggaauucuggcauguugggucaagcagacugaucaugugacacucgcacugagauccuaccaaauuucaccauguggcagagucagcaccaaacaaaucccaaaguuaaagccucaguuaucaccuggguuuugcugcauagaccuagccaaauauguguaagaguuaugagcucuagacauaauuuauuuuauugcccugaaauagaguauccccacauaauuugcaaguuuaauugcaauuauauuccugggggucacuccucauaccugcacaguuaggauauugccagguuauucaugguaccucacacaacaccuggcaguuauacacagauccucaucuuuuuuuuuuggagacggagucucacucugucgcccaggcuggagugcaguagcgugaucucagcucacugcaaccuccacuucccugguucaagcgauucuccugccucagccuccugaguagcugggauuacaggcgcgcgucaccacacccggcuaauuuuuguauuuuuaguagagaugggguuucaucauguuggucaggcugaucucgaacuccugaccucgugagccaccgcgccuggccuuacagauccucaucuuuuaugcaauaucauauucaucacuaaauaacgacacagcauaaaaaugaacuuuuacuuuaucagugguacuuuacagcacuacagugaguuuucuagaguuuaaggcuuacgcuaauaugcuuaaugcacaaguaagugcaaacuuaacagguuucuuucugguucuuuuauuuuuccccucuauuucuucucauugacccacugcaauguugacccacucggaacguagagcaugggcaaaaaaaagaaccaagagaccauuagagaagagaauaagucuuugaaaagcugcaggugggaauauaauggaaaacaagauuccagaagagguagugggucuaccauuuaacuagaacaugcccaguagagccauacugauaaaucugcaucuuagaguugcugauauacuuggacaaggggaaaaagaagcauauuccucuauccuuugucagcccagaaauuuaucccaacccuauuuuccuauacaguuucuaccagcuuucaggcgucaggccauuguaaaaccaacauagguggagagggcaauucaggcuaggauggggagagguaguuagcgggauuuccaguucugggcuauagugagggagucaguauacacugcugagucugguacauacauuccacauuguccauacccuuuaauaucuuuacaauuucuaauaccaaagugguaugaaaauacuaaugaaguuaaagacccuuaccaaaaugcuaauuuuccagguuaaguuaucauauugucuucaaugugcauuaaaaucucagagcagcuaucgggggauaaggagagugaguacccacuaagcuuggaggccagcuaaacucucuagaaagucauuuccaucugacuucccaccagcaugaggcagagcaguucagagcauuuuucaagugagucggccugccguuaccaaugccaaauuuaaagcacuuauauguuuuaucacaagcccaugagcuugugauuucauaaaaugguacuaacugguccuugccaugaguaaauucaaguaacacguaugaagaagauuuuaauaaaauuuuuuauuagaagauuuuaauaaaauuuuuuuauuaaaagauuuuaauaaaauuuuuuauuuuauuaaaagauuucuuaaaggucauuaacgcaagucauauuagaagagaucacaggcaaguagacaaaaagaauuuacuccgugaaagcucacugaaacaggaauucggauauuugacauuuacuuuuguucuugucucucauauguacacaucaaagcacacacauucacauggauguaaagauaguaagaggccaccugcaaucagaacaagugagauuauaaauaaguauauuauauaagaauccaagacaagaauuccuuacuuuuaaggaaagggcaucagagauuuaugaucuuagaccuuuaccuuucuauuuuuagcagauuuacagaaauauugcaggaacagaacaugaagucacuuauuuuugauaagcacaaaggauauuuacauuauaucgucugguuuauuuccuuucaaagugucauaacauuuacucaucagccuuuacugugugcuuauaacucucauacuguugugguuuuauuacuaggauuuuuggucuaggagaaagcugcuuuacaaacauaauagaaauucagugagaauauuaacuugacauaaaaacccaagauaauuuucaaacagcauucuuguucauuguucaaauuguauucuguuaacuuauuuaguuuaagccaagauuacuucuuuuccugcagacuuggaacacuaaagaauacuccagguuuaaauuccagguuauuugcuugauaagccuggguagauuguccuucuuaaauaacuuacaccaaagcacuaucaaagaagcucucccuuuguagagcccucagauucacagaaggaauuuuucgaauugccauuucuauaggaauaaaggcuaucaggaaccacaauacuaggagaaaauaauucugaaggggagguagcagugaagacucuuauuucuauuuucuugacuauauuuauaaaaaauuguugccgaaagaacagaagaccaagagccaaaaaucacacugcagucuuacucuuggauguaauguuacuaucaguuucagugacacaacaucagaggcaaucugauauugacaaugguaaaaauaugcagacgccaauauuaggagggugcaguuaguugacaguagagccuauaaguauucaucuaaguuuucucuguuugaagagaagaaaagagaacaucaaacauuucuaguauauagagcaaggauuccuaaucuuuuuuuuuuuuuaaugugcaaacaagacaaaaguuacuucacugucuagggguuauucccuacucuuuagcacuggccugacucucucacucccacauauaagcauucaauaaauacuuaugccaacaauuaagaaacaccuggcaugaaaaauaauaacaguaauaaacuagaagguagaaaauguaauuauugacaaagguguggaacaauacaaaauaaauuccacuuuagauaccugugaaauuuuuuauuguggcaccaggagaguaauuuccuaacagagaaaagaaaacauagcauccacaccucugucuuuaccaauuccuaaauaccagcuacaguucaacuuguccacggacuucaggcuccuccuagaaaacaagaaggcuuaaaaagcaagacaaccuauuagcuauguugcucaauaaauuucaauguuaauuuccuaauucuuugauaacacauuccugaacuccuuuguaauucaggcaacauuuuaaaaaucagaugaucuaacuggacuccaagaauuacauaaacagugugagcagugagacuucgaaugugcaaucaacuauuuuuuuaauccugcugcuaaaagccuucaguagcacagaacugguugucagagauuucaguguaaccuaacaccuaacgugaaugacugcuguacaaaaauacagcugaaaauacuaugaggaagagauagaaacggauuguugauggcuaagcaaaacagcaaaugcugaugguuaucaaacacaugccguucccacucuacacagauaagauuucaaagcuguuugaguccuagguuaaguuuugggcaaguucuggcuugaugccuuauauucagauaaacauuuuccaggcagugaacauauucaaaguuggggacagugggguaacccgaaaacauuccugaccuugauggacagauaauccaaugguggagacacaaauaaggccaaauuggcuaaccaaaggugcuggaguguuaaugcagaggucuggcaaggguacaccgaagagcucucaggaaagagugacugguuugacuuggagaaggagaaggaaggcagaccaaagaucagagcagaaaacaugcccaggcugaguaugggucggacaggaagcaugaaagguagcacaaggcuagcguccaaaugaccuugaauuuguaauaaacgugugaagucacugggagcugcugccacauuccaaagcaagcaagagcagcaucccaccaguguaugaggaggaugcgggggccccaggacaacuuucgugggccucuuucucucuuaaaaaaacauuaaaagcuauauuuuagggcucuguugauugguauaaagacaacucuaagucaggcuggauucauuauuguauauucaugauuauuaucuuguucuuuauuuuuccuucugauuuuaaaagaaauuaaacauuuuugagggcuccuaaagguacugcacagccaagacuacggucugacuggaagcaccaggaguaacaggaggcaguaaacaggaguggagguagggaagauucuaaggcuuguaaauuucaaggaugagcacauucggugcgguguuuagggggugagucuagagugcuuucauggccaaggucaacaggcauuauuagagugcaccaggcuacagaaugugaguuuguccugacgggggugggggagaaaaagaaggaaaacaaucacuaccucccugauuuauuagcaaacaucccauucugucuagccccacaucacaucaggaguucuaagagucaaucuggcagagcaauucaucuacguuucauugccuugagugaugggaacuuauuuuaauuuucaaaacuagcauauguuuaacagacuugugcagagcugccuaugugaccuggggaaaaaauuaucuggacucucaccaugcagauuaucagcuugaauugcuaaugcauuccuuacccccgacggaugucuuuuugacaugucuacagaggaauaagcccuaaaacacagaaauaacaaacuguacaaucuauaucucgcccuugggcaggagggguauugcacugugugggaaagauuuacauucuaccaaaaaaucuaagcaaagaguauuuacauaagcacaaaaauuuuuucacaaacuuguucaaauaaacuaagagaagaacacaacugugaucgcaaaacagauaacaucacauagauucuggcuucugacuuuacugcuguuguucauagcauguaauucuagauaauaagaauuuuagguaauuagaauagaagugccucuucagaugugcuaaaauguuacgugcauggcuguuucuaaagagggaauaauguugguguacaccuaacgcuaaccaacugugcccuaaugaagguaaauccccaaauauccauaacacucacuuuguuuucuguguacggccaaucuccagucaagagcuccuuuacccugacacuagucucacccauguuguucagcuaugcagugguucuccaacaggguaagcuuguuaacuacauggguccuaggccacuuugcuuuuugagcccuaugaacuguuucuagguagagguucaaaguucuuggcaaagaugauugucacgacuuggguggugcuacuggcaucuaucuaguagguagaagcuagggauguuacuaaacauccuacaauguacaggcagccuccgcuguaggcccucccccacccaacauaaacaauuauuuggcucaaaaugucaguaauucccagguugaaaacuccaaccuaagccuuuacuuagggggaaagagucaugucuuacuguucucuguauuucuauuuguucacagaacaaaauuagcauucaaauauugguugaaccaaacagaguuuccacucaaaacauaauuaauccaacugacaucauauaaaacaauaacuauguaaacuguaaauccuacaaaauacagccucccuuccacagaagcaaaaaaaaaaaacguuaauuuuuaaaagguaguugguguaucaaaaguuauuaacauuaagcaagauaaccccuucaacucaagauuacagaagauugccccauaauuauuucauauaaaaugaucaaaaauaauuuuauuguauuaacucccugugggucaauuuauaauaguaaucuuuuaauuaagaaaucuugaggguuaauuauccagcuuucauuuaaaaaaaaaaaaugaggugguaacuauuucugggcaaaguucaccaggaagcaagacaaugcacucauaacuaggguuccaagaccaagcaagccagucagaaucucucuguagguaaagacuuucaaauucuagccaaucauuucauaaugaacaacuuagacaaacggagaaaaggcuuaaaaacuggaaucucuuugaauaauguauuaacucuacuggaauaacaaauauauacuaauagguuacauaaaucaaaagcccuaugaaaauauauaacuaaaaaaauuauugcuagaaaccucucuaugucuuguaucugcaacuaugaacagggucuaauccaucacugucuauaucucuagagaccucaggggacuuacagcugggucagggucacuguaggaacuggcugaagggacccacacaugaaaguaccaauaugaucuuuggaaucaaaaggcaaaagucaauucuguauuuaguaauuaccagcuguuuggagaaagccaguuaacuuuaccucuugauuuccuuuaucucucaaauggacauaguaacaucccaccucacaggauauuaugaggauuaaaaugcaguaauauacauaaaauggagaguaagcacuuuaagagcuaaucauauugucucaacuuguaucuagcaggaagagggaaaagaaaagaaaacuaaaaugagcacguucguaagacaucuggggagccugaacugaugaauacacagcauuugaaaucuccugcgagcuaucccuacaaagauaccugcuauuuauucaggaacccugagagaggauuuccugcacuaaagaaaaugcugacuauauaaccacauaugacacacugguuuaaagaaugucuuaugccauuuaaaauagacaaucuuuccuuguuuaucugcaagacgucugccugccaaguugucucuaaaagagacaaacugguaacgacacugcaacacgugugucgucaaccccagcuacacgcucaguguggcagaucugacucaccaagucuacauaguauuuuuaaacuaucuaagauauuuuaacucaugcaguuuaauggcaauuuuagcucuuuucagaaugucugauauaagguucaugaaguccacucugacaauuuacuauccgugaaucacaaugauucuaaacagagcuaagaagcaaauuucaagauauuaaauuuuuuugguucauuucuuuagccacaguauuaaauuuguuucuacacagaacuucucuuguguaagaaauuuguuauugcaugcuuauaccacuaaguuauuaaauauaucacuaguaauguauacucaaaauggcccagugagguuuaagacauucguuucgaaguaugaauaaaugccucauuucauaucuaauucaguguucucaaaaacaguuuucagaaaaugucaacaguuauuaccugggaguggggagaauucugucauaaaacacauaugggaaauggaucauucaagauggauacuggaggcuuuugaaaaaaaaaaccguaauaaugaagucaguuuaacuuuuuuaaaaccaagguuucccaaaauguauuugaccgugggccacuuccauugugacacauuuaacaugcuuggaacugaauuugaaaaauguacuaagagauuugaaauggaugaucaagcaaaacuuaaccagaucauucugagugaaacaaaauaaacaaaaccaaaagaagccuuaaagggaacaaaagcaggaguguuaccaagcuccugcagaaaugaugauuauaauaacacaucagauuuggcucuaggcaaaauaauuacaugacaugaagaauugagagcaagaaaagagaggauuagaaugaaggaguguuuccaaaggccuaaaauauuucagaagcaaaucaugagcauucagaaaaugccaaaaggguacaagucaagaauuuuauaaggucccaaugcaguguaaaauuccaggucuuggacaggcaccauggcucacgccuguaaucccagcacuuugggaagccgaggcagguggaucaugagguuaggaguucaagaccagccuggccaagauggugaaaccccgucucuacuaaaaauacaaaaauuagccaugcgugguggcagcugccuguaaucccagcuacucaggaggcugaagcagagaauugcuugaacccgggaggcagagguugcagugagcugagaucacaccauguauuccagccugggugacagagugagacuccguuucaaaaaaaaaaaaaaauuucaggucuuaggucuuuuaaacuauacaggugaacuaaaucauggugguuuguuccaaacuaaguuaaauuuucacuuagcgauauaaacgugagauggcuaaugacaagcagaugcacaaauuuuaucacaucccuggauuccuaaauugcauuugugaaauucaauaaagugacacgaaguauagacaauaagugaauaagaacuaagaacagaaaaaguagaagacauggauaucugcagcaaagcccacacccgaggggagaaaaacauuagugcuguuguuuccaugauacgagcacagguuccuacacugauuucacaauaaaaaauacaaauuacuucuaauuuucccauuuucacacaagugaaagagaguucagcccaauuucugaauuaaauuuuccuuccuauagagggaaggucuuuagaaaaucuuuacaaaauaguacuacacaugccuugugauauuagggugauacggugauaaauuaaaagcaacagguaauuaauaugauuaauguaauacccagagaacuucacuauuucuuaaauguuuuccugagauguuauauugaaacguugugcuaaaugucauuacauaaaauguugagcaucacacaacagcugacaaacuaaccuuccaaaaagaaaggaauagauggucauucacacgaagguuacauuuuacaaacaaaacuggacacacaauaccauucugugauguuuaagauacaacaaaacauguacugcuuuuuuaaaaauugcuguaaugaggcucucacaguuauucacguuuuauuuagcuacaaguuuuaagauaucugugaaagaaaacuucuuuguuuuaaguucuuguuugaagaucaccaagcuucuauagugucucucugaaguggugacacgcugacuuccaggcacaagccaggcacaagagaagcucugcaggaaacagcaaggccacucuccauaaggagacaggcuuggccaugacaacuguggcuuagagcugaggagcacagcaacucacaacuaaugucuuugaauuuuagguaccagcacugagaaucaaguuccuuuccauguuuuaagaaacuaauaaaauccucaagaagaccuguuuuagauauucaugacauuuccuaaggcauucuauaauguuaaaauacuuagaaaugacucaaccauuuggcuaagcuuacgcuaagggcaaauuccuguuucuagaugcgucaggucuggacagcaccaauaugugagcuucaacacccagagacuugacuucuauuuagcaauuuauauuuuuaguaguagccuucccuuccuuccuuccuuacuaucacagaaaagaacaaagaaaaaaaaauucugcuucaaaagccaaagaguucacuacuaagaauaaauucuauuaucuuccuuagacuaugccuauuacuggguaauauaaauauauguuguuggucagaugcaguggcucccgccuguaaucccagcacuuugggaggccgaggcagguggaucacgugaggucgggaguucgagaccagccugaccaacauggagaaaccccuucucuacuaaaaauauaaaauuagcugggcgugguggcacucacccguaaucccagcuacucaggaggcugaggcaggagaaucgcuugaacccaggaggcggagguugcggugagccaagaucgcaccacugcacuccggcccagguaacaagagcgaaacgccaccucaaaaaauaaauaaauaaauaaauaaauuaauuaauuaauuuaaaaaaaaaggucuguugucaaugaaguagugaaaaggcccguaaaacaaaacacuucauuauuuaccaaaggagcaccgagguuuuccagcgaaaugcaaccauuuuauuguucacagugauucuauaaacguuuuuccuuuaagacaauugcgcauagagcaauacacucagucagucacucauauauuuguuggcucuuuuuacuaagccaaaacaaagauuauuaaacucuuauuagagacaacaacaguguaauggaggcaugcuuaaauaagggaaauaagaaaauuuauacuauacugaguauaauuuaagcauugauagccaaaugaccaauacggcaauacuugagaaauguccagucauaagaagcuccucugaacgauaaagccaaacuuacugacaacugacuugaacuaauaccuaauucaagucaucugagagaucuaaccaacuguucucaucagugagaaacauuauauguuaucuauugcacaauaugacugaaagauagucaugucuugaaucucaaaucuucagaaugauaaaccacaaaacucuacuuugacaccuaauguauacagaugaaugucugucuacuuccuacuggaaucgugauaguugaauuaagauuuuuuuuuuuuucacucagauccuguuuucuuaaauaaggaaaaacaauaauaaacuuaccauauuaaacaacuaaaaaucaguuguccauagaugacaaaugugauacaaucuagcugucacuagauaaaagguuaauuuuguaaacagagucaguuaaaaaaauaaacaaaaaaauaagcaauuuaagauaaaaguacuuuggcauggugagacauuacacucacuggggccaggaguucaaggcuguaguuugcuaugaucgagccugugaauagcuacugcacuccagccucacauagggagacccuaucucuuuaaaaaagaaaaaagugaugucucaaauaugguguuugggacucacuaaaaauaacuaaauuuaagggggaaagauuaaauugguauuauauaugccauaugcuuaaauucugauuuuagcucaaccuuauaauuaaaucuguacuuugcacccauuagacauuucagcaaacugaaguucauucaaaucaaaaucuacaaaaagaacaagaucccaaggcacugaauuagacuuuuaauauucaagauguaaaauaggcacucuuuuaagaaauuacuuuuaguucuccucuaccuuuaaaaaaaaguuucucuccuacucgugaacuaauucagaacuuuacauuucuguuacacagcauaugauuucugcuuuauuacuuggauaucuguuuaguauucacaacauauauguaucuccauuaagcccagaauucuuugacagauggucucacccaaagaacucauaaauacuugauuacuucaacuuaguuugcaaaaauuaaaaaaucaguaaauuauguuacagacuauaguauuuugaguguuaaaaucacuucuaaagaacaccaucacaacagaacccuaaauucagaaucggguugacauggucuaagaaagugaauaaacggguaagugaucuuccuagugcaucauauucuacacuaaaaauucaccauuuauacuucauuucugaaacucaaugucaaagagaagauuaaaaaucugggggcugggcacaguggcucaugccuguaaucacagcacuuagggaggcauggguggguagaucccugagcucaggaguuggagaccagccugggcaacauggcaaaaccccgucucuaaaaaaagauacaaaaauuagcugggcaugguggugcaugccuguagucccagcuacuuaggaggcuguggagggaggaucgcuugagcccagcaggucaaggcugcagucagccaagauugugccacugcacuccagcagaguaaaacccugccccaucucucaaagacaaaacaaaacaaaacaucugacaguuccugaguaaucggcagccuacguaaggaaccuauuaauacugcauaugcaauuuuuauuaacacacuugccaauauccucauuuuaggacuagucuaauguuuguaugaugccagacuaauuuugaaugucugaauuauucacaauuacuaggaagacaaaucauuagacuauggauucagucuacaaucuuauucuauaucuuuuggcuauguuaacugauuaacaacuagaauaggccgggcgcgguggcucaugccuguaaucccagcacuuugggaggccgaggcgggugggaucaugaggucaggaguugaagaccagccuggccaagauggugaaaccucaucucuacuaaaaauacaaaaacuacagcacgcuuguaaucccagcuacucgggaggcugaggcaggagaaucgcuugaaccugaggggcagagguugcagugagccgagaucgcaccacugcacuccagccugggcgacagagcgagacucugucucagaaacaaaacaaaacaaauaacuggaauaaagaaaacaguucccuguccguaucaaaccaaucagaaccaauauaagaaaaugcucuuccaccaaaauacagauuugauaugguugaccagauaauacauuucucuuccuggcccuaaucuagaacuuaacuugguugugacuuugauuucugacauuuacaaaauggcauucaguccuuuauaacccauugacuucgcuuauguugaaauuccuuugcaggaguuuccaaacauguuaaaguacagcauuuggaggagaagcaauguuugccuccuggacucaagcgaucuucccacucagccuccugaguagcuggaaccacaggugcacaccaccacucccagcuauauuuguagagaugaggucucccuauguugcccaggcucaugacaaggaauacugcaugccaauaauggaugccagcugaguguccucuaauucaacuggauucugacacuguacuuggagauuacacaucccacaggcugagggcucaguaccacaaaacucccccaacuucagaugucaaucacaagccccagguuguagccugugcuucugaccaacuggcuaccauuccccagaccccuuacuucguuuugauucauugcuggagcaccuucagagaacuaagagaaauacuugcuuacauucacccauuuauuuuaaaggauauuacaaaggacacacagaugaacagccagauggaagagaugcacggggugaggugcggcugaagagaaaacgagauuccaugcccuuuccugacauccaacccuccaggaaccuccauguguucagcuaucuggaaguucccagaacgcgguccuucaggguuguuaagaaagcuucauuauguagguaucauugaucauuaguuuaucaacucaaacuucagcuccuggagguuggggagggugacugaaaguccuaacccucuaaucacaugguagguuacccagccaccagucaucucauuagcauauaagaccuucuuagcacuggagauuccaaggauuuuaggagcuaaaugucaggaaacauauacaucaggaagaccaaauagaugccacaguaucacaugaccauuuucuuggagucaagauauuuguucuuccuuaaaacuucgauguuucuaaauauccaagguauccacauaagguuaaaaauaaacuucucaccacuccacuugucauuuaaaaucauccaacauuuuaacauuucaucaaaucucuauaucuauacaauagugcccaucucuucauguuuuuaagagcccuguccucacacuauucuuagugaauagacagcaagagauauuauucccuucuuacaauuaugcucugugcauaauaagauagcaagccaaagauaaagccaggauuagaaguacuuucuuaaauugagagcuuaucagaagguaaagcuggcuaacaugauuaucuauguaacagcaccagaccuucucacuucgaaauucaagacaucuccaaccacucagaaaggguauggggguugaaaacagccacauuauaugcacgacuucuauaacuuaaagauagccaaguucauaucaaacuaaguuauugaauuuuauaucacuuucuaacaaguaaucauagaaccaugacaaaacauacaaaauacagaaguuuucuccuugacuuggugcaaauucaauccaauuacuccacagaccucuuuuauuuuagucacucaaacuuugauuuuucauuuccuuagucguacauuaggacaaaugcaaauuauauacagaaggcagcacauuuagccuuauuaucucaaacucauuccuaagcaaguacaucugccuggauggugaggccuccaucagagguuaaaugcaagcccuagcugggaaaguuacuggaagggcauguguccuaccugccuuucucucucaucaucccagaucuuuaucuccccaaugucaccacauuaggaguguuuugcauauaaaucaaaacgaagccccagagagcccuugguaggaauaucuggacuuguguuuuagaaauaguuuugucagccaggcacgguggcucacaccuguaaucccagcacgcuggguggccgaggcaggcggaucacgaggucagaaguucgagaccagccugaacaacacagugaaacccugccucuacuaaaaauacaaaaauuagccaggcaucguggugcacaccuguaauccagcuacucaggaggcugaggcaggagaaucgcuugaacccaggaggcagagguugcaguaagccaagaucacaccauugcacuccagccugggcaacagagugagacucugucucaaaaaagaaaaaagaaaagaaaagaaaagaaaagaaagaaaagaaagaaagaaagaaagaaagaaagaaagaaaagaaaagaaagaaaagaaauaguuuugucacauacacaucugugauccucucacucugcacgccacugccucucugaaagaaccaacauaccacacaggcacgcacacgauggacaauauacagccaccgagcaaucauauacaucuuuuaaaaagaaacaggcaauuucaugauucuacuguacccuggauccaucaggcuuuaucuagggagugcuauuuuuaaaauauguacaggcuuuuuuagguccucaguaagaucauggaaguguuuugcucccuaaggaaaacugaaauuugagguauaagacuggaguuuuacaccucuagaauucaucuuugguaaccaugcccauuugauuuauaaauaaucuaaaaauauggauuuuuaaggagcaguguauuuaccuuaguccaccucaucuuuuucuuuucaggaauguuaucacaaaaaugugugcugauuacuuccuuguaucugagcuuugagcaacuuacaaggcagacacuggaccuaaaacacagguugguuguuuuagaagaagaaaaaaaaaaagcugguuuuaaaucuggauuuaagucuuggcccugacuccaaagcaggccaguuuaugugccugucuucuguugccagaucuguagaaacuagaaugucauucuccgcugagaaaccacaaacuaguuuccuuagaccauucgucuuccuuuuugagacagucucaaugucacccaggcuggagugcaguggcgcgaucucugcucacugcaccuaugccuccuggguucaagagauccaucucugcucacugcaccuaugccuccuggguucaagagauccucccgccuccaccuccgccuccugaguagcugggacuacaggcaugcgccaccacacccagcuaauuuuuccuauuuucaguagagacagcauuuggccauguugcccaggcuaacaucaagugauccgcccaccucggccucccaaagugcugggguuacaggcaugagccacugcgccuggcccuccuuaaaccauuaguuuucaaaccguauuugaaguuccucagaggugcgccaguauuugagagaagguuaagguuucaaugagagcaaaugagauuuuaaaaucuuuucuauaaacggggguucuaucccaucuaaauuuugcuuuuuuaugaaaaggguuacugcccuuuuuuuaaaccuaaguaaaaacccauacccuuuacuuuguuacagguguguuauaauuucaaguugucuuuuaaguaugagauaacuuucauuguuacaaaacaaguggguugggaguggaucaacgagacggagguuugcuccuucauuuaacaaagaaacaagaccagagagcucuuuccucacugggaguuagaaaugaccacagacgcuaagaacagaaagcaagacaccaaaacuaagaaagguuuuaggagcuacaaucucucauuuagaaacuccagauagaauuuuaaagaaaaaaguaaaaacaauauauuucuacaauucaaauaauauaagucagaguaaaaaacaaacaaacaaaccuacuuagcacaacauaaaaauauucugguuacucauccuagagauuuaaaaaaaaaucaggaggugaggcagguccuauuuuuguuccuucauuuaguggaucugagucauggcuguuccaaugauuuuccugaugaaacaaaauacauguuuguuccaucaacaaagggcuacccuaggaaacucaucuucuacugcaguaagaaggguaucauagguauuuuuugugguucuaauggguacucagaaaauccuuaugugauuuaauauacucuuaaaaggaccgucugaaaccaaaacauguacuaauauccaguggccuuucucucuguauacugguuuaauaauaacauucugcaucaaauccuuucagaaaccuaugaacagaaguaaaaugauaugauaccugagaauuauuuuaaaaugcuucagaaaagaaaauggggcagggggaggugcugaaacaagaacagcaaaauguggucaauuuuugaagcuggaugauguauaugucugaaauuuaacauaauaaguuuuaaaaucuucuuagagaguuggcagaucauauacuauacacaaauauuguacauguuauaggaucaaaauaugggauuaaacuaagggacugaaacuacuuauagaaugucauucucaagccaggcacaguggcugaugccuauaaucccagcacuuugggagauuucuugagcccaggaguucaacacuagccuggccaacacagcgaaacucugucucuacaaaaaaaaaaaaaaaaauuagccaggcaugguguuccucuccuguaguccuagcuacuuaggaggcugaggcgggaggaucgcuugagacaaggagguuaaggcuacaguaagccaugaugacuccauggcacuccauccugggugacagagagauagccugucucagaaaacaaaacaaaacaaaacaaaacaaaacaaaacaaaauccuccugcaaauauucuguugguggauaguuuucaauguauacaauacagucaguaccuguuacucaauauuuauccauugcaaacacaacacagaaaccuaaggaacucaaaaagcaaacugacauuugucaggaacugcucccuuguuggucaaagaagaggaaaaggagggcuuucuucgauauuauugucuacuuucuugguaagcaauaaaguguuugcaguuuuauguagacuggcgggguggggcggggaauugugacacgguuacacuuucguauauaucaaguuacucccauacaugauuuuagguagagucuguauuuuaaugugguagaaaggggugauuaguaucuugaacugcagaggcuacaaaaaacaaugaugcaacauuacguaagggaugagaaauaaguaaauaaguaaaaaaaaauaaguaaauugaaaaguuuguuaaugcacaaaaccaaguaacuggagagaaaaggacagaagagucaaagaaucaagguccccagaccuagagugagaauguacauuaucgugugcauaccuuaaucucaaauauaagcucauuaucaaauaauugugcaaaaaaaucaucuguuaccuugugaaggauagaaaggguuauuucuuccaaagcucaaaaugugguccacagauaagguaagguuacauuagugguucuccaauuuuaacuugcaccagacucuacucaagguuuuguuaaauagaucucugggcccacucccagaaaacgguuugagaacuauguguuuauacuauggcuaauucuugcaaaucaucugauuuugaaaccagucacaauuuuuugaaacauucuaugagaaacaucuuauuaauaagaauuuucaacagggcucaguggcucacgccuguaucccagcacuuuaggaggccgaggcaggcagaucacgaggucaagagaucaagaccauccuggccaacaugaugaaaccucgucucuauuaaaaauacagaaauuagcuggacgugguggcacacaccuguagucccagcuacucaggaggcugagggaggagaauugcuugaaggaugcagugagccaauaucgggccacugcacuccagccuggcaacagagcgagacuccgucucaaaacaaacaaacaaacaaacaaacaaacaaacaaacaaacaauuuucuggcaaaguaagaguauuuuacaaagagaacaaucacacugguagagaacugcacugcauggauggccaaauuaaaucauuacaccaaauaauuugcaaacuucaucccuacuuuggucacaauaaguaacauuguacuuuugaaagauauuacugucugagaacagaguuucaucuuacccaaauacagacuaaaaacaaugccaacuucacaguacucacuuacauaguugauaaacagaaccaacaaguccucuaauugguccauuugaaucuggggaagagcuggcuccaaucauugucaauuacaucagcaacuguggaauacucccugagaucaacaaacuguuaacugcagugaccacaacuugacccaggccagagcuuccauccucgggagggugagucaacagcaugucaacacuaacccaacuucuaccacgcacagcaaggcugugcuauuuaggcguggaucacacgcacacugcgccaacuucuaagcuaacaauggacaaccaaagccuccggaacucugucuuggguagaguaaaucaauuuccuuuuguaggauuuucuuggcacaaagccaagugucaggggcuguggagaaggaacugcuggcccaaauuccauccaagguugaccagugguuuaaucccuucucuaaaucaggccucuggcaaaacagcuagaaucaggaagccaauucauauuuaacaaauucaaagucuaucacaacacaggaacuuguuaggcaagaagauaacugaaugaacaccuuuaaaaauucugcuuuuuuaacaaaagcugucuacauuauuuucucaugggaguuuugguacuaguguuaauucauagacucucccuuaaacucaaauaaauuaucuauugaaagaauggcaagaaguacugccaaacuucauagggugguugggcuaaauguucucaaguucuuuuccaacguuaaaacaaccggauuauaagaaacaauucauuuaauggagcauucuggaggaguaaagacagaggauuuggaaugagacugcauagguuuaaauucuaacacuaacuguaauucuggccaaaagguuaugaugugggguccucaucuguaaaauggaguaucuaucucauggagucagugugagaauuaaauaagcacauaaauuucucaacaugacgccuggcaccuagucaacacucaaaauagaggaaggcuaauaaugaugacaugcaaaucugauauugcaaauaccaacgcaaagagucuaaugaaaacuuucuaaauuauaugucauugguucauuauuuaagcuucugagguuuguacaagcacagauuaacucaaauguuacuuaacguuuuacauuuacuauaaacacccugaugauguauuuuacaguuucuugauuuuucccuacaguuugggcacagucuuauuaugacagaaaagaaagcaacaaacccaaaggaaaggcuuuucccuagacugcuuuuaauuuucuauuaacugcccaauuuugaaaaauagaucuacaaaacuggguucuggaugacugaguucuuuuacuuuggggacaagagcugaugcuaaaggagaagacagaggauuaagaaauuuacauucugucauuuacaaacauggguaugaacaugaacagagccucugaaaacaucuggcaaauagaagacacuaugagccaaucaaucaccaaugcuggcuuaguagucauauuaauaaauacuugcugaguauauacuauguucucugggcuguauuauuucuuuuacgccucacaacaacccuaaguuugguacuuuucuaucgguuccaguuuacaaaugaagaaacagggaagaguaaggggaguuuucaaaaagaaauaauaucaacaguuauuacaucaaggguuucacaaaugaagcauucaaaaauucagaaaggcaaugaauugcuuugcuagaccuguggaaggcccucaaccugcacagguagccaacacccgguacauacccaauuacauccaguuaggucaccucuguauggcugcaaggagccagggccauguguggugccuagccacacuauauacauaaccugggaaccaugcagcaagauggaagaauaggaaacaguauccagaauccagauguuagaucucagggguaggguaugcacaaggaguauuugcaccauuuaaggugauaacgcugcugucucauggcaacaugcggggcaguauaagaggcuugguaaauauccacuggaccuucccuaagcuuagcacaaugcguccuggauggagaaaauaucaaagccaccaaucugagcauguuguggaaccagagagacuuaagaggcugcaccaccacacagcccucacucgaucuuucuaggcucugcuaagaauguugcugcuggcucacugcagaaacuaacacuuacucaaagauggugcauccugugcuuauuuucaccaagccucauauccccuucucugccagaccauuuuaauaccauuagauacuucccuauucaaaauuaagacagugucacuggggccaggcacggugguugaugucuauaauuccagcacuuugggagauagaggucggaggcucgccugaggccaggaguucaagaccagucugggcaacacagcaagaccccaucucuacaaaaaaucuuuaaaacugcugggccugguggugcaaaccuguagucccagcuacucaggaggcugagguggcagcaucgcuugagcccaggaagccgaggcugcagugagcuaagaccacaccacugcacucuagccuuggcagcagacugagauccugucucaaaaaaaaaguaaagaaaaagugaaaaaaaacaaaaauagugucacucagcaucacuuaagaaaauuaauaaaaauagguacuaccuguauuucagagauaaguaaaacuuauguugaaauggucaaugcuagauuuuuauaaaaagauguccaauuuuuaaaaacucauucaaguuauaagaaauuuuauaaucuuuauuccaugucaaagauaggcauuagaaaaauucaguauuacuuuacuuuccauaauugucaacuuuuauaaacaaugugguggagugggaauuaaaaucugauaauaguuuugauccauaaaaugagugggaaaaucaauuuuaaggcagaaaaaaaugcuucaaguuaaacacuuacuauuaaauauuuaaacaaaaaaauguaauaaagauaccuucaaaacuggcugggugugauggcucaugccuauaauccuaauaugucgggaggccaaggcaggaggaucacuuagccuaggaguuugagaccagccuaaguaacauagcaagacccagucuuaaaaaauaauaaugaugaugaaguuuugauaaucaaaaguuauuaucccuuuuggcuuuaccauagagcuacagauagguguccugguuaggucacuucuuuuauucuucccuagcuuuacugaaguauaauugacaaaaauuauguauauucaauguauacaacgugauguuuugauauauguauacacugugaaaugauuaucacaaucaagcuaauuaacauauccaucaccucagaguuacuuuuuuuguucugugugguaagaauauuuaacauuuacucucgcagacguuuucaaguguacaauucacuauuauuaacuagucacuaggcuguacauuagguauuaaucucauaacugcaaguuugcacccuuugaccaacaucgccucacuucccccacauccaaacccugguaacaccacccuucuacucuuguuuccaugaguuugaguguuuuagguuccacauauaaaugaaaucaugcaguauuuguuuuucugugucuggcuuauuucacuuagcuuaaggccauaaguaccaggggccuggauuucaaccucaccccuauuguuuauugcuacuugggucaaauuauguagccucccuguauuaaucugaucucacgcugcuaaugaagacauauccaagacucaguaauuuauaaaagaaacagguugaacugacucacaguucagcauggcuggggaggccucaggaaccuuacaauuaggguagacggggaggcaaacacguccuucuucacaugguggcaggaagaagaagugccaagcaaaaggggggaaaagucccuuauaaagugaucaguucucgugagaacuaacucacuauuaccagaacaggaugggggaaaccgccucuaugauucaguuaucuccaccuggucccucccacuacacauggggauuauggggacuacaauucaagaugagauccagguggggauggagccaaaccacaucacucacugaaccucauuuuguuuauacuucauuuugagauaguauuugcucugccuuucugauaaagcuaugcagaauaccaaguuaguaccugguuucauauaugguuuauaauacauuauuccugauacaaucucaauuuacuguuuuuauacagccuauuacugcacaaacauuuuauaucuuaagcaauguggauuuuauuauaaucuccuacacuaaauaguuauaaaaacauuagcuauugguuugggaaaggcuacacucaaucuuaaauuuaaaagucaguuacaauuuuccauuaaaaaaauacaaaauaagcuacagaugucuuaucauggucaauucucuugaacaacuuucuggguuaaaaugcagaaaauauaacagaucucaguauacaauucagugggagaaagaacaguuccacuaaacugcuuucuucugacuuaccaugagaauuccaaagauagcauuaaugucaacuugaaaaaugauauuacaagcaccaaugcuagaaauuuuagaucgagggaguugcuccuugauguucaaugugcugaacaaaguaaagcaaaugggccugaaguaauaauuuaugcuuccaguacuuucaaaagcaaguuuugauauaagaaucaguuacccaugaaaauagaugaaauucacugaaaugaccuaguuuuauaauacaauaaaacguucuuuucaacuuuauaaaaguaauguuccucugaagaacagcugggaggauucuagauaucacaucaaaauacgugccuuccuaacauuagagauguuuuacguggaaugggauggcuugccugugggaugaagucucuggggagaacuaucaaaagcuggcugacuaccuaccaggaauggcagaaccaaggaguccuacauucaagaugugccaagagggagcagccucuaaggcagugaucucuaaccuuuuuggcaccagggacugguuuuguggaagaccauuuauccaugggguguugggggugggauggcaugagacuggaugggaugggaugguuuugggaugaaacucuuccaccucagaucaucagacauuaguuagauucucacaaggacuggaccaggcaaccuggaucccucccauguuuaguucacaauagguuuugugcuccugugagaaucuacugccaggaagcagcacucaggcaguaaugcucacuggcucaccugccugccacucaccuccugcuguguggcccgguuccuagcaggccauggaccaguaccuguccauggcuggguguuggggaccccugcucuaaaguaucugcguacaguuaaaaagacucaaauaguacaaaaggugauaauauacaaaguaaauauguacuaccuucuccuccauuccaauguucucauugcccagagucagauuuugucagauucacuugaaucugcuacugacauaauacacauauaaauuuucuguuuuuuauauaaauuacuguuuaaucugugauuaugccugcauucugaauguuuucacuuauaucgguaugauuuuagauauuucuauacaucaguaugguuaugcccacuuuuaauguaucagcauaauauucuacuguauaagaguuuuuuaaaggcuugcuuaguugauacaaauaaugcucucauaauauccucaucugugcgcauuuauacaauauacuaugaacuaauuaguuucuagaauuccuagaucaagggauauguacauaaaauucuaaaugacugaucuaaaaaauuucuguaccagcugcaugcagcggcucaugccugcagugggcagaucacuugaggucaggaauucgagaccagccuggccaacauggugaaacccugcuucuacuaaaaauacaaaaaaugagccaggcgugguggcucacaccuguaaucccagguacucgggaggcugaggcaggagaaucacuugaaccugggaggcagagguugcagugaguccagacugugccacuguacuccaagcaaagaaauaucuguuaucaauugacaguagaugaaaaugccaaucuggcaagccuuuuuagucuuugcccaucaggguuuuaaaaaacaauguuauaucacuguuuuacuuugcauuucccugacgacuaugagauugagcauaucuucauagguuuauuggcuguguauuuuuuccuguguacuauaaaauucuuugccuuuuuuguccacgucuaauagagauucuguuagacauccacacugaaauauuuauacauaaaauuauagaauugaaauuauuucaaaauaacccagugagggaaaagagaauugagcagguugagaaaggggaauacagauaaaacaagacugggugagagcugaucauugcugagcauucagcgcacuauucucucuuguguauguuuaauucuuuucauaauaaguuuucaaaaauguucauuuuucucugaagauguucauauuuaguauuucuuacugauuuguaagaacacuucauggaauaaaaaaguuugccuuuuguugcugacaaacuguacuggguacauaauacuagguaauccaguauugguacuggguaaauaauuacccaccuuccuucuauguacagucagauaacccaacaccauuaacuaaauaauccaucuuuccccuuucugauguaaaaagacacuuuuaucuugcacuaauuuccaauauaugcacaacuuuauuucuagacuuccaguuugccccauugaccuaucuaugcaugggaugugcaguuuuaauuucuauaucuuuacauuuugcuucugguuuuuuauuggcuauucuuaccuaaugguuuuucccagaugacuuuuauaauaauuguauuaauuuuccuaaguaucuacuacacuuauaaacaccccucccugcagaacuccuucccaaagacagagagccugcuuuucucuuucacacugguauguuuuuauguuuccaccuagggucucaucuguugcaugcaagcucagaauucacuugacaugcugauagcauauaauguuaaagaauucuucucucaguguaaaaaauauuuagcuacuguggaaggucaaacugcuaaaaccgacugguguaacauuugaaugcugcccuuuauauaagcuuuauuuuuauaaauaagcaucugacuagaaagucaguaaaagagcaugauauaaucagucugaagcccaguguuuuaaauauaauacacuaauuuuagacccaaguauuuuaguuuugcuuuauugucuacaguuucuuaagaagauguaacuuaaaagaaaaaaaaaaucuuuuaaauggcucaaucaauuuauuagaaauaagcggcaaagagcaucuguucccacagagcaacuguuaaguuaauccccauuaagucggccucaaagcacuuggaugcagcuacaggaugugggugugauaggaucacacaggcgaacaccugauagggccuuacacacaccgggcuaaucagaacaucaaaaaaaaaaccugaagucucuuggaaggacugaaaaauccaaucccuccccaacccccccaaaaaaaccucccaaaacagacuauuccauucaauucagauuuugugaauuaaugaaauuuaagagccaccugaaaccaccaaagauacacagugauuuucucccgaaucuaagguccaaaugacacagguagaaaaaugcacugauaaaauguuaacaaaaaugcaugucuaauacuuagagcuacgugugagcagguuuuaggagaaggauauugauucucccugaggcaugagcauuacccaccauuucaggaagccucugcaaguggagaagccacaaaccccuucaaaaagaucucucaauuacccacuucccaguccccucugauaugugguaaacaauuauuucaaugagguuggcagagauuuuucaaagcuagcaggcaggcauuuugcagcuaccuccagcugguccaagcagccaaggcugucaccagugccuggucaccgcugaaaacacaaggaggggcaggacuagggcaggagaguagauggagagagcugugucccgaaccaacauucuugagauuccuuugcuaguguuuuuucuucaggguucacugagaagaggaaggucagauggggagggacaaaacccaaggaaaugaggcucauuucaaacucuaacaacuugaucacaaacaaaauguauguagaauuacaaauaaguuauucuguuuucaggcaucaaaaauguuaucaaugaaauguugagaugcuaaagcagugaaaugugaaacgaagcagugucacaggcaacugggccucuccccuggcccaucccaggagggaugaaggguggcugauaugaacucuaaggauuauucugaaggggccaacaaauguuacaaagaggcucaaaaauaaaaaucagaaccauuuuucccucauucauccagggccuacuccuggccauguucugugcuuugcacuuuauucaauuuaauucaauuuuucuccuaagcaaucuauuuagauacuuuguagauguggaaauugguuuagggaagcuuacaucauuuucuugcagucauauuucuaguaaauugaaagaguugugacucagauccaaggucugaaugacuccaacauccacacucagaacuuccuucacuugggauugagaaaaagggaaauaauggaauugggagggggagagaagacaccaaguagagauaucagcauucagaacuuccugcaggagagggugaaagaagcuggcagccaggaacugagggccuuacugauuacuuuaguaucuuaccaaucaauugcauuccaaggcuugcuuacuuaggaggcugacugcuuaguccaagaagaaacacuggcugaacucuuugacuuauuuugcuggaggcagagaagauaagugguuaagaguaaagacaaugaaaacauaguuuaaacccaguccacuggccagcucccucccagcuggggauaacaguagguaccucacaggcugcugaaaagaaaaaauuaagugaaagcacuuuucaacaaggccugguucauagaaugagcuacauacaguaccugguaauuaguauuacuauugccacaaccaaggaggccucucagcaaacuauuuuuacauaugccagaaauacaguuauuuuuuccagacuaauaaaucacaaacaauauggcacgguugaccgccagguuacugaugcaauuucuuuucacuggaaccaaaaaacaaaaccaccaccaaaucugaacuaaguauaauacaauaauucucccugucuuaaauuuuaaaauacagaagaaaagaugaauugcuguauacucuaaacgcucuuuuaaauguuuggaguacagaaugucuuucaugaaaucaucuugauuaaaauguacauucuuuuccaagaagggaguaaacugaguauggaagacccucaccauuaguuuuuauaaaugauugaucaaugggaaucgucacugaaaaauugcauacaauuuuuggaaugaaugcaaauugauggaauguuuguaagcucaugugcuucuuccaacaccccagcaugcucccaccucacagccuuuacacuguauuguucucuccagguuuaauacuuguagaaaaggggaaaaaaaccuuuuuucucuacccuguuagguucagcacaugaggccuugccaauuaaacugacgagacagauucgcaggggaaaaaacacaaauuuuauuuaauguuauuauuuuuacaugagggaggggagaggagggagcuccacagaaaagcaaaaacccaaaagaagcaguuaggccugagagcauacacaccauuuuaacaaagagcaauaaacuguggagaagucacaagacaaaggagaggggauuagggcuuccaggggaagugugguaagguaaauauaugggggaaacuaauagaagauaaggguuauuucaauaagguuuguuucugcaggcgauggugccaccucuaguggucucuccagggauggagaggggaaggaggauaccuucacacagcaaaauuuuuauaaaaaggggguaaagcuuguccugggucugcuauuucucgauugucuucagcucaaauuaguacuuugcugaaauggcauauuuggggguagcauauucugauccccuucauacccuuccagacugugucucuauccagcuccucacuggcuuaauuuuucuucauagcacugaccaccaaguggcacagaguauacugauugacaucuagauagacagauagauagacagauagauagacagacagacagacagauugacugauuugcucucugccccacccaacaaaguacaagcucugugagaucaggaagcuggccucuuucaugguuguaucccaaugcuuggcauaguguugguguucaauuaaugcaccaaauaaaugaacggauuuccauauuauaucaauauuuucuuacaauuagaauuucugugauguugauaguguaagaauuuguuuuuauuaguuuucaacaguaucaacauuuacucauuauguaguuacaguauuguauuuuuuuaaaguaaacaauaaacaacacugucuuugcuccaaauaccuauaaugugaaauauauaaaacuggccgacugaccacagaaacggcaguuaauaaucaaaauuacaugugucuggcugaauggacuccacgaccuuacacuagguucuguaacagcagcauuucaucacaauuuguuaaauuugaagauaaauaccgucucuuuucuggucaaagauucuuauaucuuuggaaacuugacagaauuaauguuuuugacuuguuuuucaccacauaacaucaggagagacuuuaacagcagugaaguggcaaggaggacgcuuuauuuauauccguguaaucauguaacccacuucaugcucccacugaauggcuccaguaaacugaaaucacaauuucacuaauaucuacauuccagcuccagcuacauuugccugucaaaugcaacaacuuacaguuaagcuucugccuacacgagcaaucacagaaccauuaaauaagaggauugcuuguuugaacuacuagaucagccuuuccuuauuuuugcuaaucugugugguguacguucauuaccuuuuuuuuuuauguuaaagaccaccaugcguaacacuacuugacagcagcaauuuauagcagugguccccagccuuucuggcaccagggaaugguuugaugaaagacaauuuugugguuugguuucgggaugaaacugcuccaccucagaucaucaggcauuagauucuaauaaggagugugcaacgcagcucucacuuucuuacaugcgguucacaauaggguuugcgcuccuaugagcaucuaaugcccugcugaugugacaagaggcagggcucaggcagcaacacucacucacccauugcucaccuacugcugugcagcaaagcuccuaacacgccacagaccgguaccaguccauggcccagggguuagggacuccugauucacagcauuacaauaaauaauaaauaauuaaaauauuaccugauauuuggcaaacaaucccucucuaagucacuacuuccagccuauguucaggcuagaaaugccaaauaaaaaagcacaugucugucugggcacgguggcucacgccuguaaucccagcacuuugggaggccgaggcggggggaucacgaggucaggagaucaagaccauccuggccaacauggugaaacccuaucucuacuaaaaauacaaaacaaaaacaaaauuagccgggcgugguggcgggcgcccguagucccagcuacucgggaggcugaggcgggagaauggcgugaacccgggaggcggagcuugcagugagccgagaucgcgccacugcacuccagucugggcgacagagcaagacuccaucucaaaaaaaaaaaaaaaaaaaaaaaugggccaaggaucugaauagacauuucuaaaaagcaaauguacaaacaaacaaaacaaaacaaaacaaaagcacaaguccacaacuacauagcuccaguuucccuaaacagauuuacccauucaguaaacauuacauguacaaagaacuuaaaauaguaugagauuuaauguuaagaaauaaaauguaggaucuaaaacguaaucuauagcauaaucucaaaaaugguuuagaaaugacauaauaauacagacauuugugggugguaggauuaugcauauuuuuauauauuuuuaaauauauuuuucaaaagcuuccuauaaagaauguaauucuuucccaauuccaaaucuagcuuaaacauaauuuuacaaaaauuauucucucagaauguaaacuaguaccaccucuauggaaaacauuauggagauuuccuaaagaguuaaaaguagaucuaccauuugauccagcaaucuuaauacuggguaucuacccggaggaaaagaagucauuguaugaaaaagacacuuguacacauauguuuacaggaccacaauucacaaaugcaaagaugcagaaccaaccuaaguggccacugacuaaugagaggauaaagaagauguggcauauauauaucagggacuacuacucagccauuacaaggaacaaaauaaugucuuuugcaacaacuuggauagagcuggaggccauuauucuaaguaaaguaauucaggaauuggaaaaccaaaaaccguauguucucucuuauaagugggaacuaaguuaggaauaagcaaaggcacacagagggacauauuggacuuuagagacucacgaggaggaggguaauaggggacuagggauuaaaagaaaaacuagacauuagguacaagguacccuacuuaagugcacuaaaaucucagaauucaccacuacguaauucaacuaaguaacaagaaaccacuuguaccccaaaagcuacugaaauaaaaauuauucucucaaaaauuuuaagcccuaaacuucaguuccuauuguuuauauuuacuaagaaaaacaacagaaaacacuguuuuaaaaaugguggauuuuuuuaagguuaaagguauauaagacagcugccuaaggaaacgcagauaccccuguaccuuguuguuguuguuguuuuucacuuuuuuaaaaaacauagagaugggaucuccuuaugcugcccaggcuugucucaaacuccugagcucaagcaauccucugaccucagacucucaaaguuuugggacuacaggcgacagucaccaugccagccaauauccuuguacuuuuaacucauuccuacaagccaugaauccucuaagcauugucccagacacagcacuggcaaacuucaaucguuuucaucagaauauaaagaaacacagggcaugcuuaacuucaagguugauauuuccuuugugaguaaagccuugccacagaugagaaguccugaggaucaaacaggaaaacuuuaaguuuaauuaaaucuaaaaucauaaaaccuaaguuauaugacuaagcaaacucuucaaagcacucagucaacauccaugcugguaaauauuucaggaaugaaaugaaaaauaacuuucaauucuaaaaguucauccaucaugcaugcuucacguuguaaagcaaauauuucacaaaaaugaguuuacaacaaaagaacaccaaucccacuucuccaacccuccaugucaggcaguaagcuuuccacauuugcuuacauucugaaaauaacuauuuuacaugccaggaaugcaauaggcuuaagcugucaaaaaguaucauacuuuaaguguaacuggguaagaacuaugggcacacacacaauaagccuuccaaaacaaggggagguaaaugaaaucuuaauaccuguguuuccagaagcccagaaaugaagugcaauuccuuauaaucuguacauguuuacauacccauacagacaauaaaauguguaagguaaugacagguccaucucuccccuuccuuuuagugggcaucugacauuucaggguucagaaucacauauccugggucccaaaagguccccccauuccuauuccaacagugcucacaauagaaaaagaugaacugaucacuggacccuacaucaucucauauauguauaauacuaguccacagagagguugaagauaugccugguaacucuauucauccuaccccacaaguuuuguccaaaucaggccaugccuucaagugggccagauugucuuaaagcuccuggcuuaauauuuaacugauagcaacaaccuaacguuaguaccuuaguaacuaaaggggaugcagcaacaugaagcagaaaaagugaugaagaaagagauuagaaguuagagaacagggacugggcucuugauccuuaaaaugugggugauuuugaacaacucaacaucuccagauauuacuuucuucaucuguaaaguggagaagcuuaaaaaggaggucuuauagauucuaccuguuccagaaacuaugauucucuuccuagacagcugcagguugaagagacucuccuagagcugcacuguccaauacaguaaccacuagccaucuguggcuacuaaguacuugacaugcagcuggucugaauuaaaauaugugaaauauguaaucaggugcgguggcucacaacuguaaucccggcacuuugggaggccaaagcggcaagucacuugaggucaggaguucaagaccagccuggccaacauggugaaaucucaucccuaccaaaaauaaaaaaauuagcugggugugauggcacacgccuguaaucccagcuacucaggaggcugaggcaggaaaacugcuugaacccaggagguggagguugcaaugagccaagauugcaaugagcaagcuagauugcacucuagccugggcaaccgacugagugagacuccgucucaaaaaaauaguaauaauaaaauaaaaaauaaauaugugaaaugugaacauuuugaagacauaauaugaaaaaauaauguauuucauaaauagcuuuuauauugacccccuguugaaauaacauuuugaauuuagugacagacuaaaauuaauuucgccugcuuauuuuuuuauguggcuacuugaaaacuuuaaauuagaucuaacgguccuauuauaccucuacuggauaauucugcuuuaaagucaguccugggcaugcaugacgcccagaggaauucacagauaaaaugagcccaggaaucuguauggaauacagaccuguagguuaccauuuccauauuaaauguguaaagggcuguuuuaaaaccaugcuuuuguuuucuuauuuugugcaccaacaauaaaucaacagcaaauaucauugggucuaaaaauaauugauaucuggcugggcgcgguggcucaugccuguaaucccagcacuuugggaggccgagacggguggaucaugaggucaggagaucaagaccauccuggcuaacauggugaaacccugucucuaccaaaaauacaaaaaaacguagcugggagugguggcggaagccuguagucccagcuacucgggaggcugagggaggagaauggcgugaacccaggagggaggcagagcuugcagugagccgagaccgugccacugcacuccagccuggacaacagagcgagacuucgucucaaaaaaaaaaaaaaaaaaaaagauaccacuucauuuaugcuaugccugaauccuaauuaucaacuguaggccuuaacaauaauccuaaguggaugugccuuuaugcaggcacuuguggccuuuuuguuuucuuugaauuaaauauacaaaguaauaauuuaucuuacuucauaaaaagauuauaaucucccauuuuuuaaaacacauuugauauuaguaggaauaacuaaaaugaacucguaugaauagaccauuuuuauuucauugauaucuaacuaggaacguugcaacuaauuuuugcaaucuguaucaauuuguuuaauauauuuuaaaugaacaaagaagcagagauaguuucuagagagcuuauuuacuuaaaaauacaacagauauuaaucaauaaaauauuaauaagauucaggugagucgagagugaguacucaaguucucuuuucucacaacguauucuuggagugccaaccuuuucaguucaaugauuuuaugcaaagguauacaucuaacugccugcaaaauaaacuacugacuauuuuaaaucagauaaagcaaacaacagcccccagcucugcaauccaaagccagcaaaggucacccauuucagacuggguuugaagcauagccaguuaugauagcucaaauauuuucagauguaugaaagcagaacagaauucagaaauauacauucuuuggcagacaauuuuuuuagaaccaaguuucucaaauuauauaauacaaacuauaugacuauuagaaaauuaugcaugaauuaaaggagauuuauuuaauuuucaaauucuaauauaauuaaaauuuucaaacuuaacuauaugggcuucacgggugaaaaaaaguauaauuuaaaaauaugagcaauauaauaugacagaaauauacauucaaacacucuuucuaauuuuucauaaauuaacaacuauuugagacaugcacaaauuuucauguguuuuucugaaggugguauccagaagugauaauuuuccugacaguuuaacauuuuuuaaagacaugccaagauuuaaauaauguagcuuuuugauuacucuuuuuuuuugagacagagucuggcucuguugcccaggcuggaaugcagugguaugaucucggcucacugcaaccuccgccuccuggguucaagggauucuccugucucagccucccgaguaacugagacuacaggcaugcaccaccacgcucggcugauuuuuguauuuuuuguagagacgggguuucaccauguuggccaggcuggccuugaacuccugaccucaagugauccacccaccucagucucccgaagugcugggauuacaggugugagccaccgugcccggccuuuuugauuacucuuaaaacugcgggaucaaaaugaaauguuagaaaguaaaaccaacagcagaaaguaaaaccaagagcagcuucugaggaaucauauuuuagacauuucuuucagacagauucuguaaugugucaaacuauuggaacauauuucaacuaaauauuuaagugaagacaaaaucccuacuacaaaaccuccaaauacucuaacaaugaugauucuaucaggccuacucagaacuacagguuuuccccacaucuugauuucaaagcauacuuucugugacguaucuucauuuaaucacuuuuagaauaauugaacaagaaaauagguaaggaauuaaaauaaauuuuaaaauggcagucccauucuuacugacauaaauuuauuaagaucaauguuccuuuuugcauagaucuucccauucuguuucaauaacaccagcaagcauaaacagauuugaaaagcuacgcagccacagaaaacagguucagcaugacagacagaucuagcucaaaagaggugcucagugucaagcucuuuucuaaaaaccucaaagcuuguuuugucugcuguugcuuucaaagaacaagcacaacaaaauuguuuugaggaagucucuagaucaaacgaaagacaguuaaccaacagggagaguaaacugacugccacugcuguccacacagggccacagaaaucauugcuuuguuccaucacucuagcuggaaggccuucccaggaaugcaagucugaaccaucuagaguucucucagccagaaugaaggcucagcucuuggauguuucuaccauaaaaaugagaaagcauuuccuaccuccuccucugucacuccacaaagaugugcuuccuguguggcuggcuagcagauaagagaagguaagcaaaucccaaaagccuacucuaaucgcucacggagaaucuuagcuuugguucagaacguuaagucuacccauuuuccucuaucccuuuaugguacuguauuucuucuacaucccagaaugccaguugccacucaauauccuaccucuccuuuacccuuaagaagagagccggaaauguaauuucugauagcaaugcucccagcuaauagagcacauuuacaugcucccuugcaucgaggugucacuaucuggcccaugagauuaagcagaccuugaaaaggacuucuacaaaagcuccuaaaccuaacugaaccaugaauaucaaugccucguccccauuuuaggaacauuuaaaaguacuccauuucuaagaaaaugaaguucaaacucauuaagggcauccaaaauuuauaauuucacacugucuccuucacuuauuauaccccugggcuucccccuuugaaacucuacacccucgcuguuuuuucugucugggaagcccuccccaccccaguucaccuucacacauccuugaaaccuaguucaaauucugccugccuucucugggaagaguuuguaccuccucuauuauagccuuuggcacacuguaccuaauuauuucuccgucucuuucuuccuccacuggacugcggaauuccucaaggcacagacugaguuaccuuucuauuuacucacagccccacccagauucuagaucuccugucauaacugaaacacagaauccaugcaguauguccauaaaaugaauaauaauuucacaaauucaaaaugagagaaacaauaagauaguaaauuuuuuuuuuuuuugagacggagucucgcucuguugccuaggcuggagugcaguggcacgauggcucacugcaagcucugccucccagguucacaccauucuccugccucagccucccgaguagcugggacuacaggugccugucaccacgcccgguuaauuuguuguauuuuuaguggagacaggguuucaccauguuagccaggauggacuggaucuccugaccucgugauccacccgccuuggccucccaaagugcugggauuacagguguaagccaccgcaccaggccauaaauuaguaauuuuuuaaacaucuaacuccaaauaaaugucaacaucacagaagucaaucacaaaugcccugagaaaacuugcaguagagacauaaaaggggaaugcacaauccaaauauucagcuaaacauucugcauuaaaccuucccccucaucugcacacagaagaaucacgggcuuaggcuuggcuuuguguucaaccucugauagaaaugagcaaacgagcaaugaagucaacaugucagauugcuuuguaaaucuaaauaacuucgcaugugauaauaaauucuaagaaugcauccaaugucuuuuucucugcaacaacaagacacuaauauuuuuuucucaucucaucggcuauuuauuaaaucaauaaauacaauuaaaaacacaugcgcauaagaaauacucucaauaaacugaagggaugcuucccaucugugucccuacaauaugacccagaaaauucacaaugauauaaauuuaaccuuugagucuagcucacaaaagugaagugaaauauccaaauagcaaauacgaagaaaggaacuaccaagaaacaaggaaagucagccuccaauuuuguucauuuaaguauacccucucugccaccacaacauucauuauguuuguccuggacagcucuaauggccaugcugauugauacucaguguuaaggccaccucuguccaacagacagagguggcuucuacucuguuucagccaaauacucacauggcuacucuaucaucaccuggaaaucucccagcuucccucaggaauuccccccucuccuauuucacugaacaagcaggaauaagugauuccaaaauugcaauuuugucucaaauguacucuuaaaagugaaacccuccacaauucaacuagcagcaguucuguaagcugccuuuacauucaaacacccuauggguuagccaagaacgccccuccacaacaaccauagaauuuuuauauucguuuuacuucuguugcauuuaaauuuucuggauucugugguauaagaggauuuaacacuugacacaaaacauucaaaauaagauugagaaaauacuagcaagauacaaggcuaaucauaaugaccucaauuagauuuucaauuccugucaaguuaaugguauauaguaguauuggcuucaagcucuucaaauugaaaaauacaauucuuuuagauaacagagguaauagaauucaauauauuuuuuuaaagggccaauuuugauccuugucacacuaaacacuagcuguaaaauggccaaaaaaggagccaaaaaaaaagacaaugacagagaaauuuucauuuucaugccacuaaauuuaauuccaauacacauuuucuuuccaaacucuacuaacuucuucacacaaaauuaugucuaggcacccucuauugaaagugucccaaucaaucagggcauggaugaaauauuucaaaaaugaggcauuuuuucuuuuugcaggccaacugaauuuuugaaauacaauugcaaaugacugaacgugauguauugacaguauuuaugaaaccuuuucacaauaaaauguuccaaaaagaggcugaaaaaaaagaaucuuauuuaaaaggcuuuaaucuucuuucuaugcuuguucgcaguuucuuaaauguugagaagguugcacagcuguucgaaucuucaaucugaacguaauucuuuaucaccacaacauagaauuucuagagaacucauuuauuuaguacauacaaaauguaaggcauuaucaugagugaucaaacaaauuacuguauagaaaagugugugaucacaaucaacacuaacuucucucucccaccacuuguuuucaacauuuaaucacccaaaguagaucuucugucuacaauuauucuuuuacaauguaguaaauauauaguuccuucccccaguuaucuaaguuuaccuucacauacugaaaugaucagagaacuuugacaauacuacagaaacuauugcauucacaacacacauccuucuacguagcauucucuuauauuccuuacccaacuuaauuuuuuccaagucacuuccuuccuccuuuuuauucugucuacccucuugggggcaaggaccucgaaaauauuugugaaaugaaggaguggcccuuucuugguuguaccccuaagaaucuagguuucuuuguguaugaaaauaagcuaauuuccacagaaauuuggcuuuaauuuuaaauugcuaaucaauuuaauauguaaguaucuaugauuaauuauucuuagaauaauuagucugcauauuuucacauuucuaugggaguuucuuagguacucuucaguuauauccucaaacuaauuuacuguaaugacaaaauuauauuuguguuaaaccauaauaagcaauugagagcaucaggauggagaauauuugcuacuacauaucacuuuucauaugauggguuuuaauguuagucucugaagacuuaagcuaagacuucaaaaacuuugcaucgguuuuaaaggcuuaaucuuugaaguagaugaggauuuuuuuuuugaaagauaaaaaaaucaauaaauacaguuaagaaacagugcuuauccaucuuuauucuaugagccuaucaauucaauuauaaacaaaauaacugaguaaugauauuuauaaaaacaacauuggccaggcacaauagcucacaccuguaaucuagcacuuuggaaggucgaggcaggaggaucgcuugagcccaggaguucaagaucagccugggcaacauaguggggaccccaucucuacaaaacauuuaagaaauuagucagaugugguggcacaugccuguagucccagcuacucuggaggcuggggcaggaagauggcuucagcccaggaggccacggcuacagaucacaccacugcacuucagccugggugacagagugaggacuugucccgaaaacaaacaaaaccaaacacaguaucaauaugcuuuugaaaauucauccaauaguaggaguagauauaacaaguccuuuuuuaagaugaauaaaccuuuaauggauaaagccauuuucuuuacuuucucuuaaaaauaaaauuuauguugccucacuaauuuuacugugaaauaacgagcacacagacaaggaaaaacuaaacaaaugaguuuguaguaacuugggaugaggggcaggucuaaaacacguuaagucuaucucaacaguaggauuaaaccucucauuuuucuuccuguaaaauaucuccagggggucaaaauauauuaguuauucaauguuugaaauuuagcaaagcagcaagaguaauaaugcauuucuucacuuaacacaaaugacuuuucuuuaugcaacagaucucuuauucucauaaguaucuuuuauggcugaaaaguaauuuaucagucuguaucaucuaggaugccuuacauuuuucaaugaagacaguauguggcuuucuggaagcuaaugaaagccaaauuauuaaauaagagacaaauuauuagauucucucaaaaaaagcaucaggcaaaaaaaaaaauuccuaucaaaaucaccaaaaaauuggccaggugcaguggcucacaccuguuaucccagcacuuugggaggccuagguggguggaucacuugaagucaggaguucgagaccacccuggccaauguagugaaacccugucucuacuaaaaaaaaaaaaaacaaaaacaaaaauuagccaggcgugguggcacaugccuguaaacccagcuauucaggaggcugaggcaugagaauugcuugaacccgggaggcagagguugcaguaagccaagacacgccacugcacuccagccugggugacacaguaaaacucagucucaaaaaaaaaaaaaaaaaaaaaaaaaaaaaucaccaaaaaacaaaagaagugacaauuauucuuguugaaucaaauuucucauaagaaaaccuucugacuuugugaagaaaaaaaggaaccaucuggaaauuaagagauucaaacacuguuugggguccaucauuaauaagaccuuaaggaaucacugcacuucauucaucaggauccauuaauuuacaaaacaggcuuauucaucuuuucccuuuuccaaaauguuuguccuauuuauuccucaucccugcucaugaacccuccacuccugcuucuggaaccaucuuaaucacuccucacuguaucuacuguaaucaggauguuuaucacaaauauggcuucugucauuacacauccucguaugugaacccacuucuugucuucuugucuuuaguuggacaggacaauuauaauuacaugagcugguuaacaaaaacccaugugaauucuuugggacucugcuucuugauuuuucccugcguucaucaucauuuaaccacaguaucaccaguuucauacacucaaggcuuucaaauauccuuggccugcuuuugaagcuaaaaaccuuuuauuuuugagcaacauaugcugauuuuuaaaaaaaauauauaauuucaauuaaacagcagaucacuauaaaguuuuaaagauguaacagccauaacauggcugguuacacaaauucacuuuacugcagcugggcgcgguggcucacgccuguaaucgcagcacuuugggaggccgaggcaggcggaucacgaggucaagaguuugagaccagccugaccaacauagugaaaccccgucucuacuaaaaauauaaaaauuagcugggcauaguggcacacgccuguaaucccagcuacucgggaggcugaggcaggagaaucgcuugaaccugagaggcggagauugcagugagcugagaucgcaccacugcauuccagcuugggcgacagggcgagacuccgucucaaaaacaaaacaaaacaaaaaauucauuuuauuuugaaacugauuuccuagagaaaugccgcauucucaagcaaucugcuuuuugguuucccuguccuugggugaacauaacuucaagcuuccauauuaggaccaaaauucuuuugcuggcauuugaaaucuuccauuucuacccagauuggcaaagccuguuuauucguuuugcuagcaaagauucuacugaaaacuaaaccaagucuguucacaguuccuugcacauagcugauagccaacuaauaguuaauaaucaagccaguguauaaacuugcucaauauuagacaucuguggcaagcugccaguguguacaacauuaaaaaauaggucucugggaggccgaggugggcagaucacuugaggucaggaguuugagaccagccuggccaacauggugaaaccccaucucuacuuaaaaaauacaaaaauuagcugggcaugguggcgagugcccauagucccagcuacucaggaggcugaggcaggagaaucgcuugaacccaggaggcggagguugcagugagccgagaucgcgccacugcacuccagccugggugacagagggagauucugucucaaaaaaaaaaaaaaaaggucuacauccauguuauguggaaaaaaagaaaaaaaaaaacuagguauuucccauuuguguaaaaaaugcuuaugcuuuuugcacauuucuguacuguuuuaaauuuuucaaugagcaugaauuauuuucauuuuucaaaaaaccaauugaaauacacaauacauauuuaauaaaugaaauuuuauaacauguauucuaaaaauuguaucugagauaccaugugcuuuuuaaauuuagaucaaacucauagacaacaaucugucaauuuccugcaauagucuuaauuggccaauaaguaauuugucaauaagugaaacaucaucuagauuuuuaacuuucaacuaugcaggaaacuuacauauacccauuguacaucaacaucaucaccauacauagcagcaacuaacacacagugcuuaugcuaugccaucagguuacauauauauuaacucacacacuguuucaagcauuuaacaaagauauuaauucgauccucaauaacuagaaguacucaucccauuuuacaaaggaaaaaacugaggcacagaaacuugcccauggucacuagcucaaaagaaacaaagacagaauuuaugcccaugcauuccugcccuggucuaaacucuccugauuagugugcaaugcugccuucucuacauaccugagaaacacucaaugacucaguguuauuggccuaacaucacgccuggcaucaaauucaacauuauaaauugagaacaacucugguucguucuacagaggugacauuuuuaaaaaccucucaucuuccccauuuuaacuaucuucuuucguaagauacugugagucucgcaagguucaagcuaaaucucuauugcauguuucuucaacauguagccacacaaaauaaaccuaaauaaaaugaucucuuagguuucuauuucagcagauuuaauacaugugaaccugagacuucuguggcccucucugaauacucagcuagcuaaucuacuaagcaucccuguuucauaaagcuauuaauugaugcacauauccaggcuuuuaaauuuaaauaugugaauuuauuccuagagcaaucauuguacuccaguuuuugccagauuucuacuucugaagagguaccacucaagcauaauaauaaucuauaaccaagauuaaucuaaagaggaaaauuugccaaacuuuuuuuuccaagaaaaauacuaguguccucacaguaaugauuauuucuuaagccauccacacuaaacugaaaaaauaguuacauaacauuucccccuuuacuaagcuuuucacuugcaaaaucagcuucaggguuugaguucugucugcuuuucuucuuauacaacaauaaaaaaagaaauacauauuuuauugauuaaacuugcuacucauucuggggugugcucauuccuuccccugccaccuucugucuucuguguacagaugaggguguuaucuguacacuggcugugagacccacagggugacagcguuuccaaggguuugcaaaagacggcauuucccauccauccccacuccauacauuugcaucugagcucucacuaugaaaaggaaaagauuuuuuuauuucuguuuucuucagcccuuuucugucuacaaagccaaucuccucuguucaacucaucggaacauuuauacuauuuuacagaauaguguugccugaauguagaaucacaacaaagccaguugagaucuuuaaauuaaaaaaagaaaaaaaaaagauuucauaaucaagcauagucaagugaaacagagagagguugaaaaccaccagacaaaaacaaaacacaaacagaaaaugugauuuuucccuauccuccucguugccacuguucaucucauacucugcccaucaagaugcuacugaagcucucugguccugcauucagccccuuaccuuugaccucucaacuccuuauuucaaauucccuacuccuguugagaauacccugcaccagcaucugucacucaagugagagagagagagagagagagagagagagagagaaagagagagaaagagacagagggugugugugugugugugugugugugucugucugucugucugguagaggcagagaggaauguaaacaaauauuguauaugcagaaacuuaaccuccaauccccagaccugggauauaaaccuggcuggaaauuuacuaccaggaaaugcuccaggauuaucuaugaucucaucccauuguuccuuacuuuuuaaauacaggaaguuuucucuguaacauauuuacucaguauaccuaaucuguauuuuccuuuugguauuuuaguacauuccacuuuguuuuauuaucaugugcauguuuuauuuacccugcaaacuuccugggaguaaggggagggaggagggaaggggagguaaugagguaugcagucgaacuaaaccuuacauucuggaagcuuuaaauuuaaaaugcaucuguacagguuuaucuuuacauuuguaauugauagagauuuuaaaagaaauguauuaaugaaagaugcuuuguaagauucucaagguaauacaauuugcagaaacaauguacauuucuacugaauuuaaugcacuucucacugauaguuuaguggccacgugaaaugcaaguaauagcuaugcuuauuuccagaaugacugacaacauucauacaaauaucuguagaagacucuaguaugcaaaaaacaguaacauaaaauagagauccucuagcaacaagacuuaacauaaagacaaccucucccauuccuucaaaccaauauuguugaucacguuauuucuuuuuaauuuuuuugaaucagccauuccucauuuaaccucgugaacuugcauguuccuuuucauuuccucagucaggaccaguauuauuccaucuaguaacuucuccgcaguacuaauagccuugcaaaugucguucaggagccucugcugguuccggugacaagagaaaagcuucugcagucugccaguuaucaugguuucucaucgauuagcaagaaccgugacuccuuacagaucaccaucaaaccugagcuuuacuauucugugugucggcuucuaccuuuagcgagguacuagucaguagcagcagguuuccauaaacuauaaauuagcacuaccacaaagguaagaugauugugacuagguuaaacccucaacagagggaaauaaaacuuaagaggaagcuagauuuaaaaauaaauaaauaaauaaauauuaggguagugaaacaucauauagauuaggguuuguuaaacucacaccucuaucaacauaccagccaaaaucaucaacccagauaauaaccauguuucccccgauagccaaggccccauuaucauugcccuuauucauuucuuuucuacagccaccugcagcagaccuauuuucuaagcucuauaaaagacagucaacucguaauuacaucuuuucaguggacacagagagaaccagauaaaccacccucaaaccucaguagacugaauuaccuacccuucuaccaacacuucgcaaaauggcauaaugugaaucucaccuccacccuuuaaaggaguuaacaauagcuacugaaaaggucccaaaagauggcagaaagagcauauuaaugcaauuaaacagaccaaaaacuaaauucgaaucugccuacaugcuuccucuuuuuauacagaaagaaauauugcucaacaaaguuacauauuuaaguuuugacaaaagcuucaaaaauacgguuaucauaugcuuuuaauuccuuaaauguaugguuuuuaaucuguaguaagaccauucgggaaaacuggaauaauucuacaaauaaauguaaguaagucaugagagaaaucagaauucucuuaguuaagugcauuuuuuuaaaacauggaaaacgaaauucuuuaacucuuaaaacaaccugucuuaacuagcccuaaggugauuccugagccacuuguggguaaaaaucagaagagaaaaaaguucaaugaccuugcaaauuagaaacuaaaaaacuaauggugugauagucuguacagccucaguggaauuacaggaaaacaucugcccggaaauugcuuuuuuucuuuuggaaaauuacuaggaggcugggggaaaagaggggaaaaacggguaaggaagguugcaaauguuaagaugccaaacaggaacccaaccgaaguccgaagugaaauacagccuccucuggcccaacugucaugcaaacaacuucuaagcaucuucagauguaaagaaaaacagucauugugcacaggcguuagcugaauguucgagaguuggaugaauggggaagacuuguuauacaccuagugguggguggauuucacuaggcugcagccuccacacagcuuuucuuugcugcacugcagaggcgccaucuucuccgucuuaaucuucacucaauucgauccuuuuaucugcacccuaaaaaaaagacccuucggacccuccccagcauccugugcccccaggggaacuaaaccagaguccccagagcugccagggaagaggccgcgccuuaaucagacaaacgccuccuuggaugcacaggacagagcccgugccuccccaccauccgccacugcccuuuccagacgcacaucccacucuccgccuuauuuccuccccgccaaggacuuuacagcccagcacagaauuaagccucggaggugauccgagggugggaagcagaggggccccgaggcuccgccagaagccccggcagcgucucugcccccucccaggcggacgcgcagccccgggaagggagccgggcgggagccucgguggcgcacugagacuaacgcggcucggcccacggcgagggcggggugucgcggcuuuuguucccgcggaccuucugccucucagacagagcuuagggugcgagcgaacucccgggacguccagacuuggggaaggcgcgggguggcuaugggucuccgaccccucccauuucucgcaaguuacacaaaagggagacgcggacaugcacaaaguuugccuguggaaggcggugcgcgaccccgacgccggcucgggcuagggucgcacccaggcugccgccgccagcagccgcgaaaagagguuggagcaaggaagggggaugggggugagagaggaaggugaaacgaggcggagaacgcagggaaaagcgaggggcuccuagcuuccugggcugucccgacuccuccuccuccuccccagggcccaagagaaaggaaagggcaacgauucaagagcgaaggacuggcuuuagggacgcugcguuuucgguuuuccccacgugcuccuucccccuuccccccugucugaaugucucucgccucccccgacccccgcuuccaaggcagggacuaagucggggucugggcucagggucgcccccuacccuucucgccccgggcuggcgcggaaccagggagaccagcgccucgcccgcucccucucagcgggccggagcgcgacucccuggggcagggcugggccgaaagcggggaugcgcuggacguccgcaagcgggggcggagaggagaggggucccauugacggacccccggcuucucugcauuaaagacuuggguuaaggucuugggggguaucgcguccccaccgugcagccuccccccgccuuccgaggcgcggcacccaccuccagcgcccgagccguccaggcggccagcaggagcagugccaaaccgggcagcaucgcgacccugcgcggggcaccgagugcgcugcugugcgagugggauccgccgcguccuugcucugcccgcgccgccaccgccgccgucucccggggcccccgcgcacgcuccuccgcgugcucucgccuaccgcugccgaggaaac

SEQ ID NO: 21545 - RNA, 289974 nt, Homo sapiens
guuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggugggugccgcgccucggaaggcggggggaggcugcacgguggggacgcgauaccccccaagaccuuaacccaagucuuuaaugcagagaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccucugcuucccacccucggaucaccuccgaggcuuaauucugugcugggcuguaaaguccuuggcggggaggaaauaaggcggagagugggaugugcgucuggaaagggcaguggcggaugguggggaggcacgggcucuguccugugcauccaaggaggcguuugucugauuaaggcgcggccucuucccuggcagcucuggggacucugguuuaguuccccugggggcacaggaugcuggggaggguccgaagggucuuuuuuuuagggugcagauaaaaggaucgaauugagugaagauuaagacggagaagauggcgccucugcagugcagcaaagaaaagcuguguggaggcugcagccuagugaaauccacccaccacuagguguauaacaagucuuccccauucauccaacucucgaacauucagcuaacgccugugcacaaugacuguuuuucuuuacaucugaagaugcuuagaaguuguuugcaugacaguugggccagaggaggcuguauuucacuucggacuucgguuggguuccuguuuggcaucuuaacauuugcaaccuuccuuacccguuuuuccccucuuuucccccagccuccuaguaauuuuccaaaagaaaaaaagcaauuuccgggcagauguuuuccuguaauuccacugaggcuguacagacuaucacaccauuaguuuuuuaguuucuaauuugcaaggucauugaacuuuuuucucuucugauuuuuacccacaaguggcucaggaaucaccuuagggcuaguuaagacagguuguuuuaagaguuaaagaauuucguuuuccauguuuuaaaaaaaugcacuuaacuaagagaauucugauuucucucaugacuuacuuacauuuauuuguagaauuauuccaguuuucccgaauggucuuacuacagauuaaaaaccauacauuuaaggaauuaaaagcauaugauaaccguauuuuugaagcuuuugucaaaacuuaaauauguaacuuuguugagcaauauuucuuucuguauaaaaagaggaagcauguaggcagauucgaauuuaguuuuuggucuguuuaauugcauuaauaugcucuuucugccaucuuuugggaccuuuucaguagcuauuguuaacuccuuuaaaggguggaggugagauucacauuaugccauuuugcgaaguguugguagaaggguagguaauucagucuacugagguuugagggugguuuaucugguucucucuguguccacugaaaagauguaauuacgaguugacugucuuuuauagagcuuagaaaauaggucugcugcagguggcuguagaaaagaaaugaauaagggcaaugauaauggggccuuggcuaucgggggaaacaugguuauuaucuggguugaugauuuuggcugguauguugauagaggugugaguuuaacaaacccuaaucuauaugauguuucacuacccuaauauuuauuuauuuauuuauuuuuaaaucuagcuuccucuuaaguuuuauuucccucuguugaggguuuaaccuagucacaaucaucuuaccuuugugguagugcuaauuuauaguuuauggaaaccugcugcuacugacuaguaccucgcuaaagguagaagccgacacacagaauaguaaagcucagguuugauggugaucuguaaggagucacgguucuugcuaaucgaugagaaaccaugauaacuggcagacugcagaagcuuuucucuugucaccggaaccagcagaggcuccugaacgacauuugcaaggcuauuaguacugcggagaaguuacuagauggaauaauacugguccugacugaggaaaugaaaaggaacaugcaaguucacgagguuaaaugaggaauggcugauucaaaaaaauuaaaaagaaauaacgugaucaacaauauugguuugaaggaaugggagagguugucuuuauguuaagucuuguugcuagaggaucucuauuuuauguuacuguuuuuugcauacuagagucuucuacagauauuuguaugaauguugucagucauucuggaaauaagcauagcuauuacuugcauuucacguggccacuaaacuaucagugagaagugcauuaaauucaguagaaauguacauuguuucugcaaauuguauuaccuugagaaucuuacaaagcaucuuucauuaauacauuucuuuuaaaaucucuaucaauuacaaauguaaagauaaaccuguacagaugcauuuuaaauuuaaagcuuccagaauguaagguuuaguucgacugcauaccucauuaccuccccuucccuccucccuccccuuacucccaggaaguuugcaggguaaauaaaacaugcacaugauaauaaaacaaaguggaauguacuaaaauaccaaaaggaaaauacagauuagguauacugaguaaauauguuacagagaaaacuuccuguauuuaaaaaguaaggaacaaugggaugagaucauagauaauccuggagcauuuccugguaguaaauuuccagccagguuuauaucccaggucuggggauuggagguuaaguuucugcauauacaauauuuguuuacauuccucucugccucuaccagacagacagacagacacacacacacacacacacacacacccucugucucuuucucucucuuucucucucucucucucucucucucucucucucucacuugagugacagaugcuggugcaggguauucucaacaggaguagggaauuugaaauaaggaguugagaggucaaagguaaggggcugaaugcaggaccagagagcuucaguagcaucuugaugggcagaguaugagaugaacaguggcaacgaggaggauagggaaaaaucacauuuucuguuuguguuuuguuuuugucuggugguuuucaaccucucucuguuucacuugacuaugcuugauuaugaaaucuuuuuuuuuucuuuuuuuaauuuaaagaucucaacuggcuuuguugugauucuacauucaggcaacacuauucuguaaaauaguauaaauguuccgaugaguugaacagaggagauuggcuuuguagacagaaaagggcugaagaaaacagaaauaaaaaaaucuuuuccuuuucauagugagagcucagaugcaaauguauggaguggggauggaugggaaaugccgucuuuugcaaacccuuggaaacgcugucacccugugggucucacagccaguguacagauaacacccucaucuguacacagaagacagaagguggcaggggaaggaaugagcacaccccagaaugaguagcaaguuuaaucaauaaaauauguauuucuuuuuuuauuguuguauaagaagaaaagcagacagaacucaaacccugaagcugauuuugcaagugaaaagcuuaguaaagggggaaauguuauguaacuauuuuuucaguuuaguguggauggcuuaagaaauaaucauuacugugaggacacuaguauuuuucuuggaaaaaaaaguuuggcaaauuuuccucuuuagauuaaucuugguuauagauuauuauuaugcuugagugguaccucuucagaaguagaaaucuggcaaaaacuggaguacaaugauugcucuaggaauaaauucacauauuuaaauuuaaaagccuggauaugugcaucaauuaauagcuuuaugaaacagggaugcuuaguagauuagcuagcugaguauucagagagggccacagaagucucagguucacauguauuaaaucugcugaaauagaaaccuaagagaucauuuuauuuagguuuauuuuguguggcuacauguugaagaaacaugcaauagagauuuagcuugaaccuugcgagacucacaguaucuuacgaaagaagauaguuaaaauggggaagaugagagguuuuuaaaaaugucaccucuguagaacgaaccagaguuguucucaauuuauaauguugaauuugaugccaggcgugauguuaggccaauaacacugagucauugaguguuucucagguauguagagaaggcagcauugcacacuaaucaggagaguuuagaccagggcaggaaugcaugggcauaaauucugucuuuguuucuuuugagcuagugaccaugggcaaguuucugugccucaguuuuuuccuuuguaaaaugggaugaguacuucuaguuauugaggaucgaauuaauaucuuuguuaaaugcuugaaacagugugugaguuaauauauauguaaccugauggcauagcauaagcacuguguguuaguugcugcuauguauggugaugauguugauguacaauggguauauguaaguuuccugcauaguugaaaguuaaaaaucuagaugauguuucacuuauugacaaauuacuuauuggccaauuaagacuauugcaggaaauugacagauuguugucuaugaguuugaucuaaauuuaaaaagcacaugguaucucagauacaauuuuuagaauacauguuauaaaauuucauuuauuaaauauguauuguguauuucaauugguuuuuugaaaaaugaaaauaauucaugcucauugaaaaauuuaaaacaguacagaaaugugcaaaaagcauaagcauuuuuuacacaaaugggaaauaccuaguuuuuuuuuuucuuuuuuuccacauaacauggauguagaccuuuuuuuuuuuuuuuugagacagaaucucccucugucacccaggcuggagugcaguggcgcgaucucggcucacugcaaccuccgccuccuggguucaagcgauucuccugccucagccuccugaguagcugggacuaugggcacucgccaccaugcccagcuaauuuuuguauuuuuuaaguagagaugggguuucaccauguuggccaggcuggucucaaacuccugaccucaagugaucugcccaccucggccucccagagaccuauuuuuuaauguuguacacacuggcagcuugccacagaugucuaauauugagcaaguuuauacacuggcuugauuauuaacuauuaguuggcuaucagcuaugugcaaggaacugugaacagacuugguuuaguuuucaguagaaucuuugcuagcaaaacgaauaaacaggcuuugccaaucuggguagaaauggaagauuucaaaugccagcaaaagaauuuugguccuaauauggaagcuugaaguuauguucacccaaggacagggaaaccaaaaagcagauugcuugagaaugcggcauuucucuaggaaaucaguuucaaaauaaaaugaauuuuuuguuuuguuuuguuuuugagacggagucucgcccugucgcccaagcuggaaugcaguggugcgaucucagcucacugcaaucuccgccucucagguucaagcgauucuccugccucagccucccgaguagcugggauuacaggcgugugccacuaugcccagcuaauuuuuauauuuuuaguagagacgggguuucacuauguuggucaggcuggucucaaacucuugaccucgugauccgccugccucggccucccaaagugcugcgauuacaggcgugagccaccgcgcccagcugcaguaaagugaauuuguguaaccagccauguuauggcuguuacaucuuuaaaacuuuauagugaucugcuguuuaauugaaauuauauauuuuuuuuaaaaaucagcauauguugcucaaaaauaaaagguuuuuagcuucaaaagcaggccaaggauauuugaaagccuugaguguaugaaacuggugauacugugguuaaaugaugaugaacgcagggaaaaaucaagaagcagagucccaaagaauucacauggguuuuuguuaaccagcucauguaauuauaauuguccuguccaacuaaagacaagaagacaagaaguggguucacauacgaggauguguaaugacagaagccauauuugugauaaacauccugauuacaguagauacagugaggagugauuaagaugguuccagaagcaggaguggaggguucaugagcagggaugaggaauaaauaggacaaacauuuuggaaaagggaaaagaugaauaagccuguuuuguaaauuaauggauccugaugaaugaagugcagugauuccuuaaggucuuauuaaugauggaccccaaacaguguuugaaucucuuaauuuccagaugguuccuuuuuuucuucacaaagucagaagguuuucuuaugagaaauuugauucaacaagaauaauugucacuucuuuuguuuuuuggugauuuuuuuuuuuuuuuuuuuuuuuuuuuuugagacugaguuuuacugugucacccaggcuggagugcaguggcgugucuuggcuuacugcaaccucugccucccggguucaagcaauucucaugccucagccuccugaauagcuggguuuacaggcaugugccaccacgccuggcuaauuuuuguuuuuguuuuuuuuuuuuuuaguagagacaggguuucacuacauuggccaggguggucucgaacuccugacuucaagugauccacccaccuaggccucccaaagugcugggauaacaggugugagccacugcaccuggccaauuuuuuggugauuuugauaggaauuuuuuuuuuugccugaugcuuuuuuugagagaaucuaauaauuugucucuuauuuaauaauuuggcuuucauuagcuuccagaaagccacauacugucuucauugaaaaauguaaggcauccuagaugauacagacugauaaauuacuuuucagccauaaaagauacuuaugagaauaagagaucuguugcauaaagaaaagucauuuguguuaagugaagaaaugcauuauuacucuugcugcuuugcuaaauuucaaacauugaauaacuaauauauuuugacccccuggagauauuuuacaggaagaaaaaugagagguuuaauccuacuguugagauagacuuaacguguuuuagaccugccccucaucccaaguuacuacaaacucauuuguuuaguuuuuccuugucugugugcucguuauuucacaguaaaauuagugaggcaacauaaauuuuauuuuuaagagaaaguaaagaaaauggcuuuauccauuaaagguuuauucaucuuaaaaaaggacuuguuauaucuacuccuacuauuggaugaauuuucaaaagcauauugauacuguguuugguuuuguuuguuuucgggacaaguccucacucugucacccaggcugaagugcaguggugugaucuguagccguggccuccugggcugaagccaucuuccugccccagccuccagaguagcugggacuacaggcaugugccaccacaucugacuaauuucuuaaauguuuuguagagaugggguccccacuauguugcccaggcugaucuugaacuccugggcucaagcgauccuccugccucgaccuuccaaagugcuagauuacaggugugagcuauugugccuggccaauguuguuuuuauaaauaucauuacucaguuauuuuguuuauaauugaauugauaggcucauagaauaaagauggauaagcacuguuucuuaacuguauuuauugauuuuuuuaucuuucaaaaaaaaaauccucaucuacuucaaagauuaagccuuuaaaaccgaugcaaaguuuuugaagucuuagcuuaagucuucagagacuaacauuaaaacccaucauaugaaaagugauauguaguagcaaauauucuccauccugaugcucucaauugcuuauuaugguuuaacacaaauauaauuuugucauuacaguaaauuaguuugaggauauaacugaagaguaccuaagaaacucccauagaaaugugaaaauaugcagacuaauuauucuaagaauaauuaaucauagauacuuacauauuaaauugauuagcaauuuaaaauuaaagccaaauuucuguggaaauuagcuuauuuucauacacaaagaaaccuagauucuuagggguacaaccaagaaagggccacuccuucauuucacaaauauuuucgagguccuugcccccaagaggguagacagaauaaaaaggaggaaggaagugacuuggaaaaaauuaaguuggguaaggaauauaagagaaugcuacguagaaggauguguguugugaaugcaauaguuucuguaguauugucaaaguucucugaucauuucaguaugugaagguaaacuuagauaacugggggaaggaacuauauauuuacuacauuguaaaagaauaauuguagacagaagaucuacuuugggugauuaaauguugaaaacaaguggugggagagagaaguuaguguugauugugaucacacacuuuucuauacaguaauuuguuugaucacucaugauaaugccuuacauuuuguauguacuaaauaaaugaguucucuagaaauucuauguuguggugauaaagaauuacguucagauugaagauucgaacagcugugcaaccuucucaacauuuaagaaacugcgaacaagcauagaaagaagauuaaagccuuuuaaauaagauucuuuuuuuucagccucuuuuuggaacauuuuauugugaaaagguuucauaaauacugucaauacaucacguucagucauuugcaauuguauuucaaaaauucaguuggccugcaaaaagaaaaaaugccucauuuuugaaauauuucauccaugcccugauugauugggacacuuucaauagagggugccuagacauaauuuugugugaagaaguuaguagaguuuggaaagaaaauguguauuggaauuaaauuuaguggcaugaaaaugaaaauuucucugucauugucuuuuuuuuuggcuccuuuuuuggccauuuuacagcuaguguuuagugugacaaggaucaaaauuggcccuuuaaaaaaauauauugaauucuauuaccucuguuaucuaaaagaauuguauuuuucaauuugaagagcuugaagccaauacuacuauauaccauuaacuugacaggaauugaaaaucuaauugaggucauuaugauuagccuuguaucuugcuaguauuuucucaaucuuauuuugaauguuuugugucaaguguuaaauccucuuauaccacagaauccagaaaauuuaaaugcaacagaaguaaaacgaauauaaaaauucuaugguuguuguggaggggcguucuuggcuaacccauaggguguuugaauguaaaggcagcuuacagaacugcugcuaguugaauuguggaggguuucacuuuuaagaguacauuugagacaaaauugcaauuuuggaaucacuuauuccugcuuguucagugaaauaggagaggggggaauuccugagggaagcugggagauuuccaggugaugauagaguagccaugugaguauuuggcugaaacagaguagaagccaccucugucuguuggacagagguggccuuaacacugaguaucaaucagcauggccauuagagcuguccaggacaaacauaaugaauguugugguggcagagaggguauacuuaaaugaacaaaauuggaggcugacuuuccuuguuucuugguaguuccuuucuucguauuugcuauuuggauauuucacuucacuuuugugagcuagacucaaagguuaaauuuauaucauugugaauuuucugggucauauuguagggacacagaugggaagcaucccuucaguuuauugagaguauuucuuaugcgcauguguuuuuaauuguauuuauugauuuaauaaauagccgaugagaugagaaaaaaauauuagugucuuguuguugcagagaaaaagacauuggaugcauucuuagaauuuauuaucacaugcgaaguuauuuagauuuacaaagcaaucugacauguugacuucauugcucguuugcucauuucuaucagagguugaacacaaagccaagccuaagcccgugauucuucugugugcagaugagggggaagguuuaaugcagaauguuuagcugaauauuuggauugugcauuccccuuuuaugucucuacugcaaguuuucucagggcauuugugauugacuucugugauguugacauuuauuuggaguuagauguuuaaaaaauuacuaauuuauggccuggugcgguggcuuacaccuguaaucccagcacuuugggaggccaaggcggguggaucacgaggucaggagauccaguccauccuggcuaacauggugaaacccugucuccacuaaaaauacaacaaauuaaccgggcguggugacaggcaccuguagucccagcuacucgggaggcugaggcaggagaauggugugaaccugggaggcagagcuugcagugagccaucgugccacugcacuccagccuaggcaacagagcgagacuccgucucaaaaaaaaaaaaaauuuacuaucuuauuguuucucucauuuugaauuugugaaauuauuauucauuuuauggacauacugcauggauucuguguuucaguuaugacaggagaucuagaaucuggguggggcugugaguaaauagaaagguaacucagucugugccuugaggaauuccgcaguccaguggaggaagaaagagacggagaaauaauuagguacagugugccaaaggcuauaauagaggagguacaaacucuucccagagaaggcaggcagaauuugaacuagguuucaaggaugugugaaggugaacugggguggggagggcuucccagacagaaaaaacagcgaggguguagaguuucaaagggggaagcccagggguauaauaagugaaggagacagugugaaauuauaaauuuuggaugcccuuaaugaguuugaacuucauuuucuuagaaauggaguacuuuuaaauguuccuaaaauggggacgaggcauugauauucaugguucaguuagguuuaggagcuuuuguagaaguccuuuucaaggucugcuuaaucucaugggccagauagugacaccucgaugcaagggagcauguaaaugugcucuauuagcugggagcauugcuaucagaaauuacauuuccggcucucuucuuaaggguaaaggagagguaggauauugaguggcaacuggcauucugggauguagaagaaauacaguaccauaaagggauagaggaaaauggguagacuuaacguucugaaccaaagcuaagauucuccgugagcgauuagaguaggcuuuugggauuugcuuaccuucucuuaucugcuagccagccacacaggaagcacaucuuuguggagugacagaggaggagguaggaaaugcuuucucauuuuuaugguagaaacauccaagagcugagccuucauucuggcugagagaacucuagaugguucagacuugcauuccugggaaggccuuccagcuagagugauggaacaaagcaaugauuucuguggcccuguguggacagcaguggcagucaguuuacucucccuguugguuaacugucuuucguuugaucuagagacuuccucaaaacaauuuuguugugcuuguucuuugaaagcaacagcagacaaaacaagcuuugagguuuuuagaaaagagcuugacacugagcaccucuuuugagcuagaucugucugucaugcugaaccuguuuucuguggcugcguagcuuuucaaaucuguuuaugcuugcugguguuauugaaacagaaugggaagaucuaugcaaaaaggaacauugaucuuaauaaauuuaugucaguaagaaugggacugccauuuuaaaauuuauuuuaauuccuuaccuauuuucuuguucaauuauucuaaaagugauuaaaugaagauacgucacagaaaguaugcuuugaaaucaagauguggggaaaaccuguaguucugaguaggccugauagaaucaucauuguuagaguauuuggagguuuuguaguagggauuuugucuucacuuaaauauuuaguugaaauauguuccaauaguuugacacauuacagaaucugucugaaagaaaugucuaaaauaugauuccucagaagcugcucuugguuuuacuuucugcuguugguuuuacuuucuaacauuucauuuugaucccgcaguuuuaagaguaaucaaaaaggccgggcacgguggcucacaccuguaaucccagcacuucgggagacugagguggguggaucacuugaggucaggaguucaaggccagccuggccaacauggugaaaccccgucucuacaaaaaauacaaaaaucagccgagcgugguggugcaugccuguagucucaguuacucgggaggcugagacaggagaaucccuugaacccaggaggcggagguugcagugagccgagaucauaccacugcauuccagccugggcaacagagccagacucugucucaaaaaaaaagaguaaucaaaaagcuacauuauuuaaaucuuggcaugucuuuaaaaaauguuaaacugucaggaaaauuaucacuucuggauaccaccuucagaaaaacacaugaaaauuugugcaugucucaaauaguuguuaauuuaugaaaaauuagaaagaguguuugaauguauauuucugucauauuauauugcucauauuuuuaaauuauacuuuuuuucacccgugaagcccauauaguuaaguuugaaaauuuuaauuauauuagaauuugaaaauuaaauaaaucuccuuuaauucaugcauaauuuucuaauagucauauaguuuguauuauauaauuugagaaacuugguucuaaaaaaauugucugccaaagaauguauauuucugaauucuguucugcuuucauacaucugaaaauauuugagcuaucauaacuggcuaugcuucaaacccagucugaaaugggugaccuuugcuggcuuuggauugcagagcugggggcuguuguuugcuuuaucugauuuaaaauagucaguaguuuauuuugcaggcaguuagauguauaccuuugcauaaaaucauugaacugaaaagguuggcacuccaagaauacguugugagaaaagagaacuugaguacucacucucgacucaccugaaucuuauuaauauuuuauugauuaauaucuguuguauuuuuaaguaaauaagcucucuagaaacuaucucugcuucuuuguucauuuaaaauauauuaaacaaauugauacagauugcaaaaauuaguugcaacguuccuaguuagauaucaaugaaauaaaaauggucuauucauacgaguucauuuuaguuauuccuacuaauaucaaauguguuuuaaaaaaugggagauuauaaucuuuuuaugaaguaagauaaauuauuacuuuguauauuuaauucaaagaaaacaaaaaggccacaagugccugcauaaaggcacauccacuuaggauuauuguuaaggccuacaguugauaauuaggauucaggcauagcauaaaugaagugguaucuuuuuuuuuuuuuuuuuuuuugagacgaagucucgcucuguuguccaggcuggagugcaguggcacggucucggcucacugcaagcucugccucccuccuggguucacgccauucuccucccucagccucccgaguagcugggacuacaggcuuccgccaccacucccagcuacguuuuuuuguauuuuugguagagacaggguuucaccauguuagccaggauggucuugaucuccugaccucaugauccacccgucucggccucccaaagugcugggauuacaggcaugagccaccgcgcccagccagauaucaauuauuuuuagacccaaugauauuugcuguugauuuauuguuggugcacaaaauaagaaaacaaaagcaugguuuuaaaacagcccuuuacacauuuaauauggaaaugguaaccuacaggucuguauuccauacagauuccugggcucauuuuaucugugaauuccucugggcgucaugcaugcccaggacugacuuuaaagcagaauuauccaguagagguauaauaggaccguuagaucuaauuuaaaguuuucaaguagccacauaaaaaaauaagcaggcgaaauuaauuuuagucugucacuaaauucaaaauguuauuucaacagggggucaauauaaaagcuauuuaugaaauacauuauuuuuucauauuaugucuucaaaauguucacauuucacauauuuauuuuuuauuuuauuauuacuauuuuuuugagacggagucucacucagucgguugcccaggcuagagugcaaucuagcuugcucauugcaaucuuggcucauugcaaccuccaccuccuggguucaagcaguuuuccugccucagccuccugaguagcugggauuacaggcgugugccaucacacccagcuaauuuuuuuauuuuugguagggaugagauuucaccauguuggccaggcuggucuugaacuccugaccucaagugacuugccgcuuuggccucccaaagugccgggauuacaguugugagccaccgcaccugauuacauauuucacauauuuuaauucagaccagcugcaugucaaguacuuaguagccacagauggcuagugguuacuguauuggacagugcagcucuaggagagucucuucaaccugcagcugucuaggaagagaaucauaguuucuggaacagguagaaucuauaagaccuccuuuuuaagcuucuccacuuuacagaugaagaaaguaauaucuggagauguugaguuguucaaaaucacccacauuuuaaggaucaagagcccagucccuguucucuaacuucuaaucucuuucuucaucacuuuuucugcuucauguugcugcauccccuuuaguuacuaagguacuaacguuagguuguugcuaucaguuaaauauuaagccaggagcuuuaagacaaucuggcccacuugaaggcauggccugauuuggacaaaacuugugggguaggaugaauagaguuaccaggcauaucuucaaccucucuguggacuaguauuauacauauaugagaugauguaggguccagugaucaguucaucuuuuucuauugugagcacuguuggaauaggaauggggggaccuuuugggacccaggauaugugauucugaacccugaaaugucagaugcccacuaaaaggaaggggagagauggaccugucauuaccuuacacauuuuauugucuguauggguauguaaacauguacagauuauaaggaauugcacuucauuucugggcuucuggaaacacagguauuaagauuucauuuaccuccccuuguuuuggaaggcuuauugugugugugcccauaguucuuacccaguuacacuuaaaguaugauacuuuuugacagcuuaagccuauugcauuccuggcauguaaaauaguuauuuucagaauguaagcaaauguggaaagcuuacugccugacauggaggguuggagaagugggauugguguucuuuuguuguaaacucauuuuugugaaauauuugcuuuacaacgugaagcaugcaugauggaugaacuuuuagaauugaaaguuauuuuucauuucauuccugaaauauuuaccagcauggauguugacugagugcuuugaagaguuugcuuagucauauaacuuagguuuuaugauuuuagauuuaauuaaacuuaaaguuuuccuguuugauccucaggacuucucaucuguggcaaggcuuuacucacaaaggaaauaucaaccuugaaguuaagcaugcccuguguuucuuuauauucugaugaaaacgauugaaguuugccagugcugugucugggacaaugcuuagaggauucauggcuuguaggaaugaguuaaaaguacaaggauauuggcuggcauggugacugucgccuguagucccaaaacuuugagagucugaggucagaggauugcuugagcucaggaguuugagacaagccugggcagcauaaggagaucccaucucuauguuuuuuaaaaaagugaaaaacaacaacaacaacaagguacagggguaucugcguuuccuuaggcagcugucuuauauaccuuuaaccuuaaaaaaauccaccauuuuuaaaacaguguuuucuguuguuuuucuuaguaaauauaaacaauaggaacugaaguuuagggcuuaaaauuuuugagagaauaauuuuuauuucaguagcuuuugggguacaagugguuucuuguuacuuaguugaauuacguaguggugaauucugagauuuuagugcacuuaaguaggguaccuuguaccuaaugucuaguuuuucuuuuaaucccuaguccccuauuacccuccuccucgugagucucuaaaguccaauaugucccucugugugccuuugcuuauuccuaacuuaguucccacuuauaagagagaacauacgguuuuugguuuuccaauuccugaauuacuuuacuuagaauaauggccuccagcucuauccaaguuguugcaaaagacauuauuuuguuccuuguaauggcugaguaguagucccugauauauauaugccacaucuucuuuauccucucauuagucaguggccacuuagguugguucugcaucuuugcauuugugaauugugguccuguaaacauauguguacaagugucuuuuucauacaaugacuucuuuuccuccggguagauacccaguauuaagauugcuggaucaaaugguagaucuacuuuuaacucuuuaggaaaucuccauaauguuuuccauagaggugguacuaguuuacauucugagagaauaauuuuuguaaaauuauguuuaagcuagauuuggaauugggaaagaauuacauucuuuauaggaagcuuuugaaaaauauauuuaaaaauauauaaaaauaugcauaauccuaccacccacaaaugucuguauuauuaugucauuucuaaaccauuuuugagauuaugcuauagauuacguuuuagauccuacauuuuauuucuuaacauuaaaucucauacuauuuuaaguucuuuguacauguaauguuuacugaauggguaaaucuguuuagggaaacuggagcuauguaguuguggacuugugcuuuuguuuuguuuuguuuuguuuguuuguacauuugcuuuuuagaaaugucuauucagauccuuggcccauuuuuuuuuuuuuuuuuuuuuuugagauggagucuugcucugucgcccagacuggagugcaguggcgcgaucucggcucacugcaagcuccgccucccggguucacgccauucucccgccucagccucccgaguagcugggacuacgggcgcccgccaccacgcccggcuaauuuuguuuuuguuuuguauuuuuaguagagauaggguuucaccauguuggccaggauggucuugaucuccugaccucgugauccccccgccucggccucccaaagugcugggauuacaggcgugagccaccgugcccagacagacaugugcuuuuuuauuuggcauuucuagccugaacauaggcuggaaguagugacuuagagagggauuguuugccaaauaucagguaauauuuuaauuauuuauuauuuauuguaaugcugugaaucaggagucccuaaccccugggccauggacugguaccggucuguggcguguuaggagcuuugcugcacagcaguaggugagcaaugggugagugaguguugcugccugagcccugccucuugucacaucagcagggcauuagaugcucauaggagcgcaaacccuauugugaaccgcauguaagaaagugagagcugcguugcacacuccuuauuagaaucuaaugccugaugaucugagguggagcaguuucaucccgaaaccaaaccacaaaauugucuuucaucaaaccauucccuggugccagaaaggcuggggaccacugcuauaaauugcugcugucaaguaguguuacgcaugguggucuuuaacauaaaaaaaaaagguaaugaacguacaccacacagauuagcaaaaauaaggaaaggcugaucuaguaguucaaacaagcaauccucuuauuuaaugguucugugauugcucguguaggcagaagcuuaacuguaaguuguugcauuugacaggcaaauguagcuggagcuggaauguagauauuagugaaauugugauuucaguuuacuggagccauucagugggagcaugaaguggguuacaugauuacacggauauaaauaaagcguccuccuugccacuucacugcuguuaaagucucuccugauguuauguggugaaaaacaagucaaaaacauuaauucugucaaguuuccaaagauauaagaaucuuugaccagaaaagagacgguauuuaucuucaaauuuaacaaauugugaugaaaugcugcuguuacagaaccuaguguaaggucguggaguccauucagccagacacauguaauuuugauuauuaacugccguuucuguggucagucggccaguuuuauauauuucacauuauagguauuuggagcaaagacaguguuguuuauuguuuacuuuaaaaaaauacaauacuguaacuacauaaugaguaaauguugauacuguugaaaacuaauaaaaacaaauucuuacacuaucaacaucacagaaauucuaauuguaagaaaauauugauauaauauggaaauccguucauuuauuuggugcauuaauugaacaccaacacuaugccaagcauugggauacaaccaugaaagaggccagcuuccugaucucacagagcuuguacuuuguuggguggggcagagagcaaaucagucaaucugucugucugucugucuaucuaucugucuaucuaucugucuaucuagaugucaaucaguauacucugugccacuugguggucagugcuaugaagaaaaauuaagccagugaggagcuggauagagacacagucuggaaggguaugaaggggaucagaauaugcuacccccaaauaugccauuucagcaaaguacuaauuugagcugaagacaaucgagaaauagcagacccaggacaagcuuuacccccuuuuuauaaaaauuuugcugugugaagguauccuccuuccccucuccaucccuggagagaccacuagagguggcaccaucgccugcagaaacaaaccuuauugaaauaacccuuaucuucuauuaguuucccccauauauuuaccuuaccacacuuccccuggaagcccuaauccccucuccuuugucuugugacuucuccacaguuuauugcucuuuguuaaaaugguguguaugcucucaggccuaacugcuucuuuuggguuuuugcuuuucuguggagcucccuccucuccccucccucauguaaaaauaauaacauuaaauaaaauuuguguuuuuuccccugcgaaucugucucgucaguuuaauuggcaaggccucaugugcugaaccuaacaggguagagaaaaaagguuuuuuuccccuuuucuacaaguauuaaaccuggagagaacaauacaguguaaaggcugugaggugggagcaugcugggguguuggaagaagcacaugagcuuacaaacauuccaucaauuugcauucauuccaaaaauuguaugcaauuuuucagugacgauucccauugaucaaucauuuauaaaaacuaauggugagggucuuccauacucaguuuacucccuucuuggaaaagaauguacauuuuaaucaagaugauuucaugaaagacauucuguacuccaaacauuuaaaagagcguuuagaguauacagcaauucaucuuuucuucuguauuuuaaaauuuaagacagggagaauuauuguauuauacuuaguucagauuugguggugguuuuguuuuuugguuccagugaaaagaaauugcaucaguaaccuggcggucaaccgugccauauuguuugugauuuauuagucuggaaaaaauaacuguauuucuggcauauguaaaaauaguuugcugagaggccuccuugguuguggcaauaguaauacuaauuaccagguacuguauguagcucauucuaugaaccaggccuuguugaaaagugcuuucacuuaauuuuuucuuuucagcagccugugagguaccuacuguuauccccagcugggagggagcuggccaguggacuggguuuaaacuauguuuucauugucuuuacucuuaaccacuuaucuucucugccuccagcaaaauaagucaaagaguucagccaguguuucuucuuggacuaagcagucagccuccuaaguaagcaagccuuggaaugcaauugauugguaagauacuaaaguaaucaguaaggcccucaguuccuggcugccagcuucuuucacccucuccugcaggaaguucugaaugcugauaucucuacuuggugucuucucucccccucccaauuccauuauuucccuuuuucucaaucccaagugaaggaaguucugaguguggauguuggagucauucagaccuuggaucugagucacaacucuuucaauuuacuagaaauaugacugcaagaaaaugauguaagcuucccuaaaccaauuuccacaucuacaaaguaucuaaauagauugcuuaggagaaaaauugaauuaaauugaauaaagugcaaagcacagaacauggccaggaguaggcccuggaugaaugagggaaaaaugguucugauuuuuauuuuugagccucuuuguaacauuuguuggccccuucagaauaauccuuagaguucauaucagccacccuucaucccuccugggaugggccaggggagaggcccaguugccugugacacugcuucguuucacauuucacugcuuuagcaucucaacauuucauugauaacauuuuugaugccugaaaacagaauaacuuauuuguaauucuacauacauuuuguuugugaucaaguuguuagaguuugaaaugagccucauuuccuuggguuuugucccuccccaucugaccuuccucuucucagugaacccugaagaaaaaacacuagcaaaggaaucucaagaauguugguucgggacacagcucucuccaucuacucuccugcccuaguccugccccuccuuguguuuucagcggugaccaggcacuggugacagccuuggcugcuuggaccagcuggagguagcugcaaaaugccugccugcuagcuuugaaaaaucucugccaaccucauugaaauaauuguuuaccacauaucagaggggacugggaaguggguaauugagagaucuuuuugaagggguuuguggcuucuccacuugcagaggcuuccugaaaugguggguaaugcucaugccucagggagaaucaauauccuucuccuaaaaccugcucacacguagcucuaaguauuagacaugcauuuuuguuaacauuuuaucagugcauuuuucuaccugugucauuuggaccuuagauucgggagaaaaucacuguguaucuuuggugguuucagguggcucuuaaauuucauuaauucacaaaaucugaauugaauggaauagucuguuuugggagguuuuuuuggggggguuggggagggauuggauuuuucaguccuuccaagagacuucagguuuuuuuuuugauguucugauuagcccgguguguguaaggcccuaucagguguucgccugugugauccuaucacacccacauccuguagcugcauccaagugcuuugaggccgacuuaauggggauuaacuuaacaguugcucugugggaacagaugcucuuugccgcuuauuucuaauaaauugauugagccauuuaaaagauuuuuuuuuucuuuuaaguuacaucuucuuaagaaacuguagacaauaaagcaaaacuaaaauacuugggucuaaaauuaguguauuauauuuaaaacacugggcuucagacugauuauaucaugcucuuuuacugacuuucuagucagaugcuuauuuauaaaaauaaagcuuauauaaagggcagcauucaaauguuacaccagucgguuuuagcaguuugaccuuccacaguagcuaaauauuuuuuacacugagagaagaauucuuuaacauuauaugcuaucagcaugucaagugaauucugagcuugcaugcaacagaugagacccuagguggaaacauaaaaacauaccagugugaaagagaaaagcaggcucucugucuuugggaaggaguucugcagggagggguguuuauaaguguaguagauacuuaggaaaauuaauacaauuauuauaaaagucaucugggaaaaaccauuagguaagaauagccaauaaaaaaccagaagcaaaauguaaagauauagaaauuaaaacugcacaucccaugcauagauaggucaauggggcaaacuggaagucuagaaauaaaguugugcauauauuggaaauuagugcaagauaaaagugucuuuuuacaucagaaaggggaaagauggauuauuuaguuaaugguguuggguuaucugacuguacauagaaggaagguggguaauuauuuacccaguaccaauacuggauuaccuaguauuauguacccaguacaguuugucagcaacaaaaggcaaacuuuuuuauuccaugaaguguucuuacaaaucaguaagaaauacuaaauaugaacaucuucagagaaaaaugaacauuuuugaaaacuuauuaugaaaagaauuaaacauacacaagagagaauagugcgcugaaugcucagcaaugaucagcucucacccagucuuguuuuaucuguauuccccuuucucaaccugcucaauucucuuuucccucacuggguuauuuugaaauaauuucaauucuauaauuuuauguauaaauauuucaguguggaugucuaacagaaucucuauuagacguggacaaaaaaggcaaagaauuuuauaguacacaggaaaaaauacacagccaauaaaccuaugaagauaugcucaaucucauagucgucagggaaaugcaaaguaaaacagugauauaacauuguuuuuuaaaacccugaugggcaaagacuaaaaaggcuugccagauuggcauuuucaucuacugucaauugauaacagauauuucuuugcuuggaguacaguggcacagucuggacucacugcaaccucugccucccagguucaagugauucuccugccucagccucccgaguaccugggauuacaggugugagccaccacgccuggcucauuuuuuguauuuuuaguagaagcaggguuucaccauguuggccaggcuggucucgaauuccugaccucaagugaucugcccacugcaggcaugagccgcugcaugcagcugguacagaaauuuuuuagaucagucauuuagaauuuuauguacauaucccuugaucuaggaauucuagaaacuaauuaguucauaguauauuguauaaaugcgcacagaugaggauauuaugagagcauuauuuguaucaacuaagcaagccuuuaaaaaacucuuauacaguagaauauuaugcugauacauuaaaagugggcauaaccauacugauguauagaaauaucuaaaaucauaccgauauaagugaaaacauucagaaugcaggcauaaucacagauuaaacaguaauuuauauaaaaaacagaaaauuuauauguguauuaugucaguagcagauucaagugaaucugacaaaaucugacucugggcaaugagaacauuggaauggaggagaagguaguacauauuuacuuuguauauuaucaccuuuuguacuauuugagucuuuuuaacuguacgcagauacuuuagagcagggguccccaacacccagccauggacagguacugguccauggccugcuaggaaccgggccacacagcaggaggugaguggcaggcaggugagccagugagcauuacugccugagugcugcuuccuggcaguagauucucacaggagcacaaaaccuauugugaacuaaacaugggagggauccagguugccugguccaguccuugugagaaucuaacuaaugucugaugaucugagguggaagaguuucaucccaaaaccaucccaucccauccagucucaugccaucccacccccaacaccccauggauaaauggucuuccacaaaaccagucccuggugccaaaaagguuagagaucacugccuuagaggcugcucccucuuggcacaucuugaauguaggacuccuugguucugccauuccugguagguagucagccagcuuuugauaguucuccccagagacuucaucccacaggcaagccaucccauuccacguaaaacaucucuaauguuaggaaggcacguauuuugaugugauaucuagaauccucccagcuguucuucagaggaacauuacuuuuauaaaguugaaaagaacguuuuauuguauuauaaaacuaggucauuucagugaauuucaucuauuuucauggguaacugauucuuauaucaaaacuugcuuuugaaaguacuggaagcauaaauuauuacuucaggcccauuugcuuuacuuuguucagcacauugaacaucaaggagcaacucccucgaucuaaaauuucuagcauuggugcuuguaauaucauuuuucaaguugacauuaaugcuaucuuuggaauucucaugguaagucagaagaaagcaguuuaguggaacuguucuuucucccacugaauuguauacugagaucuguuauauuuucugcauuuuaacccagaaaguuguucaagagaauugaccaugauaagacaucuguagcuuauuuuguauuuuuuuaauggaaaauuguaacugacuuuuaaauuuaagauugaguguagccuuucccaaaccaauagcuaauguuuuuauaacuauuuaguguaggagauuauaauaaaauccacauugcuuaagauauaaaauguuugugcaguaauaggcuguauaaaaacaguaaauugagauuguaucaggaauaauguauuauaaaccauauaugaaaccagguacuaacuugguauucugcauagcuuuaucagaaaggcagagcaaauacuaucucaaaaugaaguauaaacaaaaugagguucagugagugaugugguuuggcuccauccccaccuggaucucaucuugaauuguaguccccauaauccccauguguagugggagggaccagguggagauaacugaaucauagaggcgguuucccccauccuguucugguaauagugaguuaguucucacgagaacugaucacuuuauaagggacuuuuccccccuuuugcuuggcacuucuucuuccugccaccaugugaagaaggacguguuugccuccccgucuacccuaauuguaagguuccugaggccuccccagccaugcugaacugugagucaguucaaccuguuucuuuuauaaauuacugagucuuggauaugucuucauuagcagcgugagaucagauuaauacagggaggcuacauaauuugacccaaguagcaauaaacaauaggggugagguugaaauccaggccccugguacuuauggccuuaagcuaagugaaauaagccagacacagaaaaacaaauacugcaugauuucauuuauauguggaaccuaaaacacucaaacucauggaaacaagaguagaagggugguguuaccaggguuuggaugugggggaagugaggcgauguuggucaaagggugcaaacuugcaguuaugagauuaauaccuaauguacagccuagugacuaguuaauaauagugaauuguacacuugaaaacgucugcgagaguaaauguuaaauauucuuaccacacagaacaaaaaaaguaacucugaggugauggauauguuaauuagcuugauugugauaaucauuucacaguguauacauauaucaaaacaucacguuguauacauugaauauacauaauuuuugucaauuauacuucaguaaagcuagggaagaauaaaagaagugaccuaaccaggacaccuaucuguagcucuaugguaaagccaaaagggauaauaacuuuugauuaucaaaacuucaucaucauuauuauuuuuuaagacugggucuugcuauguuacuuaggcuggucucaaacuccuaggcuaagugauccuccugccuuggccucccgacauauuaggauuauaggcaugagccaucacacccagccaguuuugaagguaucuuuauuacauuuuuuuguuuaaauauuuaauaguaaguguuuaacuugaagcauuuuuuucugccuuaaaauugauuuucccacucauuuuauggaucaaaacuauuaucagauuuuaauucccacuccaccacauuguuuauaaaaguugacaauuauggaaaguaaaguaauacugaauuuuucuaaugccuaucuuugacauggaauaaagauuauaaaauuucuuauaacuugaaugaguuuuuaaaaauuggacaucuuuuuauaaaaaucuagcauugaccauuucaacauaaguuuuacuuaucucugaaauacagguaguaccuauuuuuauuaauuuucuuaagugaugcugagugacacuauuuuuguuuuuuuucacuuuuucuuuacuuuuuuuuugagacaggaucucagucugcugccaaggcuagagugcagugguguggucuuagcucacugcagccucggcuuccugggcucaagcgaugcugccaccucagccuccugaguagcugggacuacagguuugcaccaccaggcccagcaguuuuaaagauuuuuuguagagauggggucuugcuguguugcccagacuggucuugaacuccuggccucaggcgagccuccgaccucuaucucccaaagugcuggaauuauagacaucaaccaccgugccuggccccagugacacugucuuaauuuugaauagggaaguaucuaaugguauuaaaauggucuggcagagaaggggauaugaggcuuggugaaaauaagcacaggaugcaccaucuuugaguaaguguuaguuucugcagugagccagcagcaacauucuuagcagagccuagaaagaucgagugagggcugugugguggugcagccucuuaagucucucugguuccacaacaugcucagauugguggcuuugauauuuucuccauccaggacgcauugugcuaagcuuagggaagguccaguggauauuuaccaagccucuuauacugccccgcauguugccaugagacagcagcguuaucaccuuaaauggugcaaauacuccuugugcauacccuaccccugagaucuaacaucuggauucuggauacuguuuccuauucuuccaucuugcugcaugguucccagguuauguauauaguguggcuaggcaccacacauggcccuggcuccuugcagccauacagaggugaccuaacuggauguaauuggguauguaccggguguuggcuaccugugcagguugagggccuuccacaggucuagcaaagcaauucauugccuuucugaauuuuugaaugcuucauuugugaaacccuugauguaauaacuguugauauuauuucuuuuugaaaacuccccuuacucuucccuguuucuucauuuguaaacuggaaccgauagaaaaguaccaaacuuaggguuguugugaggcguaaaagaaauaauacagcccagagaacauaguauauacucagcaaguauuuauuaauaugacuacuaagccagcauuggugauugauuggcucauagugucuucuauuugccagauguuuucagaggcucuguucauguucauacccauguuuguaaaugacagaauguaaauuucuuaauccucugucuucuccuuuagcaucagcucuuguccccaaaguaaaagaacucagucauccagaacccaguuuuguagaucuauuuuucaaaauugggcaguuaauagaaaauuaaaagcagucuagggaaaagccuuuccuuuggguuuguugcuuucuuuucugucauaauaagacugugcccaaacuguagggaaaaaucaagaaacuguaaaauacaucaucaggguguuuauaguaaauguaaaacguuaaguaacauuugaguuaaucugugcuuguacaaaccucagaagcuuaaauaaugaaccaaugacauauaauuuagaaaguuuucauuagacucuuugcguugguauuugcaauaucagauuugcaugucaucauuauuagccuuccucuauuuugaguguugacuaggugccaggcgucauguugagaaauuuaugugcuuauuuaauucucacacugacuccaugagauagauacuccauuuuacagaugaggaccccacaucauaaccuuuuggccagaauuacaguuaguguuagaauuuaaaccuaugcagucucauuccaaauccucugucuuuacuccuccagaaugcuccauuaaaugaauuguuucuuauaauccgguuguuuuaacguuggaaaagaacuugagaacauuuagcccaaccacccuaugaaguuuggcaguacuucuugccauucuuucaauagauaauuuauuugaguuuaagggagagucuaugaauuaacacuaguaccaaaacucccaugagaaaauaauguagacagcuuuuguuaaaaaagcagaauuuuuaaagguguucauucaguuaucuucuugccuaacaaguuccuguguugugauagacuuugaauuuguuaaauaugaauuggcuuccugauucuagcuguuuugccagaggccugauuuagagaagggauuaaaccacuggucaaccuuggauggaauuugggccagcaguuccuucuccacagccccugacacuuggcuuugugccaagaaaauccuacaaaaggaaauugauuuacucuacccaagacagaguuccggaggcuuugguuguccauuguuagcuuagaaguuggcgcagugugcgugugauccacgccuaaauagcacagccuugcugugcgugguagaaguuggguuaguguugacaugcuguugacucacccucccgaggauggaagcucuggccugggucaaguuguggucacugcaguuaacaguuuguugaucucagggaguauuccacaguugcugauguaauugacaaugauuggagccagcucuuccccagauucaaauggaccaauuagaggacuuguugguucuguuuaucaacuauguaagugaguacugugaaguuggcauuguuuuuagucuguauuuggguaagaugaaacucuguucucagacaguaauaucuuucaaaaguacaauguuacuuauugugaccaaaguagggaugaaguuugcaaauuauuugguguaaugauuuaauuuggccauccaugcagugcaguucucuaccagugugauuguucucuuuguaaaauacucuuacuuugccagaaaauuguuuguuuguuuguuuguuuguuuguuuguuuguuuguuuugagacggagucucgcucuguugccaggcuggagugcaguggcccgauauuggcucacugcauccuucaagcaauucuccucccucagccuccugaguagcugggacuacaggugugugccaccacguccagcuaauuucuguauuuuuaauagagacgagguuucaucauguuggccaggauggucuugaucucuugaccucgugaucugccugccucggccuccuaaagugcugggauacaggcgugagccacugagcccuguugaaaauucuuauuaauaagauguuucucauagaauguuucaaaaaauugugacugguuucaaaaucagaugauuugcaagaauuagccauaguauaaacacauaguucucaaaccguuuucugggagugggcccagagaucuauuuaacaaaaccuugaguagagucuggugcaaguuaaaauuggagaaccacuaauguaaccuuaccuuaucuguggaccacauuuugagcuuuggaagaaauaacccuuucuauccuucacaagguaacagaugauuuuuuugcacaauuauuugauaaugagcuuauauuugagauuaagguaugcacacgauaauguacauucucacucuaggucuggggaccuugauucuuugacucuucuguccuuuucucuccaguuacuugguuuugugcauuaacaaacuuuucaauuuacuuauuuuuuuuuacuuauuuacuuauuucucaucccuuacguaauguugcaucauuguuuuuuguagccucugcaguucaagauacuaaucaccccuuucuaccacauuaaaauacagacucuaccuaaaaucauguaugggaguaacuugauauauacgaaaguguaaccgugucacaauuccccgccccaccccgccagucuacauaaaacugcaaacacuuuauugcuuaccaagaaaguagacaauaauaucgaagaaagcccuccuuuuccucuucuuugaccaacaagggagcaguuccugacaaaugucaguuugcuuuuugaguuccuuagguuucuguguuguguuugcaauggauaaauauugaguaacagguacugacuguauuguauacauugaaaacuauccaccaacagaauauuugcaggaggauuuuguuuuguuuuguuuuguuuuguuuuguuuuguuuucugagacaggcuaucucucugucacccaggauggagugccauggagucaucauggcuuacuguagccuuaaccuccuugucucaagcgauccucccgccucagccuccuaaguagcuaggacuacaggagaggaacaccaugccuggcuaauuuuuuuuuuuuuuuuuguagagacagaguuucgcuguguuggccaggcuaguguugaacuccugggcucaagaaaucucccaaagugcugggauuauaggcaucagccacugugccuggcuugagaaugacauucuauaaguaguuucagucccuuaguuuaaucccauauuuugauccuauaacauguacaauauuuguguauaguauaugaucugccaacucucuaagaagauuuuaaaacuuauuauguuaaauuucagacauauacaucauccagcuucaaaaauugaccacauuuugcuguucuuguuucagcaccucccccugccccauuuucuuuucugaagcauuuuaaaauaauucucagguaucauaucauuuuacuucuguucauagguuucugaaaggauuugaugcagaauguuauuauuaaaccaguauacagagagaaaggccacuggauauuaguacauguuuugguuucagacgguccuuuuaagaguauauuaaaucacauaaggauuuucugaguacccauuagaaccacaaaaaauaccuaugauacccuucuuacugcaguagaagaugaguuuccuaggguagcccuuuguugauggaacaaacauguauuuuguuucaucaggaaaaucauuggaacagccaugacucagauccacuaaaugaaggaacaaaaauaggaccugccucaccuccugauuuuuuuuuaaaucucuaggaugaguaaccagaauauuuuuauguugugcuaaguagguuuguuuguuuguuuuuuacucugacuuauauuauuugaauuguagaaauauauuguuuuuacuuuuuucuuuaaaauucuaucuggaguuucuaaaugagagauuguagcuccuaaaaccuuucuuaguuuuggugucuugcuuucuguucuuagcgucuguggucauuucuaacucccagugaggaaagagcucucuggucuuguuucuuuguuaaaugaaggagcaaaccuccgucucguugauccacucccaacccacuuguuuuguaacaaugaaaguuaucucauacuuaaaagacaacuugaaauuauaacacaccuguaacaaaguaaaggguauggguuuuuacuuagguuuaaaaaaagggcaguaacccuuuucauaaaaaagcaaaauuuagaugggauagaacccccguuuauagaaaagauuuuaaaaucucauuugcucucauugaaaccuuaaccuucucucaaauacuggcgcaccucugaggaacuucaaauacgguuugaaaacuaaugguuuaaggagggccaggcgcaguggcucaugccuguaaccccagcacuuugggaggccgaggugggcggaucacuugauguuagccugggcaacauggccaaaugcugucucuacugaaaauaggaaaaauuagcugggugugguggcgcaugccuguagucccagcuacucaggaggcggagguggaggcgggaggaucucuugaacccaggaggcauaggugcagugagcagagauggaucucuugaacccaggaggcauaggugcagugagcagagaucgcgccacugcacuccagccugggugacauugagacugucucaaaaaggaagacgaauggucuaaggaaacuaguuugugguuucucagcggagaaugacauucuaguuucuacagaucuggcaacagaagacaggcacauaaacuggccugcuuuggagucagggccaagacuuaaauccagauuuaaaaccagcuuuuuuuuuuucuucuucuaaaacaaccaaccuguguuuuagguccagugucugccuuguaaguugcucaaagcucagauacaaggaaguaaucagcacacauuuuugugauaacauuccugaaaagaaaaagaugagguggacuaagguaaauacacugcuccuuaaaaauccauauuuuuagauuauuuauaaaucaaaugggcaugguuaccaaagaugaauucuagagguguaaaacuccagucuuauaccucaaauuucaguuuuccuuagggagcaaaacacuuccaugaucuuacugaggaccuaaaaaagccuguacauauuuuaaaaauagcacucccuagauaaagccugauggauccaggguacaguagaaucaugaaauugccuguuucuuuuuaaaagauguauaugauugcucgguggcuguauauuguccaucgugugcgugccugugugguauguugguucuuucagagaggcaguggcgugcagagugagaggaucacagauguguaugugacaaaacuauuucuuuucuuucuuuucuuuucuuucuuucuuucuuucuuucuuucuuucuuuucuuucuuuucuuuucuuuucuuuucuuuuuucuuuuuugagacagagucucacucuguugcccaggcuggagugcaauggugugaucuuggcuuacugcaaccucugccuccuggguucaagcgauucuccugccucagccuccugaguagcuggauuacaggugugcaccacgaugccuggcuaauuuuuguauuuuuaguagaggcaggguuucacuguguuguucaggcuggucucgaacuucugaccucgugauccgccugccucggccacccagcgugcugggauuacaggugugagccaccgugccuggcugacaaaacuauuucuaaaacacaaguccagauauuccuaccaagggcucucuggggcuucguuuugauuuauaugcaaaacacuccuaauguggugacauuggggagauaaagaucugggaugaugagagagaaaggcagguaggacacaugcccuuccaguaacuuucccagcuagggcuugcauuuaaccucugauggaggccucaccauccaggcagauguacuugcuuaggaaugaguuugagauaauaaggcuaaaugugcugccuucuguauauaauuugcauuuguccuaauguacgacuaaggaaaugaaaaaucaaaguuugagugacuaaaauaaaagaggucuguggaguaauuggauugaauuugcaccaagucaaggagaaaacuucuguauuuuguauguuuugucaugguucuaugauuacuuguuagaaagugauauaaaauucaauaacuuaguuugauaugaacuuggcuaucuuuaaguuauagaagucgugcauauaauguggcuguuuucaacccccauacccuuucugagugguuggagaugucuugaauuucgaagugagaaggucuggugcuguuacauagauaaucauguuagccagcuuuaccuucugauaagcucucaauuuaagaaaguacuucuaauccuggcuuuaucuuuggcuugcuaucuuauuaugcacagagcauaauuguaagaagggaauaauaucucuugcugucuauucacuaagaauagugugaggacagggcucuuaaaaacaugaagagaugggcacuauuguauagauauagagauuugaugaaauguuaaaauguuggaugauuuuaaaugacaaguggaguggugagaaguuuauuuuuaaccuuauguggauaccuuggauauuuagaaacaucgaaguuuuaaggaagaacaaauaucuugacuccaagaaaauggucaugugauacuguggcaucuauuuggucuuccugauguauauguuuccugacauuuagcuccuaaaauccuuggaaucuccagugcuaagaaggucuuauaugcuaaugagaugacugguggcuggguaaccuaccaugugauuagaggguuaggacuuucagucacccuccccaaccuccaggagcugaaguuugaguugauaaacuaaugaucaaugauaccuacauaaugaagcuuucuuaacaacccugaaggaccgcguucugggaacuuccagauagcugaacacauggagguuccuggaggguuggaugucaggaaagggcauggaaucucguuuucucuucagccgcaccucaccccgugcaucucuuccaucuggcuguucaucuguguguccuuuguaauauccuuuaaaauaaaugggugaauguaagcaaguauuucucuuaguucucugaaggugcuccagcaaugaaucaaaacgaaguaaggggucuggggaaugguagccaguuggucagaagcacaggcuacaaccuggggcuugugauugacaucugaaguugggggaguuuugugguacugagcccucagccugugggauguguaaucuccaaguacagugucagaauccaguugaauuagaggacacucagcuggcauccauuauuggcaugcaguauuccuugucaugagccugggcaacauagggagaccucaucucuacaaauauagcugggagugguggugugcaccugugguuccagcuacucaggaggcugagugggaagaucgcuugaguccaggaggcaaacauugcuucuccuccaaaugcuguacuuuaacauguuuggaaacuccugcaaaggaauuucaacauaagcgaagucaauggguuauaaaggacugaaugccauuuuguaaaugucagaaaucaaagucacaaccaaguuaaguucuagauuagggccaggaagagaaauguauuaucuggucaaccauaucaaaucuguauuuugguggaagagcauuuucuuauauugguucugauugguuugauacggacagggaacuguuuucuuuauuccaguuauuuguuuuguuuuguuucugagacagagucucgcucugucgcccaggcuggagugcaguggugcgaucucggcucacugcaaccucugccccucagguucaagcgauucuccugccucagccucccgaguagcugggauuacaagcgugcuguaguuuuuguauuuuuaguagagaugagguuucaccaucuuggccaggcuggucuucaacuccugaccucaugaucccacccgccucggccucccaaagugcugggauuacaggcaugagccaccgcgcccggccuauucuaguuguuaaucaguuaacauagccaaaagauauagaauaagauuguagacugaauccauagucuaaugauuugucuuccuaguaauugugaauaauucagacauucaaaauuagucuggcaucauacaaacauuagacuaguccuaaaaugaggauauuggcaaguguguuaauaaaaauugcauaugcaguauuaauagguuccuuacguaggcugccgauuacucaggaacugucagauguuuuguuuuguuuugucuuugagagauggggcaggguuuuacucugcuggagugcaguggcacaaucuuggcugacugcagccuugaccugcugggcucaagcgauccucccuccacagccuccuaaguagcugggacuacaggcaugcaccaccaugcccagcuaauuuuuguaucuuuuuuuagagacgggguuuugccauguugcccaggcuggucuccaacuccugagcucagggaucuacccacccaugccucccuaagugcugugauuacaggcaugagccacugugcccagcccccagauuuuuaaucuucucuuugacauugaguuucagaaaugaaguauaaauggugaauuuuuaguguagaauaugaugcacuaggaagaucacuuacccguuuauucacuuucuuagaccaugucaacccgauucugaauuuaggguucuguugugaugguguucuuuagaagugauuuuaacacucaaaauacuauagucuguaacauaauuuacugauuuuuuaauuuuugcaaacuaaguugaaguaaucaaguauuuaugaguucuuugggugagaccaucugucaaagaauucugggcuuaauggagauacauauauguugugaauacuaaacagauauccaaguaauaaagcagaaaucauaugcuguguaacagaaauguaaaguucugaauuaguucacgaguaggagagaaacuuuuuuuuaaagguagaggagaacuaaaaguaauuucuuaaaagagugccuauuuuacaucuugaauauuaaaagucuaauucagugccuugggaucuuguucuuuuuguagauuuugauuugaaugaacuucaguuugcugaaaugucuaaugggugcaaaguacagauuuaauuauaagguugagcuaaaaucagaauuuaagcauauggcauauauaauaccaauuuaaucuuucccccuuaaauuuaguuauuuuuagugagucccaaacaccauauuugagacaucacuuuuuucuuuuuuaaagagauagggucucccuaugugaggcuggagugcaguagcuauucacaggcucgaucauagcaaacuacagccuugaacuccuggccccagugaguguaaugucucaccaugccaaaguacuuuuaucuuaaauugcuuauuuuuuuguuuauuuuuuuaacugacucuguuuacaaaauuaaccuuuuaucuagugacagcuagauuguaucacauuugucaucuauggacaacugauuuuuaguuguuuaauaugguaaguuuauuauuguuuuuccuuauuuaagaaaacaggaucugagugaaaaaaaaaaaaaucuuaauucaacuaucacgauuccaguaggaaguagacagacauucaucuguauacauuaggugucaaaguagaguuuugugguuuaucauucugaagauuugagauucaagacaugacuaucuuucagucauauugugcaauagauaacauauaauguuucucacugaugagaacaguugguuagaucucucagaugacuugaauuagguauuaguucaagucaguugucaguaaguuuggcuuuaucguucagaggagcuucuuaugacuggacauuucucaaguauugccguauuggucauuuggcuaucaaugcuuaaauuauacucaguauaguauaaauuuucuuauuucccuuauuuaagcaugccuccauuacacuguuguugucucuaauaagaguuuaauaaucuuuguuuuggcuuaguaaaaagagccaacaaauauaugagugacugacugaguguauugcucuaugcgcaauugucuuaaaggaaaaacguuuauagaaucacugugaacaauaaaaugguugcauuucgcuggaaaaccucggugcuccuuugguaaauaaugaaguguuuuguuuuacgggccuuuucacuacuucauugacaacagaccuuuuuuuuuaaauuaauuaauuaauuuauuuauuuauuuauuuauuuuuugagguggcguuucgcucuuguuaccugggccggagugcaguggugcgaucuuggcucaccgcaaccuccgccuccuggguucaagcgauucuccugccucagccuccugaguagcugggauuacgggugagugccaccacgcccagcuaauuuuauauuuuuaguagagaagggguuucuccauguuggucaggcuggucucgaacucccgaccucacgugauccaccugccucggccucccaaagugcugggauuacaggcgggagccacugcaucugaccaacaacauauauuuauauuacccaguaauaggcauagucuaaggaagauaauagaauuuauucuuaguagugaacucuuuggcuuuugaagcagaauuuuuuuuucuuuguucuuuucugugauaguaaggaaggaaggaagggaaggcuacuacuaaaaauauaaauugcuaaauagaagucaagucucuggguguugaagcucacauauuggugcuguccagaccugacgcaucuagaaacaggaauuugcccuuagcguaagcuuagccaaaugguugagucauuucuaaguauuuuaacauuauagaaugccuuaggaaaugucaugaauaucuaaaacaggucuucuugaggauuuuauuaguuucuuaaaacauggaaaggaacuugauucucagugcugguaccuaaaauucaaagacauuaguugugaguugcugugcuccucagcucuaagccacaguugucauggccaagccugucuccuuauggagaguggccuugcuguuuccugcagagcuucucuugugccuggcuugugccuggaagucagcgugucaccacuucagagagacacuauagaagcuuggugaucuucaaacaagaacuuaaaacaaagaaguuuucuuucacagauaucuuaaaacuuguagcuaaauaaaacgugaauaacugugagagccucauuacagcaauuuuuaaaaaagcaguacauguuuuguuguaucuuaaacaucacagaaugguauuguguguccaguuuuguuuguaaaauguaaccuucgugugaaugaccaucuauuccuuucuuuuuggaagguuaguuugucagcuguugugugaugcucaacauuuuauguaaugacauuuagcacaacguuucaauauaacaucucaggaaaacauuuaagaaauagugaaguucucuggguauuacauuaaucauauuaauuaccuguugcuuuuaauuuaucaccguaucacccuaauaucacaaggcauguguaguacuauuuuguaaagauuuucuaaagaccuucccucuauaggaaggaaaauuuaauucagaaauugggcugaacucucuuucacuugugugaaaaugggaaaauuagaaguaauuuguauuuuuuauugugaaaucaguguaggaaccugugcucguaucauggaaacaacagcacuaauguuuuucuccccucgggugugggcuuugcugcagauauccaugucuucuacuuuuucuguucuuaguucuuauucacuuauugucuauacuucgugucacuuuauugaauuucacaaaugcaauuuaggaauccagggaugugauaaaauuugugcaucugcuugucauuagccaucucacguuuauaucgcuaagugaaaauuuaacuuaguuuggaacaaaccaccaugauuuaguucaccuguauaguuuaaaagaccuaagaccugaaauuuuuuuuuuuuuuugaaacggagucucacucugucacccaggcuggaauacauggugugaucucagcucacugcaaccucugccucccggguucaagcaauucucugcuucagccuccugaguagcugggauuacaggcagcugccaccacgcauggcuaauuuuuguauuuuuaguagagacgggguuucaccaucuuggccaggcuggucuugaacuccuaaccucaugauccaccugccucggcuucccaaagugcugggauuacaggcgugagccauggugccuguccaagaccuggaauuuuacacugcauugggaccuuauaaaauucuugacuuguacccuuuuggcauuuucugaaugcucaugauuugcuucugaaauauuuuaggccuuuggaaacacuccuucauucuaauccucucuuuucuugcucucaauucuucaugucauguaauuauuuugccuagagccaaaucugauguguuauuauaaucaucauuucugcaggagcuugguaacacuccugcuuuuguucccuuuaaggcuucuuuugguuuuguuuauuuuguuucacucagaaugaucugguuaaguuuugcuugaucauccauuucaaaucucuuaguacauuuuucaaauucaguuccaagcauguuaaaugugucacaauggaaguggcccacggucaaauacauuuugggaaaccuugguuuuaaaaaaguuaaacugacuucauuauuacgguuuuuuuuuucaaaagccuccaguauccaucuugaaugauccauuucccauauguguuuuaugacagaauucuccccacucccagguaauaacuguugacauuuucugaaaacuguuuuugagaacacugaauuagauaugaaaugaggcauuuauucauacuucgaaacgaaugucuuaaaccucacugggccauuuugaguauacauuacuagugauauauuuaauaacuuagugguauaagcaugcaauaacaaauuucuuacacaagagaaguucuguguagaaacaaauuuaauacuguggcuaaagaaaugaaccaaaaaaauuuaauaucuugaaauuugcuucuuagcucuguuuagaaucauugugauucacggauaguaaauugucagaguggacuucaugaaccuuauaucagacauucugaaaagagcuaaaauugccauuaaacugcaugaguuaaaauaucuuagauaguuuaaaaauacuauguagacuuggugagucagaucugccacacugagcguguagcugggguugacgacacacguguugcagugucguuaccaguuugucucuuuuagagacaacuuggcaggcagacgucuugcagauaaacaaggaaagauugucuauuuuaaauggcauaagacauucuuuaaaccagugugucauaugugguuauauagucagcauuuucuuuagugcaggaaauccucucucaggguuccugaauaaauagcagguaucuuuguagggauagcucgcaggagauuucaaaugcuguguauucaucaguucaggcuccccagaugucuuacgaacgugcucauuuuaguuuucuuuucuuuucccucuuccugcuagauacaaguugagacaauaugauuagcucuuaaagugcuuacucuccauuuuauguauauuacugcauuuuaauccucauaauauccugugaggugggauguuacuauguccauuugagagauaaaggaaaucaagagguaaaguuaacuggcuuucuccaaacagcugguaauuacuaaauacagaauugacuuuugccuuuugauuccaaagaucauauugguacuuucaugugugggucccuucagccaguuccuacagugacccugacccagcuguaaguccccugaggucucuagagauauagacagugauggauuagacccuguucauaguugcagauacaagacauagagagguuucuagcaauaauuuuuuuaguuauauauuuucauagggcuuuugauuuauguaaccuauuaguauauauuuguuauuccaguagaguuaauacauuauucaaagagauuccaguuuuuaagccuuuucuccguuugucuaaguuguucauuaugaaaugauuggcuagaauuugaaagucuuuaccuacagagagauucugacuggcuugcuuggucuuggaacccuaguuaugagugcauugucuugcuuccuggugaacuuugcccagaaauaguuaccaccucauuuuuuuuuuuuaaaugaaagcuggauaauuaacccucaagauuucuuaauuaaaagauuacuauuauaaauugacccacagggaguuaauacaauaaaauuauuuuugaucauuuuauaugaaauaauuauggggcaaucuucuguaaucuugaguugaagggguuaucuugcuuaauguuaauaacuuuugauacaccaacuaccuuuuaaaaauuaacguuuuuuuuuuuugcuucuguggaagggaggcuguauuuuguaggauuuacaguuuacauaguuauuguuuuauaugaugucaguuggauuaauuauguuuugaguggaaacucuguuugguucaaccaauauuugaaugcuaauuuuguucugugaacaaauagaaauacagagaacaguaagacaugacucuuucccccuaaguaaaggcuuagguuggaguuuucaaccugggaauuacugacauuuugagccaaauaauuguuuauguugggugggggagggccuacagcggaggcugccuguacauuguaggauguuuaguaacaucccuagcuucuaccuacuagauagaugccaguagcaccacccaagucgugacaaucaucuuugccaagaacuuugaaccucuaccuagaaacaguucauagggcucaaaaagcaaaguggccuaggacccauguaguuaacaagcuuacccuguuggagaaccacugcauagcugaacaacaugggugagacuagugucaggguaaaggagcucuugacuggagauuggccguacacagaaaacaaagugaguguuauggauauuuggggauuuaccuucauuagggcacaguugguuagcguuagguguacaccaacauuauucccucuuuagaaacagccaugcacguaacauuuuagcacaucugaagaggcacuucuauucuaauuaccuaaaauucuuauuaucuagaauuacaugcuaugaacaacagcaguaaagucagaagccagaaucuaugugauguuaucuguuuugcgaucacaguuguguucuucucuuaguuuauuugaacaaguuugugaaaaaauuuuugugcuuauguaaauacucuuugcuuagauuuuuugguagaauguaaaucuuucccacacagugcaauaccccuccugcccaagggcgagauauagauuguacaguuuguuauuucuguguuuuagggcuuauuccucuguagacaugucaaaaagacauccgucggggguaaggaaugcauuagcaauucaagcugauaaucugcauggugagaguccagauaauuuuuuccccaggucacauaggcagcucugcacaagucuguuaaacauaugcuaguuuugaaaauuaaaauaaguucccaucacucaaggcaaugaaacguagaugaauugcucugccagauugacucuuagaacuccugaugugauguggggcuagacagaaugggauguuugcuaauaaaucagggagguagugauuguuuuccuucuuuuucucccccacccccgucaggacaaacucacauucuguagccuggugcacucuaauaaugccuguugaccuuggccaugaaagcacucuagacucacccccuaaacaccgcaccgaaugugcucauccuugaaauuuacaagccuuagaaucuucccuaccuccacuccuguuuacugccuccuguuacuccuggugcuuccagucagaccguagucuuggcugugcaguaccuuuaggagcccucaaaaauguuuaauuucuuuuaaaaucagaaggaaaaauaaagaacaagauaauaaucaugaauauacaauaaugaauccagccugacuuagaguugucuuuauaccaaucaacagagcccuaaaauauagcuuuuaauguuuuuuuaagagagaaagaggcccacgaaaguuguccuggggcccccgcauccuccucauacacuggugggaugcugcucuugcuugcuuuggaauguggcagcagcucccagugacuucacacguuuauuacaaauucaaggucauuuggacgcuagccuugugcuaccuuucaugcuuccuguccgacccauacucagccugggcauguuuucugcucugaucuuuggucugccuuccuucuccuucuccaagucaaaccagucacucuuuccugagagcucuucgguguacccuugccagaccucugcauuaacacuccagcaccuuugguuagccaauuuggccuuauuugugucuccaccauuggauuaucuguccaucaaggucaggaauguuuucggguuaccccacuguccccaacuuugaauauguucacugccuggaaaauguuuaucugaauauaaggcaucaagccagaacuugcccaaaacuuaaccuaggacucaaacagcuuugaaaucuuaucuguguagagugggaacggcauguguuugauaaccaucagcauuugcuguuuugcuuagccaucaacaauccguuucuaucucuuccucauaguauuuucagcuguauuuuuguacagcagucauucacguuagguguuagguuacacugaaaucucugacaaccaguucugugcuacugaaggcuuuuagcagcaggauuaaaaaaauaguugauugcacauucgaagucucacugcucacacuguuuauguaauucuuggaguccaguuagaucaucugauuuuuaaaauguugccugaauuacaaaggaguucaggaauguguuaucaaagaauuaggaaauuaacauugaaauuuauugagcaacauagcuaauagguugucuugcuuuuuaagccuucuuguuuucuaggaggagccugaaguccguggacaaguugaacuguagcugguauuuaggaauugguaaagacagagguguggaugcuauguuuucuuuucucuguuaggaaauuacucuccuggugccacaauaaaaaauuucacagguaucuaaaguggaauuuauuuuguauuguuccacaccuuugucaauaauuacauuuucuaccuucuaguuuauuacuguuauuauuuuucaugccagguguuucuuaauuguuggcauaaguauuuauugaaugcuuauaugugggagugagagagucaggccagugcuaaagaguagggaauaaccccuagacagugaaguaacuuuugucuuguuugcacauuaaaaaaaaaaaaagauuaggaauccuugcucuauauacuagaaauguuugauguucucuuuucuucucuucaaacagagaaaacuuagaugaauacuuauaggcucuacugucaacuaacugcacccuccuaauauuggcgucugcauauuuuuaccauugucaauaucagauugccucugauguugugucacugaaacugauaguaacauuacauccaagaguaagacugcagugugauuuuuggcucuuggucuucuguucuuucggcaacaauuuuuuauaaauauagucaagaaaauagaaauaagagucuucacugcuaccuccccuucagaauuauuuucuccuaguauugugguuccugauagccuuuauuccuauagaaauggcaauucgaaaaauuccuucugugaaucugagggcucuacaaagggagagcuucuuugauagugcuuugguguaaguuauuuaagaaggacaaucuacccaggcuuaucaagcaaauaaccuggaauuuaaaccuggaguauucuuuaguguuccaagucugcaggaaaagaaguaaucuuggcuuaaacuaaauaaguuaacagaauacaauuugaacaaugaacaagaaugcuguuugaaaauuaucuuggguuuuuaugucaaguuaauauucucacugaauuucuauuauguuuguaaagcagcuuucuccuagaccaaaaauccuaguaauaaaaccacaacaguaugagaguuauaagcacacaguaaaggcugaugaguaaauguuaugacacuuugaaaggaaauaaaccagacgauauaauguaaauauccuuugugcuuaucaaaaauaagugacuucauguucuguuccugcaauauuucuguaaaucugcuaaaaauagaaagguaaaggucuaagaucauaaaucucugaugcccuuuccuuaaaaguaaggaauucuugucuuggauucuuauauaauauacuuauuuauaaucucacuuguucugauugcagguggccucuuacuaucuuuacauccaugugaaugugugugcuuugauguguacauaugagagacaagaacaaaaguaaaugucaaauauccgaauuccuguuucagugagcuuucacggaguaaauucuuuuugucuacuugccugugaucucuucuaauaugacuugcguuaaugaccuuuaagaaaucuuuuaauaaaauaaaaaauuuuauuaaaaucuuuuaauaaaaaaauuuuauuaaaaucuucuaauaaaaaauuuuauuaaaaucuucuucauacguguuacuugaauuuacucauggcaaggaccaguuaguaccauuuuaugaaaucacaagcucaugggcuugugauaaaacauauaagugcuuuaaauuuggcauugguaacggcaggccgacucacuugaaaaaugcucugaacugcucugccucaugcuggugggaagucagauggaaaugacuuucuagagaguuuagcuggccuccaagcuuaguggguacucacucuccuuaucccccgauagcugcucugagauuuuaaugcacauugaagacaauaugauaacuuaaccuggaaaauuagcauuuugguaagggucuuuaacuucauuaguauuuucauaccacuuugguauuagaaauuguaaagauauuaaaggguauggacaauguggaauguauguaccagacucagcaguguauacugacucccucacuauagcccagaacuggaaaucccgcuaacuaccucuccccauccuagccugaauugcccucuccaccuauguugguuuuacaauggccugacgccugaaagcugguagaaacuguauaggaaaauaggguugggauaaauuucugggcugacaaaggauagaggaauaugcuucuuuuuccccuuguccaaguauaucagcaacucuaagaugcagauuuaucaguauggcucuacugggcauguucuaguuaaaugguagacccacuaccucuucuggaaucuuguuuuccauuauauucccaccugcagcuuuucaaagacuuauucucuucucuaauggucucuugguucuuuuuuuugcccaugcucuacguuccgagugggucaacauugcagugggucaaugagaagaaauagaggggaaaaauaaaagaaccagaaagaaaccuguuaaguuugcacuuacuugugcauuaagcauauuagcguaagccuuaaacucuagaaaacucacuguagugcuguaaaguaccacugauaaaguaaaaguucauuuuuaugcugugucguuauuuagugaugaauaugauauugcauaaaagaugaggaucuguaaggccaggcgcgguggcucacgaggucaggaguucgagaucagccugaccaacaugaugaaaccccaucucuacuaaaaauacaaaaauuagccggguguggugacgcgcgccuguaaucccagcuacucaggaggcugaggcaggagaaucgcuugaaccagggaaguggagguugcagugagcugagaucacgcuacugcacuccagccugggcgacagagugagacuccgucuccaaaaaaaaaagaugaggaucuguguauaacugccagguguugugugagguaccaugaauaaccuggcaauauccuaacugugcagguaugaggagugacccccaggaauauaauugcaauuaaacuugcaaauuauguggggauacucuauuucagggcaauaaaauaaauuaugucuagagcucauaacucuuacacauauuuggcuaggucuaugcagcaaaacccaggugauaacugaggcuuuaacuuugggauuuguuuggugcugacucugccacauggugaaauuugguaggaucucagugcgagugucacaugaucagucugcuugacccaacaugccagaauuccauuucucagcccacucucuucucugcauacauaccuaccucccggagagggcugggcgggagccuacguguggcaagagcccucacugcuuuuguuacacagauuucaacacauauggcuugauggagugugauugcaguagcaugaauguuuggugaugaaauuugcauguccuuugcugggagaaguauaauuauaagauuuuuguauucacauagccacaugugagguaugagcaggaacggggucuauuuaauagcauuagauugcuuucagauuugaaauauuuccuuuuagaaauauauuguguaaacaaaauauguuuaauuuuuuuuaaaaacuaugccuuuguacaaauuguuuaucauuugcagaggucuaaaaaauguaggagaaaagaagcucacaaaaucaaucagaucuaaagauugcaaagauugauuaccaucuccuuaaaagcuucaguacauguguuuacaguaucauucuauuugccucugcucagauucuuuccaauucuaggacaacccaaaguguauagaucauaagccauaacugauccuaccuuacauaauacauuaaauauaaaauauuuauggccaggcauggugaccaguucuguaaucccagcacuuuaggagaccaaggcaggaggaacacuugaggccaggaaguugagaccagccucggcaacauacugagaccuugucucuacagaaaaauuagccagguauggugguaugggccuguacucccagcugccuaaaaaaaggcaacuugagaaaguuucuaccuucugaaacaaucuaugccuugauucuaucacuuaguauuuuaguuauuccuaucaaauacaugacuguguuaauuucuuuugccacaaaaaugcugcaaagccacaaacucacuccaaaauuuaguggcuuagaacaauaaccauuuauuauagcccacaagcucaagggucagcugaucccggcuuagcuuggcuacauuugauauaaaacaguagaaauuuagaaauugaauauauguagaauaucucuuguaccaaaaaugaagaggaauaauagauuuugauuuuucuuuguuguauucugugcugggugcuaaucuguccuagcugucagaacaaguagaagccauacuggaaaaucauuuauuuguuacuaucaaauuuauuucagugaaugccauucaaaccacucucucugaggagcccaguuaccaaguccuccaccuuguuagcaacauggacuuaaaugcacuaauucuagaaugagaucuuagcaaaguaccagcauuugagauuugugcaaauugagcucuuaaacuguguguauauguguguguguguguguguguucauucuagcacucccacuacauaccauacaaguagcuguauagcagguauauauacauguguauauguacauagguagguauaugucaacuguugaaaaacuagaaaauacacauuaaauaaaguaaggguugauaaacauuaguaguuggaacauugggagauuuggacuucuacuuugcagauucaguuggcugcauuagauuuaaggaaagaacuaacuuuggagaaauuuguguuugcauuucaggagagauuucuuaaagaggaaacuaccagagguuaguagauauuaacaucuagugauuuaaauuugagaaaugcaaauuagacauuuaagcuguggguuugcuucccguuuuacuugcucuaaaaguaauuuuuuuaaaagccaguaacaaagacaugcaaaauaguacugccaugggggaaaaauuacuugaaaauaauauucaagauugaagaauuaaaaaagcuugacaucuaguaccaggaaugccagcuggcuuguucugucaaaaagcaagcaugugcuuuggaauaacacucuugaguagacucuaggcggguuuugagcccuucugauuaucuaaauagauguggaagugacuuaucuugguuuuucugagucaaaugagauaaugagcaaaggccuuaguaggucuuugauuuuugccucuaacccuuuuucuaucugcauguucacaaggucaaggcugaugagauauggcaauauugagagagucagaauaggauaaagaucucaaauacuauauauauauuuuuuuuucauuuuuuuuucccuuuggugacuguaugagacaugucaguaaaacuuuaaagacaggccaggcguuguggcucaugcguauaaucccagcacuuugggaggccgaggcgggcagaucacuugaggucaggaguggcaacauggcaaaaacccgucucuacuaaaaaauacaaaaauuagccaggcguaguggugcacgccuguagucccagcuacucaggagguuaaagcacaagaaucgcuugaacccaggaggcagagguugcggugagccgagaucaccccgcugcacuccagccugggcgacugagcaagacucugucucagaaaacgaaacaaaacaaaagacacacagaaaaacuguaaagacagaaugaaagagaugaacuuuuuacaucucgcucauuucaucacauacuauauaguauguguaugguuucauauauguuaguguguguguauguauauauaugaaguuaaaagaaaacauucaccuuuuaagacuaaauggacauugacuagauuguaaacuguuuuugaggcuaagaguuuguuugccaugcauaaggcucuauuuuuuguaauuccacuuuuauauucauuuauaucaguccuagcaguagaugccacucuuacuggguccugccuaaaugcaugcuucaaauguugguuauuaauuucacgaguagugaauaacaaagacuccuauugagggaccucuugauuuccuacugggcaccagcagcaagcaugacuuacuggccuucuuaugaguggguaggaguuuugggucaacuugagaacaucuauccuuugaguaguaaaaaagcuugguauuagguuggcacaaaaguaauugcgauuuuugcaccaaucuaauaucaacagaggccgugaaaaacaucaagggaggauagcuuguaauuagaagccagaucaacagugacccaaaaagaauuucagguuuccaggagugaaauauguagauuacuccucugaaaggaauuguuuuucuccuauucgcuuucauggcaaaucauuuuuuaagccgaaacucaagcucugaaauaauuguguagcaaauaguggcugugaauagauguggcaacucuccacaaggguaaauagaaaccacuugcaguuucagucaucacauuuuauuuuucuuuuuuaauagcuucucuauuuuugcucaccacaaauacaugcacacacacacacaggggcaaagccuuggaaaauugcaauuuuccauuuuaauuugagagacagcccggucacauuaacagaacccuugacggaauagguugaauucccuucucugucccuauaaccccauggccuuggacauauccuuaccuggugcccuuuccucccucuuaugguccacuuuugugauucugauuuuaauuucaguucucuguuagugaugaaaugagcaacugcagauguuccgcuuacacuggaaauacuuuuuuggcauuuaaaagaaaacccuacagaugaauuauuccccugaaagggguucacucagauuuucuagauuaugauucuagaaaauaguucuuuacauuugacaauggagaauuuaaauguuuuaauaugaaaauguaaagcacucuugugggguauaguugaauuaugcccagguuaagggaauccaguauuuaugucaggaaaccauggaugugauagaaauaguaucgcuacaaagcugggcacaguggcucaugccuguaaucccaacauuuugggaggccgaggcaggaggaucacuugaggccaggaguucgagaccagccuggccaacauggugaaacccugucucuacuaaaaauacaaaaauuaucugggcgugguggcacaggccuguagucccagcuacuugggaggcugaggcaggagaauagcuugaaccuaggaggcggagagguugcagugagccgagaucaugccacugcacucuagucugggugguggagugugacaguguauccaaaaaaaaauacugagauuaugcaagaaucugacucgaagaaguuugaacugauuaaaaaguaccaaauacuucauuauaugaggccagcuauuuagacuagucagcgggugguucaaaugcagaaaacagauggcuuucauuagccagaaaccuuaaaauuacauaaauccacggaugcaacuaagcuauggaucugugcccucuccuugccaaacaggaccucucagcuagcaaaacagagagcuccuuguucacuuuucccuccuaguugagacccuguuggggaggaaugcugccaagccugcucuauaaggaauuuugaucuccuagaugauaacagagagaaacuuuuuggagaaagggaacacccuguuugaaaggacaacaagagaacuuguucaagaagguggcuuugcauuuaauugaaaauuguagcaacuguaggcguaggguuuccagauucacaucugcagacugguccagauuagguauauauguuuauauucguuuauguuauccccuuaagccucuuuuaaagccauuucuaaaaauugcuuuggaaaguccauuucacuucaguauucuuuauauuguggcucaaaaauauuuuuuuucugguaacaaaaauauuuucuuucuguuuuuaagacuuguagcauuuuuaaguuugauauguacgucucuguaguucagagcacuugguaaacagccucuugcuuuugaggcaauuuaugaaugcuucauuguuuuuagcugguuauuuuguucauugucaggaacacuguuuucccaugggaaagcaucuccaguuuuaugaugucaguggcaagucauucaguuuacaagaauuaccuucauauucagucuuagaaaagcauagaccacaaacggccaguuauaucacaguucucaucuuuuaaauguugucuuagauuuuugcaaaguaaucuuaacucaccuuagaauaguguuaagacauaaauagaacuaaaauguaguaguuaagugguuauauuucccaucuacuaagguauuuauauuucuuuucuuuuagaaaauaaaaauguuuaaaaaauuaggaauaauuaucuuuaggaugacuuuguaagacugugcuuuuuuacuggcagcaaauaccugccagauuucagguauuuggcagguaaauugaaucuuaaaagauuucaauuuuaagaguguccauauuaacagauccugaauaggacccuguguaucauuuauuaagucauuucuuggaggcuucacucaggaaaagggaguuaacccuuggauggcaauguuuaauguggccacauuuccuucuggcugaaugccagggaguggcugcgcuuagcaaccaggcuuuguuucauaaauggguuauuugaugcaggugaggaugccgugaguuguuugucuuguuuuaauucagggagacaggcauauguagugaaagcauggaauuguuugcagaugggcuucaguaagaauaggaagguuucugguucaauuuguaucuccaagcuaauugcucugauuuccauauacacaucugguguugguucggggggaaaaaauuuuacuugagaaacauggcuuuugugaguugauauuuauuugugaagggccucuuguaaugucaaauguaagaagaucuauacacacaaccaauuuuacaauuucuaauucaacagcuuacccuauuauugaggauucgcaguuuaaauuauuaaaugaucuccacuugaagaaaauagagcauguuaaucaucacgauucuccaaacauuuauuuuuaaaguuaauauuaaaucucaucugguggaaaaccugacaggaacugaagcauauauuuucuagucuaaacucucauuguuaaaaugaagacaacaugagacaguuauagcgccguaaucaaguuauuugaaaaaaauguuuuaaaaauuaccacuuuuugguagucaacauacacacauaugccaacagauggcauuaaaaaauggcaagaacaugagacaauuauagggucauaauaaauuuauuugaaaaaaauguuuaaaaaauuaccacuuuuugauagucagcauacacacauaugccaacagaugacauuaaaauagcuguaaagucaagaagcagggaggaugacaaagugaaaaauagaagaaaucaaaggaaguuaagucaaaagaggaaaaaaaaaugaagcauuuacuugguuugucagguagggugauccaguguauuuugccaaaaacuuuccugguuuuagcaccaaaugucucagaacauggcagcugaugaccucccucacagugagugaucccagagagcaaugaagaauugugaugcccuucaugaccuuguuuuggauguuacacaucaucaugcccuucagugaccuuucugguagcaaaggguuuguuuuuaaaagaguugcagcaucuuuaagucuaauauauacaugcucggaaguuacaccaucaucacuucugcuguacuccauuuguugcacagacagacccugauacauuguggaguuucccaggguccaugaauagcaggaggcagggacuauugggggccuucuuggaggcuggcuacccuggggagagaaauugucaauuuccucuccuugcggggaggaaauggaaucaagugcauuuguauugacaagaagguagaacgcuuuccuuagacauuguaaugaacagauuguggauaaacaaaaguacagagagaguuugaggcagaggaggagacuguuucaacagaauauuuaccagcuaugguaaaggcucauuagugucuccguacaguuaacaacaugcugccaagacuggaaaucuuugggacaggaaugaauucggaaggugaacagaauaaaguacugugggaacaauggcgauuccauuaguggauuguacauuccuuacgggcagggcccuccauagcaucugauguagggccuuauccacagguaucugauuauuauuugacuuucuuuaauguuuuugcaguguuauuaucuauacuacuuauuucaguaagauugacaacauuugcauuucgauuucuaagaucaagacaaugaauuuccucuuaaucccucaggaaagcugugaaauuuaaauuuauagagcauucuacuuagccugcugcuuugcaucugucagagaaugagaccccccaguuucauggaagucacaggaaguggcaaggggcucagauggaguugagggguucuagcuauuucugcagaugaucuggauauuuuggcaucggcugcuuugacuuaaccaucuggcaauguaaaggcagaauuucguuaaauauuggaaaaguuacuugaaaacauggcucuagagauuuugccagcagcuuuugcacucaugacuugguucaaucuaagaccuguuuuguuuuuuuguuguaaggaccuaaguccucuguuggguuuugacgaaguauguguaaaaaugacuaaaauggccagagguaucuuauuuuacauuuaugugggaagaaauguuuggaaacuguuucauuucuuuaacugaaaauuucucagugcaauuuuaguugguguuuuuccuccuguggacaguuuuuaggaaugauacaaguuaucguggaaucacccaguucuugagugugugaacgaauggcuucugcuggaaguuaauucuucuuggcaugggugucucacauuuccccagcagcuggauuugacaagggagggccuaucaugauuaauaugccuucuaauugauugguuuaauaacaccuuuacuccuguggauauauuuuucauuucuugcugaauuuuuuuuucuuuuugagauaccagaaccuguuaagugacacgguauagauauuucaggacuuccauuuucucuuuuaaaaauauuuuuguaaagguaaugccuguacacagaagaguuugaaaauacagaaggcacccuuuuucaugaaguuauuuugugaaguggucuauugccugcaaugguaauagcuaggaccccuuacuuacuacccagcaggcacuauguagagcuccaaaugagaaaauguuggcuccuugcagaugguugggagaggagacaccagcacucuuaacagacuuguuaagaguugagacugauaaccagagaauauucugggggaaaccaggagggaucgccaacauacucaguuauauuuguggauggugaauucuacagugaauuuuucuguucaaaaucauaauacagucacuugcuaacuaccaacgccauacuugcucucagugcugagagguggcacaaauauuauuuucagucuuggucaucaggcagggccuggcaggcaucaugcucugugugagucaguggaguuuauuauaagaaugcgguagccuccacagugauuauauuuauuauaggaaaacguguaauuuuguugucagaaccuuucagcagguaccacaaaaucucauaugggaaaacguguaaauuuuucaugaauaaauuccuuucgguauugguaauuuccuucucuguuuuaguauaaaagaaagcauugccuuauagguggcuaagaacaucuguagcauacauaacacuuaaucuaaaggaguguugaagaccgggcugauuccuaauugagaaugagcaagaauagaacucuuuuugauaguuaucccuguucuuccuccaagccucugccuuggagcuauggauacuauaacuaacugaagcuucuucuuucagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaaguaaguccuguccgguggcuagcaauucacguuggaucacaugcauuuguuuucaaaaaauuuaacuucuuguauuuugcaucaguauuuuaacccuacaguaaaaaucuugguuccuaaugauucaccauaccauuaauauauuuauuugcauuacccuaugauauacauauaaauguuuuuaaaauuaugaugucguauuaugaccaucacuaaacaguaguuuaagaugucacagcacuuuuuuuuuuccucacucugucacccagguuggagugcaguggcaagauuauggcuuacuguagccuugaccuacugggcucaagcaauccucccaccucagccucccaaguagcuggacuauaggcacaugccaccaggccugacugauuuuuuuuaauuuuuaguagagauggggucuccuuguguuggccaggcugucugaaacuccugggcucaagcgauccucuggcuggaccucccaaagugcugagauuacggguaugagccaccaugcucagcccuccacacuccuuucaucuucaguauauaucucaccacggcucuacagucaaggucuuuugguuaaaagugcuagcauuaauuuuuuucuguuaccagcuugauacauauuuuaguucauuuguaucuguuuguauucuauuauaguuugguuuuuuccucccuuauuaauuuuacuuuuugacuaucauguuaguucuaugaaauauacucagaaagcucacuuuucacucauucucuauugauaaacauuuucauuguuccugauuuauuuuuuuggcaaaagaaaauacauauuuuuccuucuuguacaaaaaaaguacaaaguucacuguucugcacuuugcuuuuuuuuuuuuuuuuuuuuuuaacuuaacuuuguauccuggaaaucauccuuugucauuucguggagaucuucauuuuuguuuaauucuuuguagucuuuuugcuguuacuauacagggugcuccuuucuuauucaauuuaaaauagcuggaguuccaggcauuuuaucucacacuucuuagauaguuaucucugcauugugacugcaucuuaagaacauuagaaguaauuagucuuaugcuuguuggcaaagcagaauucucgacacucauuauaaacagcagauagccuggcaacauuuucuuuuguuguaauccuuuuuguacuagaaauuuuucuuuagccuacuuggauaaugaauguuuguuguuuaauuaauauuacuauucuauugagauccuuuuauuuuaaauuguaaauacuaaaauuauuauuauuaaaagguuuaauuuguuuugauagcgcucuguuuaagaaaggacaagcucuaauuacuaauugguguuuugagaagcaaaaagcaucuacauuaucacaauauauuacauauuaaguaauuuuuaucuugaaaggaguaugaaccaugaugugaaaugaugaauaguggaaaucacuaauacuuaaguucauuauauguauuuuuuguuuuguuuuguuuuuuuuugagaugacaucuugcucugucgcccaggauggagugcaguggugcaaucucagcuuacugcaaccuccaccucccggguauaaaugauucuccugccucagccuccugaguagaugggacuauaggcacccgccaccacgcccagcuaaauuuuuuuguauuuuuaguagagacaggguuucaccauauuggccaggcuggucuugaacuacugacauugugauccacccaugucagccucccaaagugcugggauuauagccgugagcuaccacguaugguccauuauauguauuuuuacaagaacauucugugugcugauuuacuaaguauggauugauaauaaaucagcuuuugccugggugugacuuuuauaaagugucaauguuagaaauaauauuuacauucugcugaagaguucuuguaguacaauuguguagauaaguuauaaauuuuauaaaucagaacucugugcauacuuauauguuuuugauaccauuuuuuugauauaugcauacagacuauguauucugagugucaaauaaacuuuuuuuaaaggcuagaauuaaaauuuaguuuaugacauugaccaaauuguccuuuucuggugaaucgacuauuuugauacaugugucauaguuugcaucuaaguuuuucuucccuuaguuucacguaugaauaaccagauguuuucacauuuguaugguggccauaccaaaaauuacucuucuugaccccaggaacaccccucuuuucccguuucacuuagagauccuacuaaugccuggguagcuuuacuuucugucuuagccuguuguuugucccaggguguauuagucuguucucacauugcuguaauaaacuaccugagacuggguaauuuauaaagaaaagagguuuaagugguucacgguuccaaaggcuguaugggaagcauggcuggggaggccucaggaaacuuagaaucauggcaggaggugaaggggaagaagacacauguucacauggccagagcaagaaagagaaagagugugaagggagaggugcuacacacuuucaaacacccggaucucaugagaacacugucacgggacagcacucgagggauggugcuuaaacauugaaaccacccccaugauccaaucccuucccaccagaccccacuuccaacacugggaauuacaauucgacaugagauuuggguagggacacagagccaaacuguaucaaaggguugagcacagagugguucuucccaguucuggacuuuaccagauuguugguggccaccaugaguggggagaauuagcccuuugcugucaccuuccucuugcaauucugguauuaucuguccucugccuaccacccacccacggaagucuuguuggaugauacacaccagccagauucuucaacauuaggcgccauaaguaagaaagggccaaaacaucauaccuugugagccauuuuaauggauuugggcuuuauuuuguagcaacaggaagucacuagacuuuauuuuuuaucuauuuauuuuuuucuuuuuuuuucuuuuguuuuugagacagagucuugcucuuguggcccaggcugcagugcaguggcacaaucucagcucacugcaaccucugccuccuggguucaaaugauucuccugccucagccucccgaguagcugggauuauaggcgccugccaccacgccgggauuuuuuuuauuuuuaguagagacaggguuucaccauguuggccaggcuggucucgaacuccugaccuugcgauccacccucuucggccucccagagugcugggauuacaggcgugagccacccgcacccggccuagacuuuauuuuuucagagaagaggagugauuguagauuugcauuuaaacaaaucaccuucuugcuuuaucacuauguccccuaccauauaucuucguucucccagagacugccaugcugcagccucuagccgugugcuguccaguacuguagccacuggcccuaugugguuguuuggcacuugaaauguggcuaguggaaacugaugugugcuauaaguguaagauagauaccguaucucaaagauauaaugugagaaaaccuguaaaaugaucacauucauuuuuauauagguuuaacauugaaauaguuauguuuugaauauguuguuaaauacaucauaaauguuacugaguuguaacuaugugauuaaaauugauuucacuuguuucuuuugacguuucacguggcagugaggaaauugagguuccauaggcaguugcauucuguuuccguggaacagugcuguucucugugcuaucccgagccaccagugacucugagcuguaagggucuuagaucccaugaucuggcaagugggagagggagguagaaaugagucccuccauaccuucaaccagaacuucacugcauguugcaagucagggaacaaggcuuguuugggguccuuuuaaauacaucuuucauuaaauacauuuggauguaagaugauuauaugccuuucuagaacccuguggugcucucuuccuccucagacauaaugucuuuggauacuaagggugcauugaugaacagaacacagggccuguucuucaaagggggagaaaagcuuguaaaaucauaauuuuagcaaucuaaaaacuacauggugacagugacacuaauaccaucagcauugagcauucacaaagggucacaaagggucagcuacuaugcuaaguacuugcacucauuuuacccacucagugacaccuguggagaagaaccgaagaaagcaccuuggggaauugcagcauugaaggcaaacaaagagagacgauuccccaugagggagaugagcaguggccagagagauaggauaggaaguaggaggcguuacaugcuggaaggcaagccauguaaauuucuaaaugaggggaaagauaagagugcaagcaugaugcaaacggaaagcaguugaaguguaguuuuugacaugguaaaaucaugucugucaugcagacugaacacaugucaaauauuuuauucaauucauuaaugagaugaacuguaagaugugaaaaaugguucauuuugacuuggagagauuuaaaauuccuuccccagcacacuugaguugcauggcuaugaacaggaaucaucuggaauuaucuggaauaucgucaaauuauuuccaugguacaggaacacuugcauugcuauggggugucugcaguauccaucuuuacaaagcucuaaggguguggaauagcuuguaaggauguaaguaauaaggguguaagaauuuuaaggguguaagucguaaaauagcuuauuuaguagcaagucaacuggaggaacaugcuguagaaucagauaauccuuuccccgccacccucagggucugcaagacaacaccugcauuucaaugcuaggacacccagcaaucucuuuugcucauaucuuguuuuuggacauuuguaugugugugugacaaaacauuguuaggaucuggcaaauagaaggucauuguugacccuguggaauagcauggggagaaguuacguuguaguccauugcaggaaaaacaacgugggucaauggugagucagcuguggacuccuggaggaaagaccuagaggcaaaaagcuuugaggucauugaagacaaaaggaaaggcuuugugauuuugauuuuuaaauggaaggaauuugggccuaaggaagcuuaaacuaaacugugggaaggacugauacccauccuaagcacuaguugcagguaucucuuaagaacuagguuuuggccgagcuccguggcucagaccuguagucgcagcgcuuugagugagaggaucgcuugggcccaagaguacaagguuacaguaagcuaugacuaugguauucaguucuguaagaacuaggcagaaaggagauccaguggauaugugauugccugggucuuggaaaggggagggaacaucuccuuuucugaggaagaauggggagauaggguggguuaauuaggcaguuucuuuugccaggugauaaaaacccccuaaacaauuuguauuuuauauauggagaauauuuucucccacugaugggaaggaucguagugugggggaugcuuacccaauuucuuaaaaauguacacagaaaugagaucccuaggugcuggaaccgagggucaguacugccuagaauuuccccauuagggucucuuuuguuucugcuuaccuuccugcuguguguuuacuccuuuucuccugcuaagauggguguccucaaggagaccagggauguugguagccacgaccucugguaguguuaguccugguuuggcaucccaacuuuguucugcccaugggcauuaucagggagugcuucugguuggcacugcuuugaguuacacgucugcccuuggagccaccaccguaucugcagggacucaguaucaggacuagcccaucuuggccuuguggguguggccgugugauguggggagaggagcuguugccagaagagggaugaggaauggcaugggcaaaauagaagaaugaccccagugcugcaacacaguggguauggauuagaaaaggcuuguaggcuggacagggcgaggugagggagugcaucaugcauuaggauuuuaaguggcuuuuuggggaguauugagcagguggcaggggagacaaguucacucagaaguuuuagacaguguugacauuuucuuucaaauugugcaucuugaauucucuagaacauucuuuauagauauuucaggaucuuccugccacuuuccacauuguagcuauucugguguuuuucuuuuauaauuagaaauaaugaauaguucucauuuguaggcuuggauuuucaugcguguguuggaaaguguucguuuugccuuuuuuuuuuaacuucauguuuuuauuuuuuaaaccguauugauggauucauugcuaggaacggcaaggaaaagaauacucucacaauguuaccacguuuccuucucacagguuuuauaaguuguauuauuuuuauauuuucaaaguuauaaucuuaccaucuccucuguugccauacuucucauucauagggucugucuuuaacuggacucauuguuuacagcuagucuuuucaucagaucaucucaaacccuguauuacauuaauauuuugauuccguuuuguuggaugacuuucaucuuaaucauucuuauuguugaacaauguuuuucuuauuauugaacaauugcuucauuagguauagaauuccugguugauggguguuugauucagcaccaugaaaauucacgguauucugguaucugucauugggcaaauucuucuucuuuuuuuuuuuuuuuuuuuuugaaaaaaaugcguggaaaccauuaguuaccauugacagagcuacucauuuaaugauuuuuuuuuucucccaauagugguggaugaauuuuuuacuuugcguucucacuuugugucucucaugaccaaaauauuuuagagauaacuagcuggcuaagucugagguggcuguuaacagucugguccuaggauagaacaaaaccaacagaacucaucaccgucacgucguuuugacuuuuugcucacaaguuuaacucauuguuuaauuuguuuuuccaaaggauugcuuugcaguauacauguuggugcauagcuuaacaugaugauaaauacauaacuuugacugugaauuaucuacucugcuccuuucauagucucaugcuucucugaauuuguauuuuguguuacuggguuguuuuguuguuaucauucauaguguuuuuuuugcccuugauucuuugaaccagguuuuggucaagggcaagguucaagagaaaaaguaaaaacacagucuuuuauuuuugcucuugguuauaaacccuuguaaaguuugauugagaagauaacuuggaucuuaugguuuaaauugagucuuuguuuaaucccaagucuuccaaauucuuugugcuuauguauucuuuccucuuucccaaucguaauaguuuugcuucugccuagucauuggucaaauaccugccuuucaaugcauuuaaaaaauauuuuguguuagcaccauuugagauuuuuccccccuuuuuuuucaaguauguauugaggacuguuaugggaugaauguuuguguucccccaaaauuuagauauugaaacccuaaccccaggcuauucggagaugguauucggagaugauaccuuugggaggugauaacuguuagaugaggucaugaguaugugcccccgugauggaacuagugcccuuauaagaaaagauaccaaagagcuugccuuuuucucccugcucaaacgaagaagucacauaaggacacagcaaggagguggcugucugcaagcaaggaagagcggccucaccagaacucggucaugcuggcaccuugguuuuggacuuccagcuuccagagcugugacaaaagacauuuuuguuguuuaagccauucacaguaaggcagcauuuugagcuaagacaaagaccuacuguggcuucuguaggcaaaagcccuacagacccaaaguguugugagaauuaacauuucuagggaucaugccuuacaguggauuuuauccaacacuuagcucugaccuagagcacgcuagucgucguuagguaaaugcuuguggaugguaguuucuggcacagagauuggagcgguaaugggcaggaguucuguauccagcuuaugcugagagagcuucccauaaaauggagccuauacuuuccuuuugcagagaccauuucuauccauugauagaauucuuuuuuuucuuuuucuuuuuuuugacgggaucucacuccaucgcccaggcuggagugcaguggcaugaugucaacccacugcaaccucugccuccuggguucaagugauucucaugccucagccuccugaguagcugggauuacaaggugcacgccaccacauguggcuaauuuuuguauuuugguagagaugggguuucaccauguuggcuaggcuggucuugaacucuagugauuuaccugccucggccucccaaagugcugggauuacaggcaugagccacugcacccagccuuccaucgacagaauucuaaagacauguuuaggcaagaguugguggaauguuggcguguaguccagauuugccuucaguuuguuuuuauccgcuucaaaugcaaaggccaugauaauucaauaguaaagucauaaauccauaguaugacuuaaaauauuugguuguaauauuacaaaguaugcuuccaaacacauuaagcaugcaaaauccuuauauuguucuuuuuguuuaguguuuaggguaguuugugugaaucauagaugaccacaguagacuguugaguuguuauuuucuuuugacauucuuugauagaaaacagugcuuuuccucuguuauuuauacuagaagcaaaaaguaucucucauagcauuauggaaacaacucgaauacaacuacgucaauuauucaucuuuuuuuuuuuuuuuuuuuuuuuuuugagacagagucccacuccaucaaccaggcuggagugcaguggugcagucuuggcucacugcauucuuugcauccugggcucaagugauucucgugccucagccucccaaguagcugagauuacaggugcccacaccauucucagauaauuuuuguauuuuuacuagagaugggguuucaccauguuggccaggcuggucucgaacuccugaccucaagugauccaccugucuuggccucccaaagugcugggauuacaggugcgaaccacugugccuggcaguuauucaucauuuaacagcauaaaguggccacuugcuuuaauaaacuauuauaguaccaaaauuuuggccugaggaauuuauaaauauaaauagaacaaaacaaaaauaauauuccccuugaaacauauucuaaaaccaggggcuaaaaguuagaauuguuagauuuuauuguccuguuucuuugggaugaaaugaaauuuuuuaaaaaccauaguuuuggccgggcgcaguggcucacgccuguaaucccagcacuuugggaggccgaggcgggcagaucacgaggucaggagaucgagaccaucccggcuaacacggugaaacccugucucuacuaaaaauacaaaaauauuugccgggcgugguggugggcaccuguagucccagcuacuugggaggcugaggcaggagaauggcgugaacccgggagguggagcuugcggugagccgagaucgcgccgcugcacuccagccugggcgacaagagcgagacuccggcuccaaaaaaaaaaaaaaaaaaaaaaccacauaguuuuacuuaaaccaaaggcuuugggauuccagaagaauaaaggaaguguacuucaauucuacaucucaagaaucuauuucuucccaaauuuaauacaggcaaauuuagucuauauuuauugggcacuguuagguuuuugugucagguguugcugaguggcgggauaccauucuuggcccauaaggaccuuauaaaucuauuaauacaauuaaauugugaagaaaauuuagaaaauugcaaagguagaaugagguugcaaauuggagggucuuauucuggagauagguggaagcuauggcagauuuuuagcaugaaugcuuucuggucaagacacuuuuagaaaaauuagcuuguuuccaagaguagauuagauuggggagagaaggaauucaaauuacaaaauaauagugugaaaagcauugugggagaucauccuguccauccccucauucaugauauccugaggugcuguauuaagggcaucauugcucuuugucacccgagcaguccaggaaggcugccuguucagucuuagacuguauccucacagucuuaaaccauauccucacuuuaugauagaaacacacaggcaaguguuguaagaguuacauauugucaguuaaacaagaaauuggaugaguccccauacuauucuuccucuuuuaaagagagaacuugggccgggugccauggcucacaccuguaaucccagcacauugggaggccgagucgggcuggugacgagaucaagagaucaagaccauccuagccaacauggugaaaccccgucucuacuaaaaauacaaaaauuagaugggcaugguggcgcacgccuguagucccagcuacucgggagacugaggcaggagaauugcuugaacucggaggccgagguugcagugggccgagaucacgccacugcacuccagccuggcgacagagugagacuccaucccaaaaaaaaaaaaaaaaaaaaaaaggaaaaaaaaagagauaacuugaaacaggcucuuccagccucucuauucuuuuaauaacaugcagugcacuucuuggagcuaggggcuagggucuaggggcuucuugaagguguugaugucucugguaacuuacacugcagggcaggucucuggagggaacuuugaacagguuaagccucaaaugcaggcagagauuuccaauugggaaaguuaggugaacguggcuuuaucaucucuuuuauugguuuauggguauuuucucuuuuuccuguuuucuuucccaccauuuaacauuaucuguucucugccuuuuuaaccuucuggcuuuaaaugaacaguugcuuaaucuauagauuaacaggaucagcaaacaaagcacagcagugccugcacaaagcagaaacugccuguuagaugaguugagcaaaaccauuuccuuugcccaacuuucuccucuaaaauacauaacugaacaugggauucccagacacgaauuguuucucaaccuuucuuuuuccauucuacaguuguaugaaauuaaaauuaaauaaaaagcaaacaacagagguagucuuuuuaaucuuaccgaguuggaagguauacuauauacauuauccuaugguagaaggucugguacauucuugaccauuauuacuuugcuaugggcacccuucacccuuguaggcugaaaauuggcaaaucauaggcacguauacauugugguuuuggaauuugaaagaucucaaauucauauugagugagacaguuuuugaauggagggaucaggcugucuauauguggauauauuuuaugcauuucuggucuguauaaauguaaggauugcuuuacugaccguagauuucuucuaggguuaaaaaguugaaggcaguuuggauauuuuaaaauaagaaaauuagcccuacauugaaagagagaauaggaaaaucuaggcuauguguacacaucugcuuguguuuucacaauuguguccuguccuauuuauuuuuauuucucucccaucucuucccucccacccacaauuuguuuuucauucaacacuuugaaauuagaauagcuuaucuaucaaacaagguucuuugacaggauuuuccaacucugaguaugaaaguguggauauaacaauauauuuauauagaaugucagaagcagaguuuggccagauuauugggaaauauucuaacgcccugcagcauuuuaccgccuuugcuuuuacauaaggccaucauuuggaaacauagcaugcugauaccucccauuauugcaguagcguuucaucagcugcacgcugccucucagcgccucauuaaguugcaagcagagaacguuuucguuuuccaguucucuuucucaauuaaguuagagauuguauuuucaguauuccucauuauuaaaagaauuuuuguugagaauaguuuaagaugugauauuucuuuguauuccaggaaaauuuaaagaaugucauugaaauccagaaacagaaguauauauugucuaggacaugcuuugucuugguuuauaugccuaaguccgaguaguuuaaaauuuaugauuaauauacucuuugaaugcuuagaaauggcaucgauuuuaguuguucuaguuucaucuuaaauaaauuggaguaauuacuaacucaggauuaugaugugcuacacauaaaacauuugcagugaugucugguacuuaggaaacccucaguuaugacauuuuucuuacuuucuucuuggauauguucuuugaaaaagggacugguauggaaaagcuuugagacgaugaaaauauacaagauaggcuaucucugaaacaauuugguauagagcauuugauucucuguuucauguauauauucauauaugcuagcugcagucaugcagacacaauuuggaucuggguuuuuuuuuuuuuccuuuuucacaugcaguuauaaauuuagaaaccuggcuguuuccucuggacuaaauguauuuauuuaaauuuucagugcuuuaaaugcaaaauuacaagcauauguacaaguagaaagaauaguaaaaugaacccucccaucuaucugucacugaauugcaguaaugaucaaaucuagucagucuuguuccugagucagucuggaaugcagguuuuuucccuuaacuauucagguucuccagcaauccuggcaaaacacaugcggguuucagcucaucucuuucagugaccuguaaauuaagaugugcuaaagcaucacauguuacucauugacguuuuguuaauauauuuaaaacauuuuauuaguaccacauaauuuuuagcguuuucaaaaagaaauaagaauuuggcuaaaggugaauuuuaaaaauugaaugacuaaguagaaaaguaggcaaacuguuuucagaauuaguagcaauuuccaauuccauuuacucuguucauuaacuuuguuuucagccuuuuguuagccauguuugauuuuguguuuuugaaauaccuuuggucauuuuaggacuuuuggcauuaaucaccugucuuagguggccuguuuacaaaagggacuuuucgguucuccauuugcccuuaauguugggaauagagacaaaguuucuguaggacucugacaacauauggcuuuacaaaguuuuuuuuuaauauauacauuucucuucuuggcuuucuuaaauaucaucaaugucuuuucuugcuuuacguauuuagcaacuuaaaugucaucuugucugagaucaauauauuuccaacuuggagagauagugagaagagagacuucagauuuuuaaaauguggaacaaaacauucugauggugaccagguuuuaagguauuucuucaguagacaaaacuacuuaggcuaccgaugauaagcuuuuaauauuaauaauaauuauuauauauaaaaauauuaauauaauaugaucuaagauuguuucuauucccccucuuuccugguuguuaggauuuggaauuucuuaugcacucuuuuuuuuuuuuuuuuuuuuuuucugagacagagucuggcucugccucgcaggcuggagugcaguggcgcgaucucggcucacugcaagcuccgccucccagguucacgccauucuccugccucagccucccaaguagcugagacuacaggcgccugccaccaugcccggcuaauuuuuguauuuuuuaguagagacgggguuucaccauguuagccaggauggucucgaucuacugaccuugugauccacccgucuuggccucccaaagugcugggauuacaggccugagccaccgcgcccggccuaugcacucuuaaaauuauuucauguacugauacauucacuuucaaugauaaaacauggcuguaugaccagguagguaggcugcuuuucagacuccuguacuaacugaaugggccccauuagcccaagugagagcuuaacuugucacucuuccuaaaugccuuccucagcugagugcuuauuuacaguaaucuacugcuuauagcagaugcuaugauuuguauaagcuguccauaucuacuuggaagaacaauauugaaaggcauugagauacuuacuuucccucaaaagcccauaauccaacaacuauuuagaauaucuuauuuaagagauagguuuauaauacccaaagggaacuuaauguauacugaaagucccugauugaauggauucugaccuuaaccagaaauauuaauuacaugcuuaucagacacuuacugugcuaucccaggguuugccacuguugagggaacaccagaugaaucauauugucccugccuucaaggauuauauauucuaauaggacagacagcccaucagcagaauaggagguagcaaguggucagggaucagauaaagugaucaaggcaaguggaggaugcagugguaggacagaauggucugcgcacagagauugagggcaucauguggugggaauuagugaacuagcaugcaagccgggccuuuuucuuggcuuuuguucaauuggaaggagcauaaagcuacuaaaggagcuuauguuuagaaauagggcuuauugaaggggacaaggcaucuccuagaauccaaaugcacaucccaagacuuaaaagaguuagagggcacaggcaggcccugucagauccggucucugccagauccagucuugucuguuucucaucuucccuugucucucugaguauucccuguuuuccuuuccuggacuaacugcuucuuccagaugccuaguuugaguccacccaugguuuuuugggggcuuuucuuuguuuuuuuguuacguucuguuuuuguuuuuuguuuuuuugaggcggggucucacucuguugcccagacuggagugcagugacgugaucccaguucacugcagccucgaccuccucgcuuaagcuguccucccaccucagccucccgaguagcugggacuauaggcgcaagccaccaugcacccauggguguugacaugccaccuguggcucagacuuaugcucaccuccagucaaguuucuuccuuaucuaacgacagccuuuguguguucgugaaagcccuugagggaaagaaugcuacguacaguuugguuuucuugggcucuaauaagcuauaggggauggugcugcagaguuugaaauacagucacuaaugaguccuccuucagagagcugagggugggagcaccacauaaaaggaguugggggucagcagccuccugauagucugaaagccaaagaugauggauguggggcuccacggggaggcuauaacaugccacguuauguuuucugcccuugaggaaagcuucuuuucaccaggcaggcaguacagauacaaacuuaauagcgaugugaggcacacugauaaauaccagaaaacauucuguaagagggguuagcauuauuucacugugugcagaggagguuuguccauguggggggacccuaaugggcguaggcauuugaaguguagucuaagggaucuuagguaagaguguguuuggaacacaguguacguauuuauacagcaaaugcucuguguggcuauaauuuaggaaaauuuguaggacuugaggacagcuuauuuuucuacuagcugacagaggcuuggguuugcuucugcuuuaaguauaaguaucucgaguccuuuuuuaaaaaggaaaaucaaggaaauaguuggaauuggguuucacauaaaaaacauuuuagaaaagaaggggaguaugagaguuaggauuugcuaauguuugcuguauuagcaaauuauuugcaaugcuugucauauuagcaauacauguauguuuuggaaaacacaugcaaauuaagcagcuuaaggaacuuuuaucuuuauuuccuauguaagauuugagaugcugcaaagaaaauauuaaaacauugaaccgauacuuacaguaguccuccuauaucugcagaggauaacuuccaagacccccagugaaugcccgaaaccuuagauaguaccaaacccaauauauacuauguuuuuuuccuauagguacauaccugugauaaaguugaauuuacaaauuaggcacaguaaguaauucacaacaacuaauaauagaauagagcaauuaugacacuacgccaccaucacuacucuugcacuuuggggccguuauuaagucaaauaagaguuacuugaacacaagcgcugugaugaagugaucaauggcagguagcauguacagcauggagacgcuggacaaagggaugauucacuuucuggacuguguggguuugagauuucaucacacugcucagaauggugcgcaauuuaaaacuuauuguuggcugggcaugguggcucaugccuguaauccugguacuuugggaggccaggacaggaggaucucuugaggccaggaguuugagaccagccugggcaacauaggaugacccuaucucuuucuuaaaauuaaauauaggccgggcacgguggcucacgccuguaaucccaacacuuugggaggccaaggcggguggaucacaaggucaggagauugagagcauccuggccaacauggugaaacccugucuuuacugaaaauacaaaaauuagccgggugugguagugggugccuguagucccagcuacucaggaggcugaggcaggagaaucgcuugaaccugggagauggagguuacagugagcugagauugcaccacugcacugcaaccugggcgacagagugagaguccaucucaaaaaaaaaauaaauuaauuaaauaaauagaaaaauaaaacucauuuauuuauagagcuuucuauuuaauauuuuuggacugaaacuauggaaagcaaaaccacagauaagggaggacuacuauaguuaugauaaaaaucaggaacuuaaucuagccacgagaacauuuguauuucugaugaaauuuuuauucuugucuaaaauguugaacuauauuuauauuuauaucuuuaaauauaaaugaacuauauuuauaucuuuauaaaugagcuauauauuuauauuuuauauaaauauaaauauuuuuauaucuauguaaacauaaaaaggcuuuuuuuccucucuggauguuuacugggguuauuuaauaaaaaccuagggaugauauugggaauuuuuguuggaauuuuaaauuuuaacguguuuguuucuuuuuuuguuuuguuucguuguuugcuuucugagcugggaguuggcugugcauguggcaguugcuuuaucaaaagggucuugcucugcuucagaagaaguuuuguuaccuugauugcuaauguucucccccuuaaauaaaccuccugauguuggaacagcaaaauugcauuauguuuggaaaaucuaaauuaauaaucccuuaucucugaauaaaaguaacugaaucagguugaauuuacugcuuccauuuuaauaggacaguaggaaaaaacuaugcaugggcuuuaugugguucaaauuuuuuuuuuuuuuuuuuugagaccgagucucgcucugucaccaggcuggagugcaguggugugaucucagcucacugcaacauccgcuuccuggguuccugcgauucuccugccucagccuccggaguagcugggacuuaacaggcgugugccaugacgcccagcuaauuuuuguauuuuuaguagagacaggguuucaccauguuggccaggauggucuugaucucuugaccucgugagccgcccgccucggccucccaaagugcugggauuacaggugugugccacugucuccggccugguucaaauuuuguaaucuccacauccaucugcauauuaacaauugucauuguugguguuauagagagagaagcugaagcacagaaaauaacacgcauguucuagauuuccuggugggaacuggaaguaaauucuguguuuggcugaucacuguauaaaguucuaguacuagucuuuagggaaaagccccgucuucauggauuuuaauuugucaauuugcaauucuaccuacuuggaaauagucaaccuaaucaguuacugcccuguugcaccaacuauuaccauaggaaucugaagaugguaugcaaccaacaugaaaaagagauccuuuucuccugguaaucaguuuguacccuacaaacaauucguugguuuuaaguuguauagagggaaccaugaugugaauaugccugccacuggguuuauagaaaaccgaugacuccugaggaaauucucagcaggguugucuuucagugaaaagaacccuuuagaaagaugcaguaacucacacuuuacugcacauaaagucaugucccucaggguggacucucaggugucauacaguuuaugacucaugagugcugcagcuuugugaucuaauaaacaaguaaagacggugggagaauuauauuccuguacaaaaagccacuucaccuuucauuauauaggaaaaaagccaugggaauauuaaauuuuuaguggcauuuuuagagcauuuucugugaucuaaagugccugcauugagauauuaagauacuuaagaacaaaguaaaauaaagagaaguauuaauagcaggaucccuuuggagcuagguuacuguggcagugguuucaagaauaacucucucagcacccaccccaggauucugauuuagagauuucuuuguguguucucuuagcauauaccucuaccacugaguuuauccccugcugcuacacugauugauaccuuauuuuuaaauuuuuguuuuuaaaauagacgguuuuuuagagcaguuuuagauucacagaaaaguugagaggaagguacagagguuucccauauacuugcuaccugcacacaugcuuagccucuccuauuauaaacaucccccacagaaugguacauuuguuacaaucgaugaaccaacauugauacaucauuagcacccaaaguccauaguuucccugaggguucacucuuggcgguauacauuuuuuggguuuggacaaauguauaaugacauauguccaucauuguaguaccauacagaguaguuucacugcccuaaaaaucuucugugcucuaucuguucauccucccccugcccccaaccacccaaacccguggcaaccacugaucuuuuuagucuccauaguucugccuuuuccagaaugucauauagugggaagaaugucauauaguauggagccuauucagaugggcuucuuucacuuagcaauauuaguuaaguuccuccaugucuuuucauggguucauagcccauuuccuuuuaguguugaaugacauuccauuuucuagguguguaccccacaguguuauuuauucauucacaguaccuuauuuuuuaacugauuuuuuuggggucugggacuaaggugagguaaacaaggcagucaggaauugagauuaagaauuuuuaauguaauauuuuuaaaaaucaaaauuacugcaaaaaaacuccaugaugaacaaaauaucaacuuuuuagacagagauugagucacgcucaauugacaucaagccaugcauaguucuccuacugccuuauuaaaauggaagcaguaaauucagccugauucaguuacuuuuauucaaagauaagggauuauuaauuuagauuugucaagcccucugaaugucauggacaauugugagugaaauuccguguaucgucuaacuccccauggauguuaucuugcucagaaaccuuguucucccuccaaggaaggcacuacuucuccuguagccuucucaggucgaaguucuuuucucaaaauccucacagcguugccccuagaggugggaauguccucuuuuccucuucauuuccucuuuuccucuucauuuuuguuuccaaaccacucuuccuuucucuucccuaaaagccccccuaccucagcuugaagugcaugcuuucagacaaaucacuuugcuccuccaccuguuggucaucuccagaccucuuucuaccucaucgauguucaccauucagacuuugaagauuuuagcuccugccuugcugucaucagguguagcugcuucauuugcugauucuuaagugauccuaauauugaucucaaugauccuuccaguauuccaauuugucaguucaugauucucaucccuccagugaccuuguuuucaucauucuccaucacccauugcuuacaauggucauauuauacuccuugcaaugaccaaucacugcaacuccuccaaaauuuuaauuucaauuauuugacucuccaaguacuacuuauuaccaccucacuuucuccaguccugugcgccauacauucuuuagccccuggagugugaucaguggacucagauuccacuggucccuaccaccuuuuaccugugucuaauuccccucauguucucacuuuugccacuugagauugcauggcccagcauucuaaucauucccuugcuuauaccgucacuucucuauucguuguuauuuaucuggcaaaacaaccacccuguugcaaugcaagguuuaugcaagggaaugcacauuuucgaaauagauuuuuauguuuauguuuuucuuucaaaucucuacucauuaauaaauagaagugguuugauauuucacaaaugugauuuaauugaucaaguuucacauuucauucuaagugcucaguuaaacaccaugauguauucacaacaguaaucaaagcaaggggcuguaguuaguuauaggagcaaagagaauucaugaguuuauuuuuaucuaaaugacacccuugauaacuuuucgauaaguuauuuucauguaaauuacuuggaauaagagcaggauuuuuauauagaaagcuuucuaugugucauauccuguaaaauguuuguccgauuagugagagauagggggagguugaauuuuacuaaacauaauauccccagccauaucuacuguaacguuuguuuaggacauuacagacuauuauccuacaccaauuuauuucacaucaaaaaucaccccaugcuuguaagaauccuccuuucccccucuuguuucuauuuuagcuccccuggaaaaauaauauuuuaagucuaaaugaguacaauaaauuaaaaaguugcauugcuuaauauuuugaauggaauagcuagaugcuuguucauuugcuaucuuuuucuuuguacugaauuucuuuagcuuggucagagguagagcaggcuugacucuuaguggauagugguauagguugaguaucccaaauuuaaaaauccagaguccgaaaugcucaaaaacccaaaacuauuugcaugucaacaugaugcucaaaggaaaugcucauuggaguauuuuggauuuuggacuuuccggauuccagaugcucaaccaguaaguauauaaugcagauguucuaaaaucggaaaaagucagagaccuugaaagcacuucuggucccaagcauuuuggauaagggacacuccaccuguaccuuacaguggaggcuuguuagaugcuuguaaaugccagccccugccucaaguaacaauugauucuuuuugugugcucucccaggucuacccugaacugcagaucaccaaugugguagaagccaaccaaccagugaccauccagaacuggugcaagcggggccgcaagcagugcaagacccauccccacuuugugauucccuaccgcugcuuaggugagccggccggccguggggcugguguugauugggggccuggucuugagggaagaaaaagaggaugcuccuguuaggucacauacacagacuuguucuucagcacauugccacucuguguuguacuguguuuuggacucuugcaguuacauucugugcacugacccuauaggagcaguauuuuugaguucccugccucagaaugaauuuacccaggguguauauugaaauuacaaauuccugggccaguuccaggacuccugaaugaaaaaugccuauaguagcggauccgggaauucuuauuuuaccguaucgcauagaugauucucaugaacaggggccuuguguguuucuucacauagacuuucuagaagaaagaaucuaaugugaagcugcagcauuuuguuaauuucuaaaaaaaaaaaaaaaaaaaaaaaaaaggcuguucuacaauaacuacuccucuuauuuggugauaguagaggaauuggaauugggaaggcuuuuuuucugcuuacaucaaacuggaggaaacagucugauuacuaauguuuaauguuuguuuugucacaaaccucaaauuuaccucaacauuuuauuuaaaaaaauugaguaguuuuaugugguaucgugcucuuuuccucuggaaacugucauacuccauauuuaaucuaacuugguuauuagucuguuccuaguuguuguuuuuaugugaccagucauugcagaagucaaguucuuugcucugguaucuuacaucuagauguuuuccacaaguguauucaucaguaggcagguuguaaauaaggauauagagauugucuguggagauuguggacaaauauugauguauauucugaugacuucuuauaaagguuaaaaggaauauuucaaagaaaauccaacagcaaacuuacaaaguaaggauauuuacugaagauuccggagaucuauguaauauauggucaaaaaugaauguccuaagagcauacugauugcuguucauucaugugcauaauuugagacauaaaaugaaaacacugggcauuagaaagaagauuucaccuggugaauuuacuuacaauguaauugaugaagagaguguagaaaacuagauuucuuaaacaucugauaauucaagaguuuccuuuuuccuccuuauuccuuguuccuauaugcuuuauaaggccucaacucuuuucugguucaucaaaaagugcaguuuaauuagaugaaaauaagcagcacuuaaauucuagauacagaacuccuacucaaaaaaauauagaagucaucuguccccaggaacuguguauuuuauacucacuuaguuauuacaccaagaaauaacacacagagauugaacaauucaguacaaguuaggaaguagaucaugagucuguuaauuugaugggccaggcuuuguuaaugauuuguuucuuuugguucuuacuuaccuguucuaugaaguauuccaaauauauuuucauuagaauguaagcucacugagaacagguagggcuuuggaugggcauuauugcuccugguaugacacucaaaacugcagucauguuucagaagugaacuuaucauuuuacauagauuuuucugcuucauauucuauucagaaugauuuguauuaaaguugauggaaagaugaaauccacauuaagauuguuauuuacuaccuagugccaguuguuguagcaaauauccuuugaaccccaggucuauuuuauccuaucuguugaucacuuccuuugccccugcucuucaagccuccucaucucugaaaagcucuccuuccacugggugugguggcucaagccuauaaucccagcacuguaagaggccgaggugggaagauugcuugagcccagcaguuagagaccagccugggcaacauaaugagaccccgucucuuaaaaaaacaaaaacaaacaaaaaaaccuccaagugaacgaacaguacaacaaguaauaaaggauauaaaagauguucucagaucucaauaucaagucagaagauuuuauaauaauauuauaauuacacggagacuguccaaauauuuguauuuguugugcuacacugcauuaugcaccauuuagggaaacaacagccuaaguaaugugguuuuaaauaauuaaucucaucuaccaaauaccuguuugauaguaaaguuaaugaccuguccucaccuuauguuuuuaaccauuauggaaagagaaccacuugaaaauauaucauuccacugacagauaauuacccagcugugaagcacaggcuggagacuggcaaggagaaauggagagaagccuauaaaauaauucuuucucagggaaggaguuuauuccugccaaggcuuugccaucaaccauuaucagauuucucuuucauccuccgaacagauucugggcuccuuugauguggagguacauaauucaaaaaguugggucacuugugacauguuaagcaaauuucucaguucugguugugucugaugugaaaugagcacguugacacuaacuguucuugacuacuaugggacuagauaaucauuugcuauuuccuguagguacuuggcguguugaaucauuuuaccauauuuucucauuuuaugaaucacugguccuuuuccauuggaccugaaauuagacccuaauaugacaaguagagcauauguugucucuuacuuuguuauuaaccuuagauuagaauuaaggaauauaggugcugcuuuuuucuuagguaguggcaaauuuuccaaaggucucaagcccagaguauaauacagaguugauaaaauaaccugguagaguauguagagcaugccuugucuuucaggaaaaggaacugaaaaacauagguuuuccaauagguguaacauagguaacauagggacauagguguaacugauguacauuuuacuugcacuuaauagacaggcaguguuaguucuucgucucucuucacaggcuauacaacuaccaagauccagagagguugaauuucuugcuauaacucacagcaaauaaaugggagagucagcacuacaguccaagcucucuugauuauugguccaguguuuuuuacaguauacacaaaaauuuguuuuaaaacaaauauucacuaugaauuagagacaauagcacuaaaaaagaaacucacagcuaucguuguguugacagaggagacaaccaugaccuaguauaggauaaaucuccaugugauauguuuucuacuuuauaguaguaguagguaacauucuuacauauuauuccugcuuaacaaagaauuacuguucagcauuaacauaaguaugcucuaaaaucucuugacuguauccaaauauauguuuuagacaagaguuuuuuuuuuuuacugaccuagcaaacaaaauaaaauuaucuuaaacauuaagcguguuaaaauucaaaacaaagcuugaagagagaaaaaugcuuguuauguguggcauacaaccuuccuaaccucuuuaucagaugaaggauccaguguggcacuggauuauuuuucuguaauauuuugccucggacauaugugcuauacauuucuugucugcauggggaaaguaugucagguugcuguugccacuuucuucccauggaguggauaauuucccuugagaauaaguuggcuuucucaucucacccuuugcuuuugguaguaccucuggaaccagaggguaagauucaucuuaaucaugugaacauuuuauuaauuaucucaugugugauucaagcacaucauuacuguuacucaaggagaauauuuucuuugcaaagcuuucaacccuuuccauuugaaugacugcucuucaugguguaauagauccacuguugaaauuggcacuuuucuguacuugucucugaccagcaaaggcaaggaacauugcguaaaauaaauuacuguugaauuauuggggcaaagucagguuaauagcuuaauccaaaaaaggaauuacaagugaaagaauuuuaccuuaaaugucauucuguuucauuuuguaauuaagaccuuccaaauguguaaguaguaaugaccagaaaucuuaucagauauggucaaaugagaaagguauucaauucauauuaauuuugaauuuuauuguuuuaauacaauuuuaggaaaagcaugccuuguuuucuggguuucuuggcugccuuuguaucaauuaucuacagcuaucuucuuuagcauggaaaggauguauuugaauacugugacauuuuauaccaggguaauucuuugaauuuauguaaacaacaacucucuugagacacaucaguacaacacaauagucagaaaugucacaugagaguucaccaaacuuuaaagauggcgaugaggauggaaaaacauuuuuauuguagacuuuaaggaucuuguaaauccccguauguaauccagugugcuagagaauuggugcccauggcgccuccucuccccaccgaccugcacuguggaaauccuacuaauuuugaagucaugggagaugcaugugugggaccuauacaugcacugugaugagaaugaugacuucaucauucucauuauuuaaugagcccagcugcugcauacaagaaggaugcaaauucuugaauguucuugauuguuuacaucauggucucauaaggaaugaccagaauugcugggcauuucuucaucaggaaaggcuaaucagccauccuuggagagacaucagacuccuuuauauguggccuucccaugggaccuuugaauggucaacguuaaucaugcuucagaaccagcauacuaaguaaaagaaaacauguccggaaaagaaaucuuaucaguguuuaucucccaacagugggauuacaggugauuuugauuuuauuuaagcaauuuucuaugacuuuguauaauaaaugaguagcuuuuauaaucagcaaaagauagacuaugaaaucaguacauauaauuuuguauuuguauguaguaccauugaaggauaauagaaaaaagucaaaagacuugaaagucgacacagaaugaucauuaauuuguuuuaucucuugguaguuguacuuuaugagcuuuauacauacaguaugggaaaauacacuuuaguuuugaaaacaccaugaugccaaaauaaaagaaaauaacguucauucauacgaucuucaacaaaauuuaagcagcauuaaucaucacugauucuucaggaagauucuugaucuuccuuaauuuuuuuucccuccaaaauugcauauggcagccacauuuguuucaggccagaaggaagaaugggaagagcuuacauuuaucucacagauuccuucugggugaggaagacuuagaaagugaagcccucuuccauuugauuaagcaagaacaccuauaaaaauggugucuucggccgggcgcggugcucacgccuguaaucccagaacuucgggaggccgagaugggcggaucgcaaggucaggagauugagacugucuuggcuaacaacggugaaaccccgucucuacuaaaaauacaaaaaaauuagccaggcguggugcgggcgccuguaaucccagcuacucgggaggcugaggcaggagaauggcgugaacccgggaggcggagcuugccgugagccgagaucgcgccacugcgcuccagccugggggacagagcgagacucagucucaaaaaaaaaaaaaaaaaaaaaaaaaaaaauggagcccuucuagguaggucauccuccauggcucacugcagcacuuccuuggcccugucccaaguuccauaauugccucaauugcauuggcuccugcuugauuugcuuucuaaaacucaggacagaggaugaguugaggagacugacuuuuuuaacaaucgcauuuugaaaagaaggaagcguagugguguuucuuggcuccguuuccaguuuuguuucuuuucauuuuaauuauuguaccugguauuguguccucuuucugggacuuuuaacaacuaauguuuugauugauaagagcucuaauagcaugggugauuuauacuucauuacaucuucaguuuugucuucuuuacuggaguuguauucaggugucauuaaguaacgaggcauuaaaaagaaacgauaacuuuugaaaaacugcuguuauggcuuaugagugggcuuugcugauauuuucuugaagcacagaauuuaucuaucucuguagguccuagaugauaggugagaaaaagaaacccagcuuauuuggcaugauauugucccaaggcuuguuaguaauugcuuugaaaaaugaauagcaaggcuaauggacaucugauuuguaguacaugcuaagaauugcaaaugugugcucaaaagaaauuucucugauuacaaaaguaacauauauucaacguacaaaguugagaaaauacaaccacuagcuaaaaauaaucaaaaccauuuggcuuccuugcagucuacauuuuuuucauguauguuuugcuuuuguuuuuaguguuauuuaaucguuuccuguuuugugacuugcuuuuuacaccuaacauuuuuagaauacucuaccugugaaauuaaauauucuuggagagcauaauuuuuaauguagcaucacaccagacacuguaauguguuuacucuuuuuuauggucauuuaggugguuuucuuuauuuuguggugguguaauaguuguuauaaaugaugcugugauaaacauccugguagauaaauuuguguuuaguugauuuuuauauaacaguuauuggcggaaugccuugcaaaucuuauaguugguguaauaaaauauaugcgccacauaauuguuuaugaaaauauggaggaaaauuuuaauacugauuuaugauccugaguuuaacauaagcauggauaccccuacauuuagcuaugauuuuuuuauugauagaguaaaagcgccuguaauuucuacuuaaggccauuuaaaauaauuacuauuuaaaucuauuuaaacaauuuuaaauauugcuuuuccaaauuuccaccuuaggaaguaguuaauugaauauucucagagaaauaaguccuacaaaauugaccaauaaaaggucaguuacguauucauuguguacguuuuauugaucacccacagugugugagccccuggaggugggugaaaugugggccucccucuuacagaguugauagugggccugaaggggaugggauuucagcucaggaauuuaaggaagacuugacaggaaguagcauugugagccaagauuucaaggauaagauuucaaggcaagaaaggagauguauuuuagguauucagacagagggucaacaaagucuuuaagguaggaacuaguucacuuuucaaaaagaagagguaauuggucaugauaagaguaguaguuuuuaaaaaucauuacuguuuucauucauuuauaaugaauacuauuauuuuauaauuuuaaaguuuauauccaaauaauuguuuucaagaugguaaugaauguauauugcuuuuauguauacacauaguacuuuuugcuuuuugguaacuaaguuuauaauuuuugagggcaggaaauauuuuuguuuuucacuuacaaagaaacuauauuuuaauaagaguuuuuugacagcagugcuuuaugccaaaggaaaauaaagcaacauuuaacauaucaaagaaagccaaugcaaaacaaggauuauuuauuuauuuauuuauuuuauucauuuuugagauggaguuucacucuuguugccccggcuggagugcaauggcgugaucucggcucacugcaaccuccacuuccugggaucaagcgauucuccugccucggccuccugaguagcugggauuacuggcacccgccaccacgcccagcuaauuuuuugucuuuuuaguagagaugggguuucaucauguuggccagguuggucucaaacuccugaccucaggugauccacccaucuuggccucccaaaguccugggauuacagacaugagccaucaugcccagccaaaacaaggauuuuauauucaaucaaacugacauucagauaugaucacaugaaauaaauaucaacguacaauaacucagggcauauuuucacauuauuuuccuguagaaucugcuagagaacaaguuucagauacccaaaauaccuagagaaaaacugauauaaggauggguaaugagcauuaaggagaaacauaaaaacuaagacucaacgaugguaaaaaguaugauaauauaguauuccacagcuacaugcugugacaauaaagagauucuguaacugucaggccucugagcccaagcuaaaccauccccugugaccugcacguauucgcccagauggcccgaagcaagugaagaaucacaaaagaagugaaaauggccuguuccugccuuaacugaugacauuccaccacaaaagaagugaaaauggccgguccuugccuuaagugaugacauuaucuugugaaauuccuucuucuggcucauccuggcucaaaaacucccccacugagcacccugugacccccaccccugccccccagagaacaacccccuuugacugcaauuuuccuuuaccuacccgaaucuuacaaaauggcccuaccccaucucccuuuccugacucuuuuucggacucagccugccugcacccaggugaaauaaacagccuuguugugacaguaacuuuaauggggaagaaugagaagaagauguggguaaagaaacaacuguuuuucuauuaauggugguaguauuaguguguaauucugagccuggugcauaaguaauaugguguaacauaagugaauaguugugugauauuuuaauucaaucaucccauguauuugagaaucagaauuuugaugugguaaaagaagauucacauguaacauauaaucuauuaaaaagauacccuguagucaugaguuugacuuuuagguaucauuucucaguauaacauauuguuguagauuucagauaacauuuuuuccccauaaauacuguccgcugcaggccuaaaaauaaugaaaaggccuaaaagaccaacucaguagcgguaaacaccaguacugcaccuagauuauggucuuuaggaaccauuuuccaguaaaagauaccaguaaucuuuggaaagcaggauuuuuuuuucuuuuuuuuuuuuuuugagauagagucuagcuucgucgcccaggcuggagugcaguggugcgaucuuggcucacugcaaccucugccuccugaguucaagccauucucugccucagccuaccgaguagcugggauuacaggugccugccaccacuacuggcuaauuuuuuuuuguauuuuuaguagagacggaauuugaccaccuuggccagucuggucuugaacuccugaccucgugauccacccgccucagccucccaaaguacugagauuacaggcaugagccaccacaacccggcggaaagcaggaaauuuuuuaaaagcuauuuuaauucagucauguaaaaaaaaugagcagaaagaaacaaaaaacuuaaaaaaaaacuuaaaaaaugagcagaaucuuaggaaucaccugcgacuuugguuauucaugcuuagccauuucuauaggaaauuccagcacuauuugaguuagaccacuaauuauauguguguuguagcuuucuccaagagauaauggaauucacaaaucaaaacuuugagauuauuaaguguuacaagugaauuauaaccccagucauuugcuuucaaaugaacagcuaaacauauuuuguguuaauuucuuauggaugcugcuuuguuuguuuguuuguuuauugagacggaauuucacuccugucaccuaggcugaagugcaauggugagaucucggcucacugcaaccucugccucccggguucaagugauucuccugccucagccucccgaguagcugggauuacaggcgugcaccaccacaccuagcagauuuuuguauuuuuaauagagacaggguuucaccauguuggccaggcugguuucgaacuucugaccucaggugauccacccaccuuggucucccaaaaugcugggauuacaggcgugagccaccauucccggccuagauaggcuuuuaguugguuuccauauacaguguauauagggagaaacagacuaagacagacacuggcauccacagaaguaaaaauaaaaaguaagguauaauuuaaauuucacacggucauggucacauuuuucagcuuuuugcaccuauguuguauaaaaaagacaaaaaugccuuuagaggcucaaguuuucaggacuuccugaagcugugucauaguuuaaaaaugccauaaaaaugccgucagauuuaauaacguaucagcugaacacuggauuucuguuauguugagucuucaaaaauuucucccuguaugaggaauuaauacuguuaugucugaucugguggucugaaaugugaacuuuucugggccaaccaguaaacagcugcuguugcuuuauagcugcguaauucagucuuggaaauuauuagauaauucccacaccauuucagcuugcuguuuuaccauaaauuuaaugugaacaguauuucuagcuaaccucaagcuguguuuauugucguggaauuuucucuuuuauucugagguaaaugauuacaaaugguuaugaugaggaaucaaagaagaaaguggacuuucuucaaaguucuuuuucuacucuagccgcuucugagcaucuuucucaagcacuguguuuccaucagucccuaccccaagcagagaaaggaaacaguuuuccccuuugucuucagaacccucuucucaucgugucauuuuccaaagcaaauaaaaaucuugagauauugucuugaguuugauuuuuuuuuuuuuuuuuugagauggaguuucacucuuuguugcccaggcuggagugcaauggcacaaucucagcucaccccaaccuccgccuccuggguucaagugauucuccugccuaagccugccaaguagcugggauuacaggcaugugccaccaugcccagcuauuuuucuguuuuuaguagagacgggguuucuccguguuggucaggcuggucucgagcucccgaccucaggugauccgcgccucggccucccaaagugcugggauuacaggcgugagccaccacacccugccgaguuugauguuuuuuuuaaccauucaagccaguaaauaacuuuccagacagcuguaguagaaaacagaauuugugugugacaaaacuuaagauuuugggauugagagcucuaugguuuaugccauguggauaauuguagccagaugaagaauaugaaauuuaaggaaguguuuagagugguacagacagcuauuauuacgauucuugggguagaagaguagcuuacauacaacauaaaauaauggcauuaacugaauuaacuucagccuuugccaugaaacccaagcuuucauuauguuuuaaauaaugaacuacauuaaaaauaguauauaaauauguaaaauauauuagacauagacuucucauaauaaauuaugggaacuuuugauguauuucuucccuaggaaaagaacuaaacaagugcuucuuuguggacuuaaaauuuuucaguuuacuauugugaauuagguacagcauaucuuuauaauuccagauaauacccauaaaagcagaacuguuuauuuacuuauuaugaagggaauacugaaaugaaauuaaggacaauuuuuuucucacguauuauauuuuuaaaaaguuauuugauguuugugauuaaauaaagaaugaauuuuuaaagccaguucucaauuagcacugaggaaaagaauaugcuuuuuuucagguacacaaauaagcaucauggauauaagaaacgacauaaagaugaaucuacagucuggauuaagacguauuuuaauuucagugucaaaggcuguuaggaaauauucagauuuuaguacuugacaaagaagguucucaauauuuguuucaguguucagugaaaggauaaauucugucgucuuucucuuuuaucauauuagucacugagugguuucauuaaacauucccucuuccauauccccugauaaauuucaacuuguuggugaugcaucccaggagugucugucuuuuuuuuuuuuuuuuuuuccuucuccugucagugagucuuaggcuuuggcuuugaaacccuauagugaagggaaaucucaggcaacagcugugcaaccgucuggagagcagcuaguccagauuggaggagacgaacgaggcuggucgcaggagagaggccuccaggaaaaaauggcauugaugcauuaccugcguuaaagauuuuccuguacuuagcaugcuucuuaggguucuacuggagcguuugggaaagauacaguauugauggaugcauagaaaaugaggcaaauuuuuuaaauggggcaaauauuaacuguagacaaagaaaagccaaaaguacaaaauaacagcguuguaagauacgaagauaaaaauacgccuaaguaugagcguucuggcagacucacaauacagaugccauauaugggguaaaaccauaccaguaggauggugggaagggaaaggggugggcucauguuccauagugggaagaccuacagcggaaaaaucaggagaauaguuauuuaagcacagaguuuagggaguaaguugcagaagagacaacuaaaugagauggccgugaaugauuuuuaugaccuccucuuguuauggagaaaucgaucaaggaggccuauauuugauggcaggaagaaguugaguuuaagguuuccagacauuuguuuuaaucuggaaaauuucuuuuuuucuuucuuucuuuuuuuuuuuuuuuugagacagagucucacucugucgcccaggcuggagcgcaguggcgcagucuuggcucaucgcagccuccgccuccuggguucacgccauucuccugucucagccucuugaguagcugggacuacaggcgcccacaaccacgcccggcuaauuuuuuguauuuuuaguggagacuggguuucaucguguuagccaggauggucuccaucuccugaucucgugauccgcccaccucggccucccaaagugccgggauuacaggcgugagccacugcgcccagccuaaaauuucuuuuaagcuuagaaguugcaagucaaguuacuguuaaaggcguccuaacuuugaauuagauaaagcuaaacugugguuuaauugagcugaguuuguuguaugcuauaucucaacuucacaagauguuugcuuuuucuuggcuauaaccuaagauuauacaaauauaaaauuaccuuuaugcccauuugauagacuuuagggcugaauuucccuguguaagauguuguagagguuuguacuugugauuguuuuuacucuagaagcauguuuaucuucacuccuuuagugacacguguuuguucaggaacuucaaacucaaugugaucaaaacuagacucauguucccugaauagucucuccugacuacaaaucuguuggaaacuuccaauccuaauuaauaauuguaaacuuuuuaauguaagucauaugagggguuguugugagcauaggagguagggagaugguagugugagcuggagcauaugguaaaaguuguuugaaagaaaguagacccaugauguggauccugagggauacguaaagaaaaugaagagguguagauuuaaaaauguuuauggggccugggcgugguagcucacaccuguaaucccagcacuuugggaggccgaggugggcagaucaccugagguuaggaguuggagaccagccuggccaacauagugaaaccccgucucuacuaaaaguacaaaaauuagccaggcauggugaugggcgccuguaaucccagcuacucaggaggcugaggcaggagaaucacuugaaaccgggaagcggagauugcagugagccgagaucgcgccacugcacgccagccuggaugacaagagcgaaacuccgucucaaaaaaaauuaaacaauaaauaaauaaauauauucauggggauguuccagggaaaguaguuuguguugguagccuugagaaauaauaauagaaaauuagaauagaacuaaguugguucauuaaaguuggaacacuuguagagauuuuugauuuggacagacauuaauucauuugauuauuucucuuauucgauguccagaaaaauaucuguacauucaaugugguuuuauuuguacugcacaugucauuaauaggcuaaaguuaccucuaagauaccugcuuucuuaguccuuguuacgcuguaaauucugggcaucaggauauagcuuuuuauuauguuagcucuuuuaauagaugauacaauuggauuggggaaaaaacugauuauacucuggaguaauacuuucauagccuguaguauccugcaaauagcuccuggucaucuucgaauuuuacuagcaaacuuguaggguaauagguugggacaaaguauuauaaucaguggcuuugagggccugauaagaggaaacaauaauugugcagcuauauugugaauaaguagugcaugaugcugaugguuaacccuuuccugcggugcucaaacauugggaaauaauugcuuuuuguucaaaauguaagcucuucgauaauugagacuuuugucaauucacugaaauauucccagagcuugaacaugucugguacauaguacauauuuaauaaauauauagauuuaaugaaugaauugaggauguagccaaauauuggaaaaggaaagggaaaagaaagaauagcccaaacauuagaaagacagaagauguggagcagcaauuucacaugccuaaaagaauuucugagauuauggcaaaaucauuuacuuuacuuacuccuuauugaucaacaaaggaagagcagguuuuauguaacaaccaagaaguaacauagggaucucagaagagaagaaaccaagugucuuuggaucuuaauaaaaagaacauucaacuccagaaauaggguuaaaccuauccuacacaugucuaguaaaaagucaguguaucagaggcaucuguguuuagagauaaaacauaccauuagauucauuuauaauaguuucauuguccuuaguuuuuaaggcuaaugauaaagauuuuuuuuuuuuugugagacacagucucucugucacccaggcuggagugcagugacgcaaucucugcucacugcaaccuccgccucccggguucaagcgauucucuugccucagccacccaaguagcuaggacuacaggcacacgccaucaugccuggcuaauuuuuguauuuuuaguagagaggggguuucaccauguugcccacgauggucucgaucuccugaccucaacagaucugcccgccucggccuagugcuggaauuacaggcgugagccaccacgccuggccuuaagaauuaauuuucacagaaaucugcuucuaaauauuauucagugauaauagauuuuagaaauuucagauucuuauguuguaccuuaaagguuaggauacuauuuauaaaugcuaaacaugaacuccugucauccuauuuuaaugucuuuauuaagugauuacaugaauguggcguuucaguagguguuugguguauuaauagauguagguacuccccucuuaaaccuuuaaguauuuucaugccaugaaaaauuuggggggcauucucuuuauuuauugauuagguaccuguauuuucaagaauauuacucagcuucaguucccccaaaucuuuuuuaguguuaacuaccuuccgagaacgugguauaacauuuuaaaauauauuuuuugaagguuuggaugucacugaagaucccccuauuuauuggaugguaucuuuaucagcugggaagauaauuaguuucccaauguugcuauauuuuuaugaauagguccuguagcucuugcuuucuugaaagcuuagaauugauuguaagccauggacuaaugauauucuccaagcauauuuaacaugaauaggcucauguucaguaugucaagaaguuacccuguuguacuauuuaaauaauuugagcuuaguuuucuuuuuccaccuuuguucuaaauucuuaggugagucugaauuccugggcaucugugcacacagcuucuucaguagguccuuuacucucauuguaucugaucuuugacuucauaaagacccuuggccuacugacccuguauuuaauuucacaucucaauaguauuuagccuucucauauuuuuccucuucuuuagagcucccugaucccucacuccagucauucaacucuguguauuccuuuaacuuccacccucgcucugucucuucacagauaugcuucuuuauaugguagucagaaguuccugugugaucuucguaaccuccaguucccuccacagucaccuguuaucaggcaucuguuccuugagcuccagggaaugagcucuuugcuaucauucugguugucggacucacugggcacuguuguguccuccacagucucucaguggcaucgguugaugggugcauucuccccacacugaugucauucugcugcuucugauuuucuuucugcuguccuccauuuuccuuucaggcucccuuccccguccuccccgcgccaccuuuugcaauauuuaggauucagaaauuccaaauauugcaaaauauuuagaaucagaauucagaaauucuaaauaucaguguuuaauaggaguacccugggguuguccauuuucucacacaacacauacuugcuaggagaucucauaagugcagugguuuuucagaggccugcauugaugauuccugagucauuauguccaggccaggccucauacauacuauuuacugguucucuuucugcgggugcuccaccaagaauucagacucaauggaauauuucuucuaagauguacaccaguuccuuaucaaaaaauggcaaauucagacuucuuagguuaaacagagaacucgugaacauggcauaugucuguuauuccauuuuucucuguuggcuuauugcugaguaccauuugggauaaaaaucuguuucaggcaaaggauaggauuguuuucagcuuuuauuaaauucuccuagacccuugauuuuaugcagagaacuaauuaaauuugaaugaauuuaauguagaaacccugcuauugaugcagaaaucaaccugauucuggacuagcaccagaaucaacuauuuuuguuguuuuugcuuucuuuuuuuuugcuuuugcuuucucugccgguaaauaacaacuaguauguaagaaucaaaugaaucaagcauaaaucccuaggaaauauuuaugcauucauuuuuaacaauuuaaagaugugaagauauauaauuaagcauaauccucucaaaguuugacguugaaaaguauuucagauacuucaacuuaaauauauuuuuugcaaaauaucuuuuuuaaaaaaacagauguggucucagcaauguaauuauuacagugugaggagagcuuacaguuguaccaaaauuuauaacuaggaagaagagaaugugaaauaauccggaaaccuacaaaacuguccuauacaggaauaccaauuaaacagcuacuaaaaaugaguguaaaaugacaauauggcuuuaucaagugcuuagggucuggaaaaaugcacauauugccuguuauuuauuguuauacuuaaugaauguucuuuugcacgugagaacuguuauaaaagaugucuuuuguacauacuugguacaccaguuggcuuuuuaacccauuagcuguuuucccccaaagguggccuacucuagaugacguuaaaaauacacauuuuccagggacuuauauaaauagucaacugcccuauuauggaaacuuaaaagcgaaggcccugaaauauccagacaguuugaacauaaaccaaaaaugaagugaaucucuagaauugcuguguaauagcgugaguggggagggggucccucaagagagggaacugaccuuuuucuuccucgugggugaccuugaguacacacuuuauuuagucauuaaaagggucaccugaagcuuagagaaugaagauccuacagccuguuaauuuuaucauuguuagaaacucucugccuuuggccugaaaaugguaaaucaccuuucuuagaagauucucauauccagauauucuuaccaaaucagaaucuuuuccagcauuuucuucaaaaaaccacaguucuggguuaaaacacagcagauccuaacuguaauuuuccuuucauguacauuuuagucaucuuuauaauuuuaaaugaaagacaggaacuacauuauuugaaauaaggguuaacccccucuaauuauaagcauuaaucacacacaguuuucucauuucuaaauguuaaauauaaaaugggagcuaucucuucagacacuuuucuguugccuucugugugcggcaggaccuuacuuuuaagcuuaguuugauuuaaaggcugaguuucugcuugcuuggaaugcuugcucuucaaaauauuugcucccuggagagggaaacugaagauggagcuuucacgugacuuuggauugcugaccuggaagacguuugggguaauaggaugggcuagggcaugguuccacugcuuucuguuugaguggggucaggaaaggaaggcggggcucgcugugugcaaacaggaaaacauagucugaagauguuugaagccugagugcacuuucauuugaugccuugcuuuauugcuuaagagaauuuuaaacugccgaauccgcaaaugugcugcagccuauaaugacacauauuuaaaugauuuuugcaucuaaacaaaugcauucacucuuugccugguguguacaauuugaaugacacucgugcucugccuggaaggaacagacguuuuucauuauaaaauucagucaagcagaaaaguagcaaaggaagcagaaauuuccauuuacaucuaugauugaaguuguagugauaaaagaggaugacuaaguugaagaguagccuuguucucauucugcuaucugacaugggaucuugucacuuugguaauaguuuuuaaacuuacauuauugaggaaggcucugaucagaagucucaaauuauacauguucuucaaccuuagauuuuucuggguguuuuguuucaaaagucucaaauuauauauguucuucaaccuuagauuuuucuggguguuuuguuugguuuuuugguuaucuauagauagauuugaguaucucuuuuuuucuuaaaauccguuacuuacuaguaauaaagacuuaagugguagcuuuacgcuccauuaucacagagauucacaguacuuuuuaguuuuuacuugugagccucagcagguguagacagauaccuuaguugccacugauaacauccaguugccacuagaucaagaaaugguucaaaauucuccaggggcauuuucugcuaaagaagaguuggugaucuuccuuuuggaagccuuaauguacuuaaaccuucuuccuuagaaguccagaaauucaauuauuucagcucucuguggagugauaaguccugccaaauugauuuacaauaaugaaacuaagccuuguuuacaaaucuaaguggugauuucuaaguccacagaggcgugguaacagagagagagauucugauuuaucugggggucuauccguguuugaacagauugugugauuuuugaaacaugauucaaaagggauguugauaaauucuaaaauacauuuuuauugaagagcuugaugaaucauguauacuuacuuuauuuguuauucuauuagauauugucuuccucaucccuaggugguguugcuaguacagugacagaauucaaauccuucuuuuuccucugcucuaacagagcuuugugaacucauagcaauauuguaaugccugguaaaagguggugccaguuucaaguacuauauccuaauuacuucauggcuaacucuuguuauuguuaacaauauuguuaacucuuuuguuaaaugcagugacaucuuuuuucuuucucauucucuguguacuuuuugcccuaaauaguucugcaucuuuuaagauacaaguuugcuuuuucuuggagguuuuuauuuggaaaaugccugaaauauauagaccaacauuuguuccuccaaugguuaaauuacauugucucccaaagugaggcauuuuaagucuggacuauacccaggagaaucuaaaagaggcaguuaauaagcucuugaagagcacaguggggugguuguguauuuauugagucucacacuuaggagagaaauaggcuggaccaaaugagccugggcaucaaaagcauguggguggucguuggugauaugugcagugaugagugugugugcugaggguccuagaccaggcuggcagggaaaugaacugaaggcagugaagccuccccugauaacugcagagagugcugcagcauccaggaccucaggaucaugaugaacaagcuguaguggauggaagggagaggaacuaugggaaggaugaguuucuggccagaaagugguuuacuggagugcugugucugaguauuacaugaucugaggaccaugagguccagcuuugggaguauggagaguuugaguggaguagaguuauagucccauggucuucugauucacagacauucaugagcgauaaguaucuauugagaaaguggaagcaugauuuuuaugaccuccucuuguuguggggaaaucgaucaacggggccuauauugguuggguucuacaaccaaauagaauguguucagcaggagucauguuuugggcuccucacaauguucaguguuaguucuguuccuuucucuugcuuccacauaggaaagacuuugacccaaugaggaauuagucauuguccuuuggguacacuuccggaauuugauaaucaguugggcacuugauucuaguacauuugcuaaaaguaauuaauacccugcaauuggaagcaugcagcaagcgacugggaaugcuaagugaaaggucagaauugaaagaguggaggaggcuguugacccuuaggcauggaugauaugucugagugagaaagcaagaagaguagaagacagagccuuacuuuauaaucagaauuaugaaaagaggagccaaugagagggaaagaaugauuggcuugagauagauugguggaaacuggagaagauugaauuuaaagaagaaaagugggccaaguucaguggcccaugccuagaaucccagcaaauugggaggcugaagcuaggagaguugcuugaggccaggaguuugagaucagcuugggcaacguggcgagaccccugucucuacaaaaaauaauuaaaaaaaaaauuagccaggcauguuggcaugugccgguagucccggcuacuuggaaggcugagacaggaagguugucugagcccaggaggcugcagugagcuaugaucacagcacugcacuccagccugguugacagaggguauccccgucucuuuaaaaaaaaaaaaaaaaagagaauguggcagaguagucagagaacuggagggcugagaagagacugauggcauuuguuguucuugaccuugaaagaagaguugcagauuguuggagcaaggccagaugguaauagguuggaaagaacaagugaggggcgugagagugacagucuacaaccccguuaagaaguuaucugugaaaaugccucuuccugucuugauuauagccucccucgcacauggcuuucugaguaugguaugugaaaacagcaugcuguauauuuuuaccuucccauaugaguuaagguuuugguaaugacuugugguucuuuugccucacggaacaccaaccugguugguauuuugucggcaauuaugugguuuuuaaaaagccccguauauaaccuuaauuaauugcgucucuaaaaucuaucaggcuuugaguuuuuuguuuuuuuuuuuuaaauaaggcagaaagaaaggaaaguguuaggagaaagcaaccagugagaauaccuauauuuugaagaaacaaaguagggaauuuagaauuaucucuacuauaucugcuuuuucagcucaucucucgggauacagaggacugaacuaagcuaaaguagguucaagucuaaaggaaaccuuaaauuaauuucuguauuagaauuaaucacacaccuauaaauacaauuuaugauaugagaacugcaacaagagaaauggggggagaugagcaguuugcugaucaauaggguuaaugaugguaacauagaauccuagugauaugccucccauugacuaaaauguaugcguuaagauagcauagcgcauaaaaugguguacugcagucucaguguauucaagcuuauuaugguuucucugccuagguuugugucuuuggcuuuagauuuucucccauaaccccaaccuguccacauucaagucacuacuccuugaaauauauuauugaucucuaaaaucugaugcuaagucugucuugcccaacgguggccacuagccacccauggccauugaauauuugaaaccuggcuaguccaaacuaugcugugaguauaaaaaacccaccagauauuaaaaaguuagucugggagaaaaaaacaaauguagaaugucuuaaugauaauuauuuacauugauugcauguugaaaugaugaaauuuaggauguacuggguuaaaauauauuaauaaaauuaauuuuaccuguuucuuuuuaccuuuuuauguuaauguggcuacaggaaauuuuaaauuagauauguggccucuauuauauuucugugagacaaagcugcuccaagcuguuuugguccagaacuauaucucgguucuuuuguauccuacauggaccugcauagaaugguauuuaguaauacucagcaguagcagagaugaucucuuaucaaauuauguuaaguuuuaauuuuuauucuugucucucacccuaugugcaccucucuggccaggaggcauuuaucauaucaccuuuuaauauuuggaaaucacuugaucugcuugagucauuguguuguuuucaaaucuagaacucuuucuaccuuauuuuguaacuucuauaauuaaacaaaaggcgaaccaggagcagcuuggcucuuagggaugugugaaaaggcgcucaguccuuaaguuggugccaaaagugacaaaucuauaggaugagaugcagguuuauggaagagaagcaugaaaauuuuuauuuuuuaaaaggacacagcaagcuagucaccaaaagacagauacuugauucuacuuauaugcgguaccuuuuugaauuugaagagucaaauucaaaaagauggaaaacagaauggugguuuccagguucuggaggugggggaauggggaguggaggugggggaauggggaguggaggugggggaauggggaguuguuuaauggugugcaggguuuuaguuuagcaagaugaaaacaguucuggagauggaagguagugaugguuguacaacgauaugaaucuacuuaacacuaaacuguauaauuaaaaguggguaagcaaagagugucuuacaaagcaauaacuuguaacuuaaaauuuuuaaaaaccuuaaugagauuaguuguaauggguuaucuuaaguagacccuuacugccggaaggaacagcugaaucacaucacuugggagcuuguuagaaaagcagacucagucccacccuagacuuguccaaucaaaaccugcauuuuaacaaggcccccaggugauucauaggcacuguaaagcuugagaagcccugcuccaaauaucauuucucaaagugugauccaugagccaccugaagcagagccacccugggaaggucuguuuucaggcgcgucccagaacacguaaaucagaucuaggcuguggagcuagggagaagaugaaucugcagacugaucaggaucccaggugauuuugaagcaugguuugaguuugaaaaccccuaaucuggaaagcuuuaacaacuauuacucuuacaauuccaucuuuuaacgaauguuggaauuauuaaauacuuguaacaagaaguccuguuauugauaaaaucaagauaugacuaauagugcagucaaaaagaggcaacaaaaaagcaccuauaacuuaucuuggguugguuaaugaggaagcugucauucaaaauuaguaagacuacuguaacauuucuugggguccugaacauuggaaugagagucgguuuucagaguugagcccaccucugucauuagcuuugugcaaaccucaucaggcucaagauuccucauuuguaaaggggaaugaauucucugaccaguuaguuuacauuccuaagacaagguuaaauuuggaaagcaaagaauuuucgguauauaugugauaauuuugaaauucuugaauuuuuaaaaaauuuaaaugccacauuacuuauauuuuuuucuaaaaaaaagucaaaccaagcgcugucuaguuauuaauagauaccacagaugagaugccugaguugguaagcucuuuuuaauucuaguucuuuucaacuacaauaauuuuauagacuuuuuuuugaaggcuagaauguugauguggaaucaaauagguaugccucuauguaugguagaugcaccugacagggaucacuugacuugaacaugcccugacaaugauccuguguggcaggugcaccugauucugaguucugaguuaagaaauccgggagugggccgggcgggguggccggugccuguaaucccagcacuuugggaggccgaggcagguggaucauuugaggucggaaguccaagaccagccuggccaauguggcaaaaccccgucucuacuaaaaauacaaaaaccagcugggcgugguggcgcaggccuguagucccagcuacuuuggaggcugaggcaggagaauugcuugaacccgggagguggagguugcagugagccaagaucacgccagugcacuccagccugggcgacagaaugagacucuguuucaaacaacagcaacaacaaaacccaaaacaaaaaaacaacaacaaagaaauccaggaguggcuaacccagagagccauuccuuaucuguaaggaacaucugagcccucaucuccuucuguggaacaugggccucgccggggauugagacccuuuguuaugaguuaaguggaaguugccagguggagauuguuagggggaggguguuaaaugagaaugcuguagagaccacaugccuuuugcaagcggcugcgguuccucuguccaacccaccaccacuggacucucuacccuguaugcaagcccccaguaaaacccuaugagacauacgguucacuagcucugggccucuucuggcucuugaaccuggugccauccacauugcagucaguaggaguuuggcaugacaccuuauuaugugaacuuuuauaucaagccauuaaauuuuuuuaaaauagacuuuauauuuuacaacaguuuuaaauuuacaggaaaauugagaggauaguccagagaguucccauaggcuuugcauccaguuuucccuauuguuaacaucuuauauuaauaugguacauuuguugcagucaguaaaccaauuuugauacaugguuauuaacuaaagucuauacuuuauucagauguccuuaguuuuugucuaauguccuuucuguguuccaggaugccauccaggaaggcgcauuauauuuaauugucaggucuccauagccuccuuuccucuuggcuaugacaguuucuuuauacuucucuaguuuuuuaauaaccuuaaagguuuuguauuggucagauaauuuguaggauuccccucugugggaauuuucucaugcuuugccugggguuauugguuuuaagaaggaagaccacagagguaaaaugcccauuucaucacaucauaucaaggguacguguuuaucaacaugauacagcccuguuggcauugaccuugaucaccuggcucagguggugguuguugaguuucuccacuugaaaauuacucgucuucccacuuuaugugcucuacucuuuggaaggaagucaguuugcacagcccacaauuaaggagcagagaauuaugcuucauuuucuugagggcagaguaucuacauaaauuauuuggaauucuucugcgcaggagauuugucucuuuuuuccuauuuauguauucauucauucagucauuuagacucauggauauuuacauuguacuuugauuucuaauccagcacuacuucauaauuuuuauugcucaaauuauuccggcuuuagcuauuagaagcccuuucacuugguuccuaugcucauuugacauagccucuuuuuuuuuuuucuuacaagaugcugcagucucaucuugcauauuuucagcccuaauccuagaaucagcuguuccuccaaggagcccuuguuccuuuuauuggagaguaauguuauuggagaauaguauuaaaaucuggauguuaaggaugcucguugccacuggaguuucuuugcuuuuaagacuucucaguugauagagcaaggcaauguauuuguccauguucacccuuauguuaugcagaucuauaaauauuucuauagcuaacuaguuguauuuauauuaagcuauaauaucuagucuauauuaagcuaaauacaaguucauccggauguuuccuacucuaacguauuaccacauggacacuauaucucuccuccuugguuauguauaaauucucacuccauccaccaucuauguacuuaauuguucaguuucaguauaugugcguagccguaucagaauuguuaacccaggcuggguacaguggcucaugccuguaaucccaauacuuugggaggcugaggcagguggauugcuugagcccaggaauuugagaccagccugggcaacauggcauaaccccaugucuacuaaaaauacaaaaaaauugcuggucaugguagcaugugccuguagucccagcuacccgagaagcugaggugggaggaucaccugagcccaggaagucaaggcugcagugagcugugaucgugccauugcacuccagccugggagacagaguaagacucuuucuuaaaaaaauaaaaaauaaaaaauauaaaaaaauuuguuaacccacaccuauauggaucuuuuuaaaagcugcaagacugcuaacaaauauuuauuuauuuauuuauuuauuuauuuauuugagacagagucucccucugucacccaggcuggagugcaaugacacaaucucagcccacugcaaccucugcuuccccggcucaggcgauucuccugccccagccucccgaguagcuaagauuacaggcacccgccaccaugcccagcuaauuuuguauuuuuaguagagacgggguuucaccauguuagccaggcuggucucgaacuccugaccucaggugauccacuugccucggccucccaaauugcugggauuauaggugugagccaccaugccuggccauaaauacuuauuuuguucccgugguuuuuuuuuucuuuucucuuuuuuaaaguaaauccuuugcacuauuuuuauuauuuuaagaccaguguuauucagagccuggguuaaacacuauucuguguguguguguguguguguguguguguuuguuuguuuguuuguuuuuugagacagagucucgcucugucacccaugcuggagugcaguggugugaucuuggcucacugcaaccuccgccucccugguucgggagauucuucggccucagccucccgaguagcugggacuauaggugcgcgccaacaugcucagcuaauuuuuguauuuuuaguagagacggagugucaccauauuggccaggcugguuucaaacuccugaccuugugauccaccucggccucccaaagugcugggauuacaggcaugagccaccacucccggccagcacuauucugucuuauacucacucugccaucuguguguguauaugguacguaugugaggcuggaucugugcacuuggaaaaguuggagagaugauuuagguaaaacuuuuaguuuucacuucuuuugccuuuuugcuuaucuugauccauuuaguuccuaccaucuggcaaauaguucucaucugaagaaucccaucugucaguucucacuauuauccgguaauaguuacagugaaaugcuggugacggcaacagccacuuuuuaaaaggauguguaauucacccucauguccucuuugagaacccaguaacugcccacacucugaagcuaaaaccauaacaguuuuaucacauggaaaguuuguugagaaauguuuggcuguuucugugaaguaaucgucccgucucuugaguacagaugccucccaggaaaauuuucccagccuauuuguuaaugugaaaguuacaaaagauagcauauaaugagcacauucaagacaaaaaaauuuguggaguaagagucugaaaugguaaaauaaaaaaucacuuaagaaaacauuuaucuguagcugucauuuucauauacacauaucuaguguauacaaguuaguaaguacauaauucucaaaaguucuaccugucuacacaucuacacagaaaaauuaggaaagucuuguccagacuuuuccaucaucuucaguauaaagcaucuucuagcuguuggaauagaaacaagcuagauucuugacuccuuucuauuugauuauuuagaucugaccuucagacgacauccagaaucugagaacacgcaccaccucuacugcucucauccugguccaagucauugucaucucccaccuggauuaaugccagagcccccuuccuggucuucucacuucuagucuugacccccuagggcaagaauaauuagcuuagaaaaccaccccagagccuuccagcauuacucugaguacuggccagaguuggacaauguuuaaggccccgugcagucagcugucccuguccuguccuggcugucacucacucgcuugcccacugaucucuuccacaucauuccuccacgacagcacugaucuccuuguucuucugugaguucaccaggcaugcaucugccucaagacuuuguguaauacuuguugcuuccucuggcuagaauauucuucccuuugauucugaauacuuuguucccucacuuccucaagucuucacugaaaugucauauuuucaaguaggcauucccugaccacccuauuuaaaauuucaccccucagaaaaaacaaacaaaccaccccuuucucugcuuuaucuauguaacauuuauuaccauccaacagacacuguauuuuuaucuguauuuuuuaucgcuuccccgcuaggaucauauaucguuuuaucuguuuuguucacugcuguauucuuagcacugagacauaauuguaaguaugcagugaagaguuaguggauaaaggacaguggcugcaagaggggauuuaggaaacacccccucccagccaggaccagcacucggugcaagaguugaaagaguugaucacucagauucucugcuucuccagucguagggacuccaccccgcuguguugauugcugucauguauucaccccaucauaagcaguacucacauguaaaacaguaccaugucaucucuguggggcuacaaguagguggugauggugcaaugaacauauaaaaccccagugucuucaguaggugcgaaauaggugauuagugaaugaugaagaguagcuguugcuguuuugauuacuaugauuauuauuaugagaaacuacugugguugaugagauagauacuggggagaaggauacuauuaauauaauuuauugagcaacuuuguucugggcacuaguugaguacuuuagggauauuaauucauuuaauucucccaguucugccauuuacucucuaugugaccuggacuguuacauagucucucagucucacccucucuuuuuuuuuuuuuuuuuuuuuuuuuuuuuuuuugagacggagucucgcucuuucgcucagucuggacugcaguggugcuaucuuggcucacugcaaccuccaccucccagguucaagcgauucuccugccucagccuacugaguagcugggauuacaggcaugcaccaccacgccuggcuaauuuuuuuguauuuuuaguagagacgggguuucaccauauuagccagacuggucucgaacuccugaccuugugauccacccgucucggccucccaaagugcugggauuacagacuugagccacugugcccggcccuugccuucucuuauaaagugaaaucauuguagcugcuuuggugugguucugaggacggugagagaagacgcacgugaaguauugagggugguggcaggcacacaguucagaguuacuaacaauacugguguuuuaucuucacaaggcagaucugggcccauagcacaaggaaaccgaggcuuuggcauuuuacaguaauuacauugccagaacauuucccccacuuucuugaaucaucuuuaccucuugagagaugaggaagagagggcacaccucgggcagaaguccaaagaccucaggcauuuuuggccuuucauucccaugauucuggccaacaucauuuuaguccccagcaguucauagaaauauugucuuuuaaucugauauucaaauaaucugugccuugaagaaccuguguauggcucuagaaucuuuuacauuaaucuacucaaccccacucugaugcucaaaacuucagcagucuguuuuuuuuuuauuuuaaugucuuuauuauuauuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccuugugauccgcccgccucggccucccaaagugcugggauuacaggcgugagccaccgcgcccggccuaaugucuuuauuuuaaacauuuauuuuuagagguagggucucucuaaguuaugcaggcuggccucaaauuccugggcucaagugauccucccaccacagccucccaaguagcugggaugacacccccaggugccgccauccuggcagcagagucaguuuugauacaucuuucccuucucauucuucccaaugucauggauugggaaguuacugugguuuuaguugcaguacuuuuuacucugaauucuguuugcuuccuggaauucugucugucuuuugaaaagacaacauaaagaaaucgaaaaauauacuuuaaauuccauagugugggagccucugcuacucgccuguuugauauucauucccauuuuuuccuuucuaaaagaauuccagauuuuuuuuguucagggugacaaugugcucugcugaaaauacuuucacagauucccuugcaggugcaugugaccagaucacaguaauggcacauauggccucaguggaauuugcugaggaguaugucccucccaaguaacagcaaagcuuuauuagaggaaaaaacaacaacagaaaaccuuucaccuuugucuuguuucuccugccuucugucuggaacuuggacacagagucuugaauuucugugaccauaaaacacgaggauaaaaccaacgugcucaggauggcaguacagaaagauaggaauacgcuggucccugauggcaucauggaauaucugcaguggcccuagcuucagugucacuucuuaggugagauacauaauccuaccguguguuuaagccacgguuugacauguggucuauucucugccgcugacugcauucccagcuguucuauauggcuugcuagcuaauuuaagucuaguuuuauugucaaauugaccacauuguagauuauaauauuaaaguacuucacagucuaaaagugaacuacuuuuguaaaagccaaaggaaaugggccaaaugaaccauuuugaacagaguuuaaaugagugaguugaguuaccacucuuggauggagaacuggagaccuggauuuucagucuaguucuucugccaguuggcucugugggcaagucacuugaccugagcucuuuuccucccaucugcaaaaugagguaauuugagcuagacaguccucccaaagaccaccaaagagcuagcagauugaggccugcagacuccuauugaauuugccauccuuguucaccuugccaagacuucauagccaagaagccagacccagauuuuguucauuagcuuugaaaacacccuuucaguuggguguguguguguguguguguguguguggugugugacaugcguuuugaauauaaauugugaauuguuuuagcaagaaaccagguuguauguuucucaauaaacaugcauacuguauauugaugaauuuauccacuugaaauaaauggugccaaauugccuaaaguuugcuguaaacaggaacaugauuucucauuaugauguuuaauuuguuuuagucuuugaucucuuacaucagaauucuguuaagaacucuuuuuaccugaaagaucaaagcaaauaagcagaagcauuuauaaaaauaagguauacguggcuguggagagaaacuccagguauauacgaucauaggcuuuuuaaaauuaauaaacuuuguuuuuaaaaacaaagcaguggaaguucacagcaaguuugaguagaaaguacaguuuccauguaacugcuguccuagcaaagauuuuuaaguacaauauuuuuuaauuaaaaagagaaaauauaaaccgugcuaagccaguuggugaaaaaggcuucauuauacuuuuagcacucuuaacgcuuauuaaaaguuuuuaaaaacagauuuuugugguugaaucgcuuacaauuucugauguguaaccuucuaacauguuucaucaaauuuuaaaaguaauguaagcagugcuguccacugcuaaauuuuauuuuaauguuagaauacaaugagguuucuauuuugccauuaguccugagagcuuauuaaguaaccaguuuuaauccuuuaaaaaaccauucucauuuugagggacacauauuucuuagcuuugugcaauauaagaagcuaagaccaucuuggcaguaucaaaugaaauguuuugcaaguuagaaaguucaguaaccacuuauaaacauaaugaacaauuguuauagucagucuaaugcagaaauacagguguugggggcagggggguggugggugggcagacuugguccacaaguaguaguuugccaaccucuguccuaaacacaaguucaagaauaugguucucuuggauagauuuucugccagaugaaaguaagaguaacauccuuagcuaaugaacuccuaauauccaaggcaacuuuuaauuaauucaggcuuuuaagaaaagcuuguuuaccaacuccucauuaaaaauguucagacuggcuggucgugguggcucaugucuguaaucccggcacuuugggaggcugaggcaggcagauugcuugagccuaggaguucgagaccagccugggcaacauaucuagacccugucucugcaaaaagugaaauaauuagcugggcaugauggugcacagcuguagucccagcuacucaggaggcugaggugggaggauugcaugacccccggaggucgaagcugcagugagccauugauccaaccacuacauuccagccagggugacagagugagaccuugucugaaaacaaacaaacaaaaagauuaaugcaguacauguccuuuuggugaauaaguaaauauguuuugguaacuuuagcuuugcauuauaaucuagucgucagcagauugacuaagggcagauaaaacaagaugauuugguuuugugguuuggcacuuacugucugauuuaugcccccaagaacucuugcaggccaaggucgaguguaucugauaccugcucuggcucuucucacgaacugauuuaguagcuuugggccagcauuagauuuuuuaaacucuuugaccuauuuguacaugacaggcauuuaaucuuuccaguaguuacuugucaaauagaaaagcaucacuucuuaguuuggacauuugcaaauaugacugagcagagcugacagaugaggugggcaucuucaggccauaggguacuucuggccuccuguaaccuagaaaauugggaugccucagauaucagguauucuuccaagcagcuaggguuagucccugaccucagaaacccugagagcccucagaaacccugagaaauccaccugggaaugguguauuuguuuuggaugagauuaccuuuacuuuccauucuccaggucuucuuguguuuuuuguuuuuguuuuguuuuguuuuguuuuauaucauucuauguaaaagagaaaugugguaucauuugcauuaucauguuauuucuuuccuuauaauuuauaucuuaaugcuuaucucuggggcuagguuauaaucuccugaguuagguagccuuagguuucuuggcggagauuccuccccugggaagugagguuuauaaaagaacccgugauguggcccuguggagcugcauggggugugugcucaguacucacugguuucuucccugcaaagugacaccugcagccuuugggguaccaugucucauaauuuuugcauucccugcaacacacacuauacugcuaugggcaucauugaucauuuuaaagauuuaaggaaugacaagauacagugcuuauucuccccuaugauuugcuuagauuuuuaucuaaauaguacuuauugaaauaaguacuucaguaucaugcuacaucuuacauguuugagcuagaaacagacuaaaguuuaaacccuuuuaugagaaugaaaaguuacuuccuuccccuucuuagggcuuuuaaucccucuuuauguugcauuucagaaaaugcccuauagcguacuaugaaagaaagacauucauuccugucuuugcugcuguguggacgaucuguauuccuugcuccgugggaguuguggguuuaugucuauucuugcauguuuugccugaaggaccacagugaccuacuugguggucucccugcuuucaugguuucacuaugcugaucuauccuucacuuaauuauagagucuaucuuaaaaaaaaaaaaaaaaaaaaaaaaacuuuuggccuauguugcuucuuccaaaauggcauccaaaaccuaagccucuuuaaaauuggaguccagcaugcuuccccagugcuacuuccuucuggacucccuuugccacuugcuuucugcuuccacccauauccagaugggcugcaaauaugccuugcugguucuuuacucugucuuugcacaggaggcucccucauuuugaagggucuuuugcuacccauccauccauccauuuggauucuauaauagaguucuugauguuugacagaacuaggccaggaauuguggggguauaauggcaagcaagacagagucuauccuuacguuauggaaguucaauucauuucccauguggcauacuacuucucaccauucagauucaucucgaauauuguuucuucuuugagguuuuucccacugcacccaagauacuggccugacacuuuccuuaucucuauuacagaauuuaacuuguucauucauuaacagauauuuauugccuacuaugugcaagaaucugugcuaaaagcugggaauauugcaguaaacaaaaauuaaguuuacagcuuacauauaaugugguaauuauccaucuuuuaccuucauuagacugaguucauguaggacuuuauguaauaucuuuauaucuucaauaccagaaaugccuagaaauaauuugcauaauauacauuuucuuuaaagauuuaacaaaagucugagggacaguuuucagaauaaacugaauuaaacucucucucucuuauguguguuauguaaacauauauauaaaauacacuuuuggguuuuuugcuuaggaaguagaaaaaugcuaaaauuucuguuacuuacaagcagauuaaaauguccaagaaagaaaaguagggauuuauauugauucugcucaaaugcuuaccuagacaaugucaauauuuauauuuuacuccccuguuguaguagaaugguaauugguucucuaguuaagcagcuuuuuuaggauuaauuuugaagcaagaaauucagauuaauuaagggacaauuucacuugcagcauuuaggcauuauuuuaaccaucaaacuugaaguggcaagaaacggaguugcuuaaggaggccagacguaacauucuaaagguaguagggucuugauuggguugcuuaggcauuaaaaggcuguuuaacuugucuugaagucuaucuuuccuugaugucuucugcgguaagaacacugugauacagauggaaugacgggaagugguuuuccuuucuuucaguuggugaguuuguaagugaugcccuucucguuccugacaagugcaaauucuuacaccaggagaggauggauguuugcgaaacucaucuucacuggcacaccgucgccaaagagguaccagcccauaaauucuuucuuauugcaaagugaagauuuccuggggacgugcuuaauggcauuuuagggguauuuugaggcaacagcuauguugauaaguuauuuaagaaaaaaacccagugcuacuauccguaacccagauuuuaguuuuuagagugauuuuagguucacagcaaaaucgaacagaaaauagaguucccguguacccccuguccccacacaugcgcagccuccccauccaugaauauuuuuaaaaagucaaaaauagggccaguugaacuagauucauuaugugccugugccguguuucgcaacuuaaaaauauaaguugucugugccaugccuuauaacuuaaaaauauaaucucuaauaguuauaacuuuaaaguuuacccuucagauuauuuuuaugcaccuguuguuuucuuuugucauauacaauuuuuuaauaauuuagccuuuuccccuguuaucuauuagugaauacagugguagaacagugaaguagcuuuuuuauaccagccugaaagcuccaguuagaauucaguuucucaguuauaccauccaguuuuauauucagcaggccaugccuaccaucuugauuuuuccacagggugagucugaccgagcacuugguuaaccucugcuuuuggcuaagccaauaaaagauguaagauacuuagcaugaaaaggucacugugugguaagaccaccuucacagcugcuguguccccuugauagguuuccuaauaaauuuauauagguuuauuuguggcaagaucagucuuaggcuaacuagaauuaggcuccuuuaucuagcucauagugcuucacuugagucaauuuugauccccugucccucaccggaacaugucuggagacauuuuuuguuauuacagcuugagggagugguguuacuggcaucugauagugcccagaggccagagauucugcuaaacauccuacagucaacaggauaaccacccgccacccccaagaauuaggcaguccaaaacaucaauagugcugggguugagaaaucugaucuagcuuagcuuaaccauuguaucauagcuuuauagcuguuagacagaaaauaccacugaagauuuaguauuauuuuaugccucuuauaaaauaguauauuuggauccacuguagaauaaaauguuuuuuauguaaaaauguguuuuggagguuuaagagcuugcugaguuuaagaaaacaaaccaaauaauuugaaguccagcuaccuauuugauaaccucauuuuuuauuccuucuguguuuucaaaagaaaaauccuuugucucuaagaaacggaaaugacucccauaaggucaaaauacagucuguaauauuuucauugucuaccuuuaugucuugaauuauucauccuucauuuaucacuaguggaugcucucagaacuuuaugcuaaucuagauuugugcaaauuuagcaaaucccagaaaagcaaaaagacauucaaggagaaaucucuaaugacuguaaguucugauucuuaguggcugcaggggauaauuucuucucuucccaggauuguuacucugaaagugaaccaagagagucagaauuucuaggauaaggcagguccaugugagauaaacuuccaucuguaagggagguaggagugagcuggggaucuaccuggaaugcgcacaauuucuggauacacgaauuaagccagaaggcauuaauucucugguaucuguucaccaguggagacugcuacaucuuauuucccaauuaguuuccauuccaguuguucguauaaaccucuauuauauaacaucguggucuuauuaaauaaauaauaaacaagaauaaaaagaguaccaaaguguaacccaugcuaaaaaaaauccuguuguaaauucacucaaaaagcaaauaaucuuuuccuuugugaaauugguuccuaauauauugggucugcauguugauuauuuuauguggaguuuucuuacaaugaaacacaucuacucuaccacucacuguuuucuccuuacacuuuguagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagguaagguggccuuuguguucagccucagagaugcugaaacaucuuguauggaguauuuguauccuguaaauuaaucuuucuguuuaucacugaaaaggucucugcccacucccaucagagucugcuguuaugcaaaaaucugaacuaugaauuuuuauggcauccuguugaauuaauaauaucagucacccaucacagaguuaauuuuaacuauuuaauauuaaacuugggaucaaaaucccacugauaacuaucauagguuacugguaguucuaacagggaguugaaauaauaauggcguucuguuuuggucauuaauuuaaaaauauuuuuaaaugcucucugggauugucagucauuaguuuaaggugaauuuucguuaaagguuugguuugagauuuugggcguucucuguguggauguguaaggguuuuuuuuuggccuuuuaucauuucuuuuccuucauaguggaagucaaaggcauuaauaaaugcuuguuaauuuuuuuuaacuaccuuugauuuguugauuguaaagaaaccuauuuucgccucuuuuucuuagggagcuuagucccguuacuucuuaccugauucucauucuuaacugaaggcaaacaucuauauucaaaucauaaaauuauaaaaugagaaucuuuggguuggaaaugccaucugguucaggcauugauuuuaugcugucucaucccccgaagggugaugauuguaucacuuaucuuauuccuucaguauucucuuagauguucccuagagcuacagauuuccaaacagcacauucaauaggaguuguaaguuuauaaucggcaaacuacaggaugcuuguuuuuuuuucuuuuaauuucugguguaaucugcuacuagggcccccauagaguuuauugucuauaucagcuagaacacugggaccacagucauaaacugaaggauccaggcaaacugggucauaugguuacccccaccaauuacagucuucagugaugaugucacuauccagguugauauucaguugaaaugcuagccagcuccuuccuaguuaccuucauuuacaucccauuucaguaccugaacacagucaugcuuuagacucugaaauuccuuagaaauaguaccauaagguuuauagcuuugauauuccucucugaucaugaucuucccucauaaucaccuccccaguucaggcuuuuaguccauuauccucuuuuucccugccugccuuucuaaucaggauggaaucaauggauaaccauucuuaccuauuccauugaacauccuugacuuggcugaaacccuucacauuuucuaaacauauuuuugucaauucuccauagcuaggaaaaauuaauuucuuucuuuaguugcuucugggauuucuaaaguaucaagucauguaaccuuaccacuuaauuccauuucuuauucaugcuguaacaucagcugggaucuuaauguuacuagaugcaccuaauuaucucugucuugaugaccuaucaucuuccccauagcaguugauccagcccaacuucauucuccuugguucccagcguaacucucucucaugcucuacagaugaccccuccaccgucauccauugugaauuucugcaacaugguaccugacauuugguaggugcccaguacguguuuguugaauaaaccauugaauuuucuccuguacuucagcaacucuuguaccuucuucuaucccuuuguuuccugucuucccuuuuaugauuauguucugcuggacucucaaucaucuccucucccuuucuugcauuuucagucucccucucccccacacccccaggcuucauccacccuccucccagauaauucuuucccauguguuacuaucuuucuacuauguguuuuuaauccuguugacaguugguaggaaauauuugaugguuuauucuaccuguagaaaaguccaaauucucuugcagggcauucagaagucucuuacauggcuucagccugcauuuucagccuuauacauguaugugacucuccuggcauccuaaaaccauugaccuuuucuuucucuaggcuuucauucccaccguucugccccaucugaaauauuuuuccuuuuuuugucaaaugggguuaauguaugauaaagauauuugucaacucuaaagugccacuucuuaugacccgucaaaaucuauauauuuauaaauguucaccugaaaagaugcagccuuuacaagucuuuacaggugccuugcucugcuauacuacccuugcuuuaccuuuuucuuauaagaccauaacuuaucuuccaauuaauuguagucauaucucuuuuuaucuguuagaauccaaacuauaguuuaugugucugguaugucuugcacauagguccucaauaaauauuagacaaaguaaauuguauauuuuaaauuuuuuuucauagcuuuugguaaggacuucaugguccacgauuggauauuguagaaagcuuauccagcccacugcccaggacgacuuugaaugcggaccaacacaaauucauaaacuuucuuaaaacauuaugaaauuuuuuugccuuuuuuuuucuauaggcccuguuauagagccucccaucuuuuagcaaagaacugucuaauacaaauguaaugugagccacauacuuuuucguuuucuuuuuuuaagauggagucucgcucugucacccaggcuggagugcaguggcgugaucucggcucacugcaaccuccaccucccggguucaagcgauucuccugccucagccuccuaaguagcugggauuacagacaugugccagcaugcccagcuaauuuuuuuuuuuuuguacuuuuaguagaggugggguuucaccauguuggccgggcugaucucgaacuccugaccucgucauccaccaaccucagccucccaaagugcugggauuacaggcuugagccaccgugccuggccuuacuuuuucauuuucuaauagacaguuuaaaaauaguaaaaagaaacaggugaauuuaauuuuaacaacauuuuauuuaauccaguauaucugaaauaucaugugaccaauaugaaaaauuuaauaagauaguucacauucuuuuuuuauguuucuuucuuucguaagaagucuuaacacuucuuuuaacauuuaacagcacgucucaauucauacuagccacacacuguguuugauaguuacauguggcuggugacuacuauauuuggacaguguaguuccuggaugacuugaaauuucuuaucacucuuuauuuuuccauuaagacagacgguuuguauaaccuaguaauguuuucuaaggcugagccacugaauuuuuauuauuguuuuuaacuauucuuguuuuuaaaauuuaaaaaaauugguuuggauucaguauaauuaguauaucaggucacuugcaccauuuuauuuuuuaacuucuuuuccuguagcccugcaggcgggcagggcuucuuucauguggacaaaaccagaaagguguugcaucacugauccacacacaaggugggcuccugccaacuggcagccuccuuguuccaggaaccagcccuccuuuugacacuugaaauguaaaaucagaauagaaguuuaacguaccugacuuaaaacaucuucaggggaugcuacgugacaauucuugaagaaggagaaacgagcuaccauuuuccuggaaacaauauuugauucacaguauuuuguuguuugguaguuaaugaggcuuguuuugauagaagaugaguguuuuucuaucgcuaauggggcauuuagagaaacauuccuuguaggaugagcucuguuuuaugaccucauugaaaaagagguaugaaaaagagguaaaucuuuaacauaggcaaaacagguaguguuucagaaauuuauguguaaauuaccgaguauauuuuucuccaguguuguaauggucauauucucagaucaccucaaaauaccuauuuaugcagucuguaauguagcauaauccagacuguuacuaacauuauguagcauaauguuaauaauaauaauuacguacauaauguuaauaauacacagacuccagccaucguggguaagauuuuuuuccaugggaaaauucauuuggaaagcuaacuuguaagacuagccagguaggcagccuagcccuggaggcagagcugcuccucaccuggaacugcagaaucugauugaacccagugguccauggggguugcugaauucguaaagcaaaugaaauguuagaagacccucuaauuguuguagagucacacuuuuccucuugcagaggagguacucacauuuuuuuuaagaaacaaucuuuaauuaucgauguauucuuuuagguuuagguuugcagacacuggugagcgugugcugagagguaacuugauguaucuuucuggauaauuagaugauuuuuuuuuucuauuucuuugaacauuuuuuuuuuaaagagcugcuuaagaucuggaggagugauuccuuuugaccgugucuuauuuucauuaagacuguauaacuuggaagaguuuuuuuuuuucuuuuucuuuuucuuuuuuuuuuaagaugaaguuuuugcucuuguugcccaggcuggaguacaguggugugaucuuggcucacugcaaccucugccuccuggguucaaacgauucuccugacucagcuucccgaguaauugggauuacagguguucaccaccacacccagcuaauuuuuguauuuuuaguagagacaggguuucaccauguuggccagguuaguuaauguuacucucugguuuggggggcagugauauguuuuggcuuuuuucccacccagaucucuucuugaauucccauguguuguggaagggacucggugggaggcaauugaaucaugggggcaagucuuucccaugcuguuccugugaagugaauaagucucacgagaucugaugguuuuaaaaagagggguuccccugcacaaguucucucucuuugccugcugccauacauguaagacaugacuugcuccuccuugccuuccaccgugauugugaggcuuccccagccauguggaacuguaaguccaguuaaaccucuuucuucuguaaauuacccagucucagguaugccuuuaucggcaacaugcaaaugaacuaauacagcucgggguggcuugugugggugcguauggccauguaugcaggugugcgugcauuggaauauacaauuccguauugaacccaguuuaaacuucaucaguucuggugauugcuggagugucacauauggcaagacgucaccuugcccucuaacuacaccagaaaaccaggccagcaccauugacuaucuagauacagugggccguuuauauuauuauuguuucauauuuuuagauuauuugguaaacaauuuacagaacuaagaauaaaggaauagugagaaauaacuauuagcaauuuuaauaagaguuaacauaguaaauauuuuaauuuuacgaagaauuuaaauaugguaaacccacauguuuauucuguauuuucccaguuuugaagguauggauuucugaaaugagcauuauccuuuggaaugcagcuagcugcuaaucaccugccaugcacgaaccugaaauauauccgucuuacaaauacugguucuacauuucaaauacaucucuauuagguucaucauauuucuuggucuuuuuuuuuuauacuugcaauuucauuuaauuauuguaaaaauuuaagauauuuaaaacauugacagcucauaauuuuauugaagagagaauauagccaucuucccucaggaauaaaauguuuucaaguuuggauuuguaaacagcuauuaaaaugaucaagccagucuuuuuuucccccuuuuuuucugcauuaucucuucuaaucaccuuagagagauuccugccuugggcauuuguccacuuccuaaugguaucaaauaaauguguugcacagacauaaaauguguugcauaagcaucauaaaauggcaaggaauacugucacaucauuuuagcaaugaugguuaauguuuuugucacauaauauugagugaugauauccuuccuguugaaugacuaaguggaugagaauaccauauuuccuuuuuauucuuagaaauacauugcucagccgggcgcaguagcucacgccuguaaucccagcacuuugggaggccgaggugggccgaucgccugagguugggaguucgagaccagccugaccaacauggagaaagcccaucccuacuaaaaauacaaaauuagcuaggcgugguggcgcaugccuguaaucccagcuacucgggaggcugaggcaggagaaucaauugaaccagggaggcagagguugcagugagccaagauugcaccaucacacuccagccugggcaauaagagcgaaacuccaccucaaaaaagaaagaaagaaagaaagaaauacauugcucacuugucaauucuugagcuugagaaaauucaucuaggauaucaugugaaggcucauagccuaagguuuuacuuacgugaucaauuucauucuucuucugguuuaucuaauugguaaaaugccuccuucugucaguuguuccuauuugccaauauguggaagaugauuuuugacuauauucagugagucuccagacuucuuuuuaucaugcuuuuuaaagagaugggaccucacucuguugcccagacuugagcgcaguggcuauucacuggugugaguauggugcauuacagcugcaaacuccugggcucaagugauccucaugccucaacaucccaaguagcugggacuaugcagacuuuuuuuaaaccaucuugaaagaugaugcaguacuuugggaacacagcaauaaaaaugugauaauuucccuauugcaucaccuuucuaggcaauuauaucauucuuucaugcucauauuauuuugucuucuuuagcacaguuuuuaaauaguugauggcuaaugaugaaauaauucuucggaugauaaauauuuuguaacauaggaacacaauauaggaaaaagaucgagguucauaccauaucucagacucaugguuaaguacaagcuagaaugaguuuuagucgauuaaauuucuuuuucucuaugaauggauaaagugagaauaucagcccacaaguaguuagaagugcucagaacucaaagguaaaauuguguccaagaccugaugguauucuaaagguuaacagccuauccuacuuaccaagaauuuacauuuauuaugaggccuguacaaccugaugcaggaaaauacuuggcauaauuuucuauaaguuagguaguuaggugcucaacaaguauuugaguugaaucacauuggcauucacaucaaacacauacaccuacgucaucauguuaacuuaagguuaauagugucaccaaaacuaacuggucuuuaaaaaagaaaaacuaggccaggcaugguggcucaugccuguaaucccagcacuuugggaggccgaggcuggcagaucucuugaugucaggaguucaagaccagccuggccaacauggaaaaacccccucucuacuaaaaauacaaaauagccaggcaugguggcaugugccuguaaucccagcuacuggggagacugccagagaaucgcuugaacccaggagguggagguugcagugagcugagaucgcaccacugcacuucagccugggcaacagagcaagacucugucucaaaaaaaaaagaaaagaaaagaaaagaaaaacuaaggaauaucauucuagacaugcaguaauuaaguaaaauugcaucaggagucuaauaacauagcaugaugggucccauguuucauuauuuccaugggcagaagagggauggcuacauuauaaauaaaggaaaauuguaagaauaagaaaagaugaaguaugaaauauuuccaacucaaaaacaaacuguaucugagcaugcagagguacaaaaugucaccuuuuuccuccaguguaaugaagggcacuaaaccucuugagcauuugauauguuccagauacuauauuaaagugauuuuuuuuuuuaggagacagguucuugcugucacacaugcuggagugcaguauugcaaccauagaucaguguaaccuugaacuccugggcucaagugauccuccugccucagccucccaaauggcuaagacuacaaacacauugccaccaugccugccuaauuuauuuugauuuauuuauuuuuuuuguagagacaggggucucacuauguugcccagacuguuuucaaacuccuggccucaagugauccuccugccugggccucccaaaguguugagauuacaggcaugagccaccacgccagaccaaggggugaaaucuugauaacaauaaucaaugcagucaucauaaaacgcuugcacaggcucaauuuguagguggcacagugcuacaucuagucaaaagcaaauuuaauuauggucauugugcucugagaacuuuucucagaaaauaauaaccagaugguauuauagauggugcauuucacaaauacaugauuuguaguuagugaaaacuugucauucaaucauguaauaaauuaugcacaugccggucuuccacuuagcuagugauguugaaacauucauagccuuaccugaugagcucaggcugucaugagaauuuaugucuauucaguacuuugucuuuaaaauuaggugagagagaaagagaggcuguauuugacuauauaucuuuuuauuuguaucucuggaguuacaaguuuuugaauauauaaucuuucagcugccuuucugcauugcauuuugagaaaugauauuaaaugcucaaggaaaaaaaaccuaacaacuuuagagggccgcaaagugaaucauacaaaagauaaauuaaagcuuuaaaucuuugccaguggaugagucaaguaagaguggauuuaaugaaauggcucauggcuuugagaagcagcugucauaaugcuggguuggcagcuuccaggacugugugaggcuuucugacugucuauacugaaauaggagaacucauuugaaaaugacgaauaggagaauagcagaaacuugcauuuucuuuugagggaacuggcugccaguuuugagguccuuauuuagaaaugcucgauuccuguauugaauaaacuuggacuacauguaugucaaaaagaaaagcaaaacacuuuuauagccuuaagcagauuacagauguguggccaaaccaguggggucuguuuuuguuuccaagcaggugauggcuggaagaggagaugccucuguagugcagggcuugaguugcugcugucugagcuacaucuggcaaugagacugugcugcuuacugagaccuaauggcacagguugccccaguaacaggauauugcugaaugagaaauacuguaggauucauuuguaagaguuauuuggaggguuggauuauucagugcuaaggauccuaagcuacugaugcauggacucuuuucuucccuccaguaucuuuuaauuaaacuguacaaauucccuggcuuaaaaauaguaggaaaagaggaagaaaauacagauucuuaugauuuuaacuggucucuggcaauaguacaccgaaacauuaauuucuuguugaaaccaucuggauauuuguaucuucaguguaaaaccccuaauuuagauaggacucuccauugugacauggaaaaauaacccuuuaauuaguuaauuaauuuuacuguggccucaaaaucuacauauuagcauaucaagccaaaaacuguuggcuuuacuugggagccauguggcuuaaacuaguaccaguaacuuaccacaaggaacucagcaaaauuauaaguccauguuuguuuuggaaggaaggcaauuauuacgaaaauaauuuagagauguucaaacuauuuccuuugaguagagguagagagugaacaaaaucugucccaagugggagcuaacuagcuuccuuuuuugcccucccuguuuacaaaguaacacuuuuaguuuacuagguaacauuugcaguauccccaguguuucaauguaaaauuguaggugguagacuaaugccacuuagccaaagccaugaucaccugaauuuuuaauauauauuuuuguauggagugagauacugggagaacagucuucauuagcuuaaacucuagaauguacuguuuguuuguuuguuuguuuguuuguuuugagauagagucucgcucugucacccaggcugcagugcaauggugcaaucucagcucacugcaaccuccccucccaaguucaagugguacuccugccucagucucccgaggauuacaggugccugcuuccacacucagcuuuuuuuuuuuuuuuuuaauggagacggagucucacucuguugcccaggcuggagugcaguggugugauuugggcucacugcaaccucugccucccagguucaagcgauucuccugccuuagccucccgagucgcugggauuacaggugccaaccaccaugccuggcuaauuuuuguauuuuuaguagagacgagguuucaccauguuggucaggcuggucucgaauuccugaccucaagugauccacuggccucggccucccaaagugcugggauuacaggcauaagcuaccaugcccagccaagaauguacaauauuuuuaaagaaaugcgguuuauuaccauaaaauacagguugagcaucccuaauccaaaaucugaaaugcccuaaaauccaaaauguuuugagcacugacaugacagcaaacguagaaaauuaugugacuuuauguguucaauguauacaaacuuccuuucugaaacaaaaauuauuuaaaauguuguauaaaauugccuucaggcuguguguauaagguauuuuugaaacauaaaugaauuuuauguuuauacuugggucccaucuccaacauaucuuauauguauggaaauaucccaaaauuugaaaaaaaucugaaaucugaaacacuucuggucccaggcaguuuggauaaggauuacucaaucuguaaauacaguagcucaaauugauuuuguaaggcagucaaguuauuauuuauaguauuuuaauuuguauuauucuuuuaauauagcaauucauuuuauauauuuauauaaauaaauuuuuugcaauugagcaaauuaaaaaaauuaagugcuuccuucagaucuacauuuuauuuucuauuuguuaucaauuuaauaaguaaaggacacacagaucaucugauuguguugucagacauuugaaggugcaacugaugaauguucacuguuguacuuuguuuugucauguaaauuguuuuaaagagaagugaauguugagcauauaguaggccacacgugccuguggauuggcucauuguuuuaggaauguguaauucuggaaaagauuugccaaggguauucaaaaguauaguuugauauuagaaauuauuugaaaauaaucuuuauagcauagcaccauuuuauuuagaucaauaguaauucaagcaguauacauaauuugcuauuguaagcguagcauauaaccuaaguuuucuuuuacauuugagaccacuguuugcuguuggucgaauuuggucuuccaagauuuuuugcuuagugaccuaauugccagccuuugugaagagcuguuacuuauugucaaaccaggcaguaaggguuugcuuuuaucuuuuuaucaguucuuucaaugcuaguagucaugagauuaauguaguuggauacuaaaauguuaauacguguuagauaacaaacugggaaagagaugaaugacaucaugaaggaaagggcaguauugcacuuacagugauuucaugaugauagaacuaaccugccuaaaaagacauuggguggaaacagaaaccagguguaauagacgcauccaaguagucaaggaaagaaaagacuuguaaguaaauaagauaaucuuugcuucaaaaauaucuucaaagguuuaaaaugugcuuuacccucauauauaaucuuuuugagccuauuucuuuaccucaaacauggggaaaauugcaauaaucuguaucacgguauuugcuuccaaaacgacuaauugguguaaaugcauaucaagccgguaaaguuuacaguggacuuguuuaaaaugcguagauuggaauuguugggggagcaggccagcagcaugggauguuuuuuuuguuuguuuguuuguuuaagacucugucgcccagacuggagugcaguggcacaaucucggcucacugcaaccuccgucuccugaguucaagcaauucuccuaccucagccucccaaguagcugggauuacgggugccugccaccacgcccagcuaguuuuuacauuuuuaguagagacaggguaucaccacguuggccagacuggucucgaacuccugaccucaggugauccgccugccucgggcucccaaagugcugggauuacaggcgugagacaccgcgccagcuggggugauuuuuuucuuagucaaaucacuucucuacccaucaucucacacugucgaauacaaagacucuccuuggggcucaaugacucaucucccaccucugguuugauaaucauggcuauuauaacauguucccuuuuuaauuaguuauuuuaaaauuauuguaggucuuguaaucauaaucaauaauaauacguaauggcuccuuaagcacuucuauccuagauaagguugagaacauuauuaaaauuaguuuugguaguaaucaaguaaugauaauucuuauuuaugaauuuaaauauguaggaguuuuuuuauuuuagggaagcaaaaaggacuagaaaguaugaugucucaugauuagaaaacugcuauaaaaaugaagguagaauugauuugggcuguuuuggacauuuuaaauagaaauuuaaauagguauucaaauagcaaagucauucuacuuuaaaacuucuauacuuuuuuaggaucuucaauuuuauauuuaaauuauauuuuugaaaugguuuuagaagaaauauuguaucuuaaacucuaacuacuaauaaguaagagaagauauaucaaagguuugaucuuuuaucuccuagaauauacuauucauucguuucccauuguacgucauuugaauguuaaugguuagccucaaaugguuuucaacauaauuguauagcuacuauuauuggaaaauuggagccaaggacucauacacauaucagaagugguaaugaagcacuuugguuuuaugaaaauauguuuacaagguagucacaggauagcaauauugcauuuacuguaauacaaugaugguggaacuaagugcaguggaacaggaugcugagaccacaguuaccgcaucucuaagugccucgucuaguuaugguccaaccucagauauaacucauugguguugaaacacaccuagcaacauuuuaagcauagaccguucauuaaaagguaccuuuuuaaaaauuuuuauuuuuaaaaauugacauguaauaauuguacacauuuacaggguacacagugaucagaucagacugaucagcauauucaucucaggcauguaucauuucuuuguguugggaaaauucaauauccugcuucuagcuguuugagauuaugucauauauuacuguuaacuguagucauccuacagugcuguagagcacuagaacuuauuccucuuaucuagcuguaauuugguauccuuuaacaaaucuuucucuauccucaguuucuaccuacccuucccagccuccaucauccucuguucuacucuuuacgucuaugaaaucaacauuuucuagcuucugcauaugagagcaugugguguuuaacuuucuguuuuuggcuuauuucacuuaacauauguccuccaguuccauccauguugcuucaaaugacaggauuuuauucuuuuguauggcuuaauaguauuucauuauacgugcaugcacgcacggacacacacacauacacacacacacacacaucacauuuucuucauccauuagucucuuuggacaucuagguuauuccauaucuuggcuauugugaguagugcugcaguaaauaugggagugcagauaccucuuuuaauauacugauuucucuuccuuuagauaaaugcccaguagugggauugcuggaucguaugguagcucuauuuuuaguuuuuugaggaaucuccauacuauccucaaaugguuguacuagaacagagcuuuuuuaccuuccuuccauuugggaaucuucuuacccaacauguauauuaguaacuuggcuauguauguuccauucucugucucaaauacugugucuaggacaucugcaaucuuuggcuaugaccacgacuguaaagugcaugacgcuuuugcucugucaucaguauuaguugacaggcaaguaagauaguacuucucuucauaaccccuuuaccugcccagcagaauaccaguacagacagacccagaauaucucugggcucaagaauccagacauuuauaggaugggacuuuuaucuauaaaucaccuuaagauuaguaaguucuuagaauugguuaccuuugccauuucucagaagcccuuugucuaguaaccugugugucacugucauuuccagccugucuuuccuacacauuguuuaugcaggcuuuaggagugcccaccccccaguucuaccccccacccccacccuagccuuugugguuuuaauuauccugucuuggcugauuuuguuuuguuuugacauuucauccauuaaauuccugacacuggcuaucucuuuacaauuauuauacuauuuuucuuucuggcucgcucuuccugauugcuguaauccaugcccuugacuuuaaauaccauuuguaaguagacuaggccaagguuuauuucucuaggccagacucuaccuaguuauuucauaggcauaugaauccuaacauguccaaaugagaguucuuaauuccccugcuacccaguccucaaugugguucucucaaagcuauucuaucucaguaaugguccuaugcccucuccuagggauuauugcugagaaccuagaacucaucaucgucucuucugcacauccuaugaauucuggauuuauccacuuaucuccaucuuuuccagcacuaaucuaaacucccauuguuucuugcuggaguuauuuccguauccugcuaaucucugcucucguucucucucccugacacaugcgcugcuuucuucucccacaccaagccauucucuguacagcagccaggauguagaguguuuauuuacauaaagcagauccuggaacccccaaauuuaaguuguguucguggcuuaccaauacgcuuaaaaaccaagugcacagagagaaaacaaugaagccuuauuuggauaugcugaggauaauugauaacggguaacaacuaacaaacacguaguuggugucagguuugaccuccuacauuccuuacagguauuaguguauuugacccagcuccucccuaccuccgcaguaucaccccaugccucucuuucccccgacucuccccugcucagugucacacaagucaauauccccagcuugcuaacccccgggcugacagaucucauugucuauaauggauguuccaaggucccaccuucagccucaguuuuguugccaucuuuccagaaugaauucccuugaucauucuguuuuuuggagacaagguccugcucugucaccuaggcuggagugcaguggcaugaucauggcucacuguagccuugaccucccuggcucuggagauccuccugaguagcugggacuacaggcugcaccuggcuaauuuuuuuuuaauuuuuaguggagacaagaucucacuuuguugcccaggcuugucucaaacuccugaacucaagcaguccucccaccuccgucucccagagugcuagaauuacaggcaugagccaccaugccuggcccugaucauucuuuucugaagaaaacaccccuucuucauuauucucaauccuagcagccuauuuacuuccauucugaaaugaaucacauuuuaguauuuuauugguucguugucguucucuccccccauagaauguaaucucucugaguacagggagcuuaucuuuuucccuuuuggagccucggauccagcagaaugccagacacuuagcagccacuagcauuugaugagugaauggcuuuucauacacaauuuuagacauuguuccugauuggucucucuagucaauaauagauuuaucaaaucuaaucgauaauagauuucuuuuucuuuucuuuuuuucuuuuucuuuuucuuuuuuuuuuugagaagucuugcucugucgcccaggcuggagugcaguggcaugaucuuggcucacugcaggcucugccucccagguucacgccauucuccugccucagccucccaaguaacugggacuauaggcgcccgccaccaugcccagcuauuuuuuguguuuuaguagagaugggguuucacuguguuagccaggauggucucgaucuccuguccucaagauccgcccgccucagccucccagagugcugggauuacaggccugagccaccgugccuggccgauaguagauuucuuuuauugauuagagagacuaaucagcaacaauguuuuaaaauucucacauagaucucugaaugggaaagcagucuugaauuaugcuugcagggagagagaggggaaggaaggaggaggaaugguauaauuagacuucauaaggcuagauuuuguuucuacuuaaauaaugguaucacagugggacauauuauccaugcagaaagugagugggcaucuggucuauuaucuguggucuuucaggaauggcagcucuuuaguuuaaaaaacaacaaagugcagcacuguuuauuuaauggaaauagaaaagcagugccuguguauuaguggcucagauuuuuuuguucuuuguuuucagcugucugcuguaugccucuccagcggggucuuacagaaucucaagucuaccaugaucaaagcugaacccauuagcuccauuucuuaauuccuccuguauccucuguuaccauuaguaacuauucuccaacucaaagcaucagauuccuccucuuacucacucccuucauccccagucaccaguucugugcuguuauuuuauccaaguucucaguaggcuucacgagcaccgccuucacaucccaacugucgcuccuccaccuaucuguccuccaugcuucugcuagcucauguuuguugcaauacaacuaaccuugccacucuucugcuucaggcuuuucuacuaggcucugcaucuagaugaugguccagacuccucagccugugaaacaaagcccuucauaaaagagcagagcuacagcuagucagcucccuuccugcaguccacccccuccuccaccauacugagaauuggcaauuccuguagcacucuuuguaugaguccauuuucacacugcuauaaagauauaaccaagacuggguaguuuauaaaggaaagagguuuaauugacucacaguucugcauggcugaggaggccucaggaaacuuacaaucauggcagaaggggaagcaaacacauccuucuucauaaggcggcaggaaagagaagagcgaggagcagagugggaacagccccuuauaaaacugucagaucuccugagaacucccucacugucacgagaacagcauggggaaaccacucccaugauccaauuccgucccaccaggucuuucucuagacacauggggauuaugaggauuacaauucaagaugagauuugagugaggacacagccaaaccauaucacucuucaucugcuacgggugccauucccuguuucuacaguguccuguuugcuaccuucuuuguagauuucuauucauucaucaugucccaguuuaccuguuaccucuucaacagauuauucuucagucugucccucccaaacuccaccaaugaacauucuuuguucagcccauuauuguuaauaugcacuucacugaaaacacuguuuuaugcuuguuuacaucccaucucugcagggcucugagccuauagucagcaguugggaacuuacuaggcauagcgcccaguaaaggauagcucuuuauauauauauauauauuuuuuuuuuuucuaaaauaauaagccccaagaaaaacauuaccugugaaaaacaaaugauauuuuuauaccauuuucaaaaccuaauagcaauaaaaagaaaagaaaugucauaaguauacauuuaagcuguaguuaaaaacaguaaauaggcacaguauuuaacucuuaucaugugcuguuccaaguguguuauuuacaucauuggcuguucacaccauccccugaggugguuaauauuuccaucccauguuaaagaugaggaaaccaagucacagcagccuaagugacauguucauagucacauuggagcuggcagguggcagcacugagaaugaaacccacguggcugagcucuggaaagucaccauuaaucaccacacuagaccuucucucuaggaucuacauaacuagaacauacaauuaacuggaguauauguaaguguagucguuccuugagaaaggaaaagaauucacaaauuucauagccucaucccuugugcauuuguggcauugugcuaggggugucuauuugauauuugacccuacagauuucucagaugccaaccaaccacagauacuuuaaaaaaagauacuuaauacuuaccaaugcaagaaagugggcuuguuggaagaggaaaaauguuagcucacuaauggaaaaucaacuaaaagucuuaccucuccagaacaugcuuuuccuaaauguuguggcuaacccaagaagcuacaucaucuuuaccuuuaugauacaauuuaaaguacuuuucuacuuacuucaagcccucagagcacagaggcaagggaggccuugggcuauaaacccuguagccugagccacauggcuucuucuccuggacagauaccuggcauauucugccacugaggaucaguggugcagauguaucuguuuucuccuaggaauggggcuccacuuacgaaucuggggcaggacaagguauugcugcauuuuggggagcgugcuggaaggaggagcagaguuuguuguuuuugcuuccugauauggacuggcugugucuccauucaaauaucaacuucaauuauaucucccagaauucccacauguuguggagggacccaggggagguaauugauucaugggggcugaucuucucuguacuauucuugcgauaaugaauaagucucacaagaucucauggguuuaucagggguuucugcuuuugcuucuuccucauuuuucucuugccuuuuccucauuuuucucuugccgccaccauguaagaaaugccuuucaccucccgccaugauucugaggccuccccagccauguggaacuguaagucccauuaaaccucuuuuucuccccaaucuuggguaugucuuuaucagcagcaugaaaacagacugauacacuuccuuaacagaaccaauuauuuuuucccaaaaaagagggggagaagcccagaagcaugcagcuucucucuucuuucuaaggaauaggucuucacaaagugcccccaaaagaaaaggaccaggcuuuucucuuacuuugugacuuuccuagguugcuuuguagccauuuuggacacagaccaccuauagcuguguaguaguucucauguguauggacacaguggaaggagaugccaggcacauaguucuugcugcauugacaccuuuucagggcaucuucuuuuaccaucuucuguagaaacugcaacagcccggccaacuaccagccccagcccaccccuagcuuugcugcuuucauuuucucuguaacacuugucaccuuguaaugugcuaguguaacaucguuguuuuaguuuucuuauaucuuuccuucccuguagaauguaaauaccaggaaggcagggaauuuugucugcuuuauucucugcagcaucccuagacuccagagcagacccuggaacucaaauauuuguuagacagccaaaggucauauacuuccaacucuccacccaaaauauauauggaucacccauccuuaguagcagcuaaaccuuuggacaugaggaauuugcucguucacaguuuucuggccuagcaucugauuaaccaaacuuuuucacauaucaagaauuuaaaaugacuccaaaacuuuuuaugaccuuaggugcuucuccuuaauucuaguugguucauaaagcugucagaacaauaaucugcuuuugauaauauaugacuuuucuugccuccaagauagccuuuaaaaaagcaauuuagccuuuuacuguaauuauauuccaaauuuaagucuugccagaauaucauuuucccccuuuaaacauacuuuuuaugaugccaagauauuuuaaagaaaaguucagauaggaagcauauuuaagaugucaguauaugucucuaaaaucuaagaacauuuuucuacagaguccagaugauaccaucucacccacaaaauuaacauaaauuuuuaguaccauuggauaccauguccauauucagauucucccugaguuccagaaagguccuucacagguuaugcauuucacauccuauccggcaccagggccagcaucuuacauccuuaauucuuaggauucagaauagcacuuuuuauauccugacacugacuugcugaagaagcuguaccaguuuuccuauaaacuguccacuccuuggauuugucuuauaucaugucccagggguauuguuuagauuguugcucuauugcuaggauauucauguuacccuaaguguguacugagauagcagaguaaagagagauugucuuuuaaagguucugcccaggaacugcugguuuacacaaaagcugggcuuuagugcuucucggaucucuuugcuuguuucaguaauuuuuuuuuagaaauucacuaauucacuaacguaaguggggcaggguuuacaggagcauguguugagagaaguugguuugacuuuaaauggucauuuuuacaauccguauuuaggccuuacaggucgcauacaaucucugucacauauugcugucauuuuuacccccuuucuuuucuuuuuauaauccuuuaaaaaaugcaaagcccacccuuagcucacaggauguacaagaacaaguugcggguugcaguuugccaagaccugcucugugccacugcugacuugccauucuuggagcccacuuucuguucuugucagccaauucccuuucaggugcucagguuucccucccuccugucaccgggccuuugcacaugcucuacccacccugccuaguggagagcuaucuuuggccccuggacuucauucacuucggaccuucuuugggucacauuucagucaugccucacuagacaccuggaaucucugccucacuagacacacuagcacucacucuuuugggucuucuggcuguauguaauuguuaucagggcaguaauuuugcauuuauacaggugcugaggucagugucuggccuuuggcuacuugccuugugagccaccuuugcuuuccaguguaccccuagcuccuggcccaguguccagcuucccagcauccauucauguuuucccuggagaccauucugugcccagcagccagagacaucauugcaacuuaaaucucauugagucguuccaguugcuguaagaaauguaaccguacuggguaacacuaugccugucugucuccaccaccagaucuuauacuuccucccucaucugcuacucccuaagcucacuggcccuuuguuguuuuugcugaacgugcuaaucucuuccucacaccugggccuuugcacuugcucuuaccccugccucagccauccaugcacucucuugguuuugccgugcccgacuucagcauuuuuaguucacauggcucuuccguggggcccuucccugaccacccuguuugaaaugcuacccaucccuggcacacaucuaucauagucauucauuagcaauuagccccaucuccuuucccuauaguacuuuuccauaauuuuuuuucuugcucauauuacaccuccccaacuaauagauagauuccaagaaauugagugcuuuaucuucacuaccuggaauaguacuggcacuugguaaagcacagcgaauauuguugauugaauuacuagggguuggcuuagagagguacuuaauggaaugauucaauggaugaaugaaugaaugcauugccacuuuuuugcucauuaucaucaauuuguacauaugccuuucaacucaaauauuuauccauuggcuaaagaaaaaaaauaccugaauccccgugucucugcaguuuacccuuccucacuguuaaaacucagugccuguguaaaauuucauuauauuuuauuuacuucuuauuccacuugugcauuauguggauauuccugccucauccccacagccaccuaucacuuccggccaacucagaugccucuggucgcaacaaucacuucucuguugaauuucugaagcguuuaaucugcaguaugucuguuacucauacagcaguuagugugaauugucucacucagaauaaguauucauuaaauguguaagaaugaugauauagccuaauuucagaucaagauugugauuuauagcucauucuuaaucagcugugucaugacuuuauuuauuuauuccuuuuuuuuuuuuuuuugagacagagucucacucugucacccaggcuggagugcaaugcagcuucugccuccugaguucaagugauucucaugccucagccucccaaguagcugggauuacaggcgugcacccccacguccagcuaauuuuuuguauuuuuaguagagacggaauuucacuauguuggccaggcuggucucgaacuccuggccccaagugaucugccugccucggccccgcaacgugcugggauuacaggcaugagccaccuccucaggccugagucaugaauuuuugguaguccagucaugugguuaucuuccuaaagcuggaggccuuaaaccuagggccccaggugggcuuaugccuuuagcugcaaguaacaagaaacccuuuucaaccuuuuuacugauuuauuuagagagaaguacacauaagagguaaugcaaguaagcaaaguuuuuuaagaccacacaacuagauagccagcauccggaccagaacacagagacuugcuggccccuagaauccucucuccuggccccugccaguuacuggccuuuccccugaguucuauuugccugcaguuugcuuguuuucauauuuaauucaaauagaauuaggugauguguccccuuguguuucgcuucuaacagugccuuuaugcgggagaaguacuggcuauuucuuacuuugcccucccuccccggaaacauuuuccuaauuuaguagcaguaauuucaaaaacugcuuuccuuucggacaaacugacuuauccagccauuguaccuuccaguuuagacucuggcaguuuggagaguugagacagagagaaggagaaccgucuguuuaucuucuugaaaaaaacuacuguauuuucucucucuucugacucugggagccucuagacucuuuuuucccauuuucauauccacagaggaagagucugaaccucuuccugcugagcuuuccccugguugguugcauuucaggaacugacauugguugucuucccucuucccucaucagugcaaguagguuggaucucaugauaguccauauucacauaaccaugagaaucagagcuuucucucugucauuuccucccuguuuaucuguagcaagaagaaaaaaguccgucuuaacagagacugugaaagaauaaauauagacuuuauuguuuuagagcaguuuuagguucacagcaaaauuaggcagaagguacugagauucucccauauacucccuguucauacacuugcacagccucucccauuaucagcgucccccuuagagcgauuuguuacaaucagugaaccuacacugacaccauuauuaucacccaaaguccauaguuuacauuagcauucucucagcauuguuuauucugugaguuuggaaaacugucuaaugacauguacccaccauuguagugucauacugaguacuuuuacuaucccccaaauccucuguguuccuccuguucgacccucucuugccuuuaaccuuuccaagccacugaucuguuacugucuauaauuuugccauuucuagaaugucauauggcuuucuuagaaaauacaaauggugacuuuuuuggcaugacuuuaauaaacagaaaugaaaauuggugugugaaucaaaaucuuucacucuguaaagggacuuaucaggcggcaccugcauguggaauuauaucaaggucagcuuuaguuagaaacagaaggagagucaccuuugugaugucauuucuccuucauccaaguaaaaucucgcaugcugacacauaaaauuuuaucaucagugauuuauuuccucguaggaaugucccuuugaccuuauuaaauucagauacucuggggauggucagcauuuucagaugguucccuuguucuguaaaaauguuuguuauugguguuuaaaagcuguaaaagccacccacuauaaauugauagccacuaaagucugcgaaugugguaugaauguuccacuauguugccaagcguuuauuuuauugugaguuguuauuugauuguuuguaaggaaauuguuuuaugaugcucagcuuuauauuuccauaaacuguuccucccuugcaacuccuuaaacugugaugagcuuuucaaaacaaguccacaggacaacagucuguccagcauuugaagaagugguggaaaagucauuuuuuuccuuucaguguuucuagcuguucaugaaaacugcaguuaaaaguuguaauguuguuguguuuggcauucuuugggaagaugcagcauuauucaaacaaaaccgugugcucuuguuuuaaauaguguccaaaugaauaauugaauucauggacaucuaaauuuaauuccagaaaucaaagcuaugguaauaagaacuuggaccugaguucucuuaggccaaguaauuuaauuccuuagccgguugaacuauuuauuacgugucuccguuccugguuauuaugccaguaaauugcucaggcagaugcagggauggaugaugggcauauaauucacucuuuuucacggcuagacacauaccagaaugcagaucacacuaaacagcuguuuuuacaaacaugguuucuauucagagcuuuaagggccacauccaaguaauaacaaagaagccuggagaaggaaccuggggauacccagggucauguuuucaccaucccaccuggaaacacggugcuguccaaacccuggaugguacacuuggacaucgucauuccagucaugguucaagaucacguguauacaucaugauuuaaagagaauacugguuugauuuuucuuccugacuuucccugaauuuuccacuuaaauuggaaaacagcgcuaguuagugcccaugauuugauugaauaaguaagagaucucaaacacgguaaauuaacugaugacaugcaucaggucaucuuucuuugauucaccaguaauacaacagugagauccuacagaaaaaugcaaaggcagaagcucagggcagcugagcaacuguuaaggauucuuuugaaauguagccccacguaguaaacuuucgugcaauaauuugggcagucaaaaaaaaaagucaguuauuucaccucauuuauuucuacgaggagauaaaggcuuccaacaucugauuuucagugccaguguuuucuguuucucuuuucaccuauuucguccuagucuuguggaaauguuacaauaacugauuaggauuuucucuguauuaacacuucauuuauuaacauaugaguaaguugcuauuaauaaauuauucugcuuaaucaguuucuuuuuauucuuuagccacaugcuaaacuucuucggaugucuucacuuaauauccuuacaucauauuuaaucagaguuagaaaggcguuccacuugggggucauacacauuuuuuugaaacuuuuauaaacgcccuuuauacuauucuuguauccuacguaaucagagucagguguuccauggggaucauacacaucuuuauacaacuuguguaacacaugcuuuaaauccugagguaaucagagaauuccugccauugauggauuaaucucuuuacauaucuuucccuuucacucucagcaaaacuacuuauggcgguccuguuagacuuugaaagccuuucagguuuauggaggagucuuccuuucuauugucguagaucauggaaucauaguguucgcuugucucacguguuuggaaucugauuuccuacauaaugcugugcucucacuacgaguccaaggcuuccuguggcuacaaaucccggguuccuaucacuuuucccaaugaugagcuucuccuuguuggccagaaucagcucugugguaauaauucccuucugcuuucucccucucgcuuuuuuuuuuccuucuggguacauuauaaugucagcauagcagcuuuuaauucuauuacuaugguacuucucgaauagaccugugguaguugccccagaaagguugaaacccccugccacaucuaggucuuucuccuguauugguuuugugaucugaucaaggacaucuauuccucuaguccugcuaggugguauacgauaggcuuuuacuauuagauauucaaaugcugucaaccaugccugccuugacagguacaugauuuccacaaggauuuccuaauaggccuuuuuaauuuuguucuagacaugcccuucuuuugccauccaaauuugcuuauuuuuuacaaacuaugaugcaucagcauguaaauguuuaauaccauaaauauuucugauccucuucccaauuucacugaguuacugguuaucucuugccauuauucucagcauauugcaguggaucucagaauauuuuccccugaccaccagcaucaguauuaccugggaauuugaaaugcacauucucaggccccaccaaggccucaugauucagaaacucuggagcugcauuagaaacugccacaggcaccuggugaucuguguugguuuuuguuuguuuuuaaggagacagugucuuugucucccuggcuggaaugcagugaugcagucauagcucacagcagccucgaacuccugggcucaagcaauccucccgccccagccuucugaguagcuggaacuacaggugcacaccaccaugccuggcugguuuuuguuuguuuuuaaggaggcagugucuuugucucccuagcuggaaugcagugaugcagucauagcucacagcagccucgaacuccugggcucaagcaauccucccgccccagccuucugaguagcuggaacuacaggugcacaccaccaugccuggcuuuuuuuuuuuuuuuuuuuuaauuuuuuuggagacagggucucaccguguggcccaggcuggucucaaacuccuggccucuagguuuuuucccaccucagccuuccacagugcugggauuacaggcaugagccaccacauuuagcagguaggugaucuguguuucaauaagccuuccaggugauucugaugcucacugaaauuugagaaccacugaaauauuugguuuucuacaaaacauaagcaguuaguaaccauaggguacgcaacuaaauaguuccagcaggcaucccugaccacagggcauugcagauuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucagcuucaucuuccaccuguguguccaguuuaagcucucaguugcaguuuuuaaaccaauuuccaccagcauauacugaguauccgcuaccgugcaaugcguugcggcucuuguaugugcacuaugagaaguaauucccauaauacggcaaacucaguuuugauauccaccaccccacuuuuuauaauggacuacauuuuucagagcaguuuuagguuuacaaagaauucaagcagaaacuacaaaaaguucccucuaccucucacuuccccacuccccaacaguuuccccuggauuaacauuuugccuuaguaugguacguuugaaccaauaucgauacacuauuauuaaccaguauuccuguuuuaacaugagaggcgacuuuuuguguaguauagucucuugguuuugacaaaugcuuaaugcuguguaucuauuauuacuuaugacaguaucgugcagaguaguuucuaaaaauccucucuacuccaccuauucaucccuuccccacucccccugaaccacuggcaaccgcugaucuuuuuauugucuccguaauuuucccuuuuccagaauguccugugguuagacucauggcauccccuuuuagcaacugcagaaacuaagaacuguccccaaggauaaaaauuuuugcagacccacugagcugggauuuauacuuagaccugcugaauugaaguuuuggguguguuucuucucaaauugccaaaauuccauauggacgacuuuucuuuuccuucccugaaauguguuuaauugacuuuuucuguuauuuguguuugccuucacagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagguaauccaccauuugcuuggauuccccccacccccaaggaaaagaaagcguaauaccagaguuggaaauauccacccuagcaccacugccuuccccaaucaaaaacauguuuuuuuuuccaaaaggcuucuuaugcuugugaaauuuuuuugguuuaacaagcaaacaauuucaaauaaugugaaaucuuuauuauacaguuuguuuuguaccuuguauaugcugcuuggcaaaucccaaguuaauucuacaagacuccgcccaaccagguagucaucuaauuugacaaacacugaguuaggugacuccuugguauuccuuuggcagugaguguuuguuauauaauauugucuguuaccaccuagacgaugagcuccuugaggguaaggacuugauuuuauucaguauugcacagagugccuggcuuguaguuucgauaaaucuuaguugagugaguaguugugauuagauuucauuaaagaaggagauuugggccaggcacagugccucacaccuguaaucccagcacuuugggaggccgaggcaggcggaucaccugaggccaggaguucaagaccagucuggccaacauggugaaaacccaucucuacuaaaaauacaaaaaugagccaggcgugguggcacgcaccuguaaucccagcuauuugggaggcugagacaggagaauugcuugaacccaggaggcggagguugcagugagcugagaucacaccauugcacuccagccugggugacagagcaagauugucucaaaaaaaaaaaaaaaaaaaaagauuuggugaguaucgcauuauuuuaugcuaugaauuuuaacagaggugauuuauguugaguuuacauuguuuuauugggaaguacggcagugcuuucuucaagaaguaaauauaguauuaaugucuuagacuuucucuauugaauuaauguuuguguugcaaauauugugaacuaaaagaacuaaaggucauacuugucuccaugaaauaaaaacaaacauucaguugauauuaaaugaccaaauguuacagaaacgaguaaacuguuggauugaguuccuuaaagaguaugcauuuguuccuuaaagaguucugcauuucauaucugccaucugcuuggcagauaguaaaagaugcuucuagagcuagauugaaugaauauguacuugacugaauuuuaauguacugcaaauacuuauaaaggucaaccacaaauguuacagcauuuacaaaaaguggcuuucucucacuuuuugcuaaaguuuaaugauuucagauuuauuguucuauuagagcuuaacaugggcuauuuugucucccucaacuauauucauaguugucacuauaguauuuucuucccuuuguugcauuuuuuaccuuauuaagguguaauuuacauauaaguuucauuugcuuuuaaguauauaauucagcggcuuuaagaaauuugccaagcugugcaacuaucaccauaaucuaaucuuagaacauuuucgucacuccaguaagaucacacauacucacucccaguuaagcccucuacucaccucuagccccaagcaacaacuaaucuacuuucugucucuauagauuugcccuuuuuuggacuguuauuauaagugggaucauauaauacauggucuuuuguguccgacuucuuucacuuaacacaguauuuuugagguucuacauuucuuuaacuugagcuuuuaaaauugagauuauucugaauuaaacacucagcguuagcuuaaaauuuauugaaaguuuuacauguucuuugaaaaaaaagaacagagugcaagauggauuaaguuuaucauucccuacuuaaugacaguuucuuacucacuuuagcacauaaguaaaugugcuaguaaaugcgcauuuuguuuaaaccaccauuuuucaaauacugagacaugcuuucucaggguguuuuucauacaacuguuaggaccaacuauggcagaucuggucaaaugaacuuguuagccugaugccuguagcagggaaggacagcuuuucagggcuucucuucucgaaaccuaaaugaagugugaauacaaauuacagcagcuagcagccugcagugggacugaaaguccuuggugaaucuccaucaagcugggcuguuuaauagaaccaguuuagugucccauuuuacuugaaacauuagauuuugagcaccugcuugguacaagccauuuugcuaggccauguggaauggaugaugagcacacacagaccagcuaacccuaguggauguuaaaaucucuuaggaaauagaagucaaagaaguacaaagccaucuguguuguaagaaaugugaacacagaaccugccuccgagaguaagagggaacuucuggauugaucagagaagguuccauggagagcaugacauuugaacuagagccaaaaguguggguggguggugugucuaccaguggauuuugcuguagagucaucaggacuagcaaaacaaauguggugccauggaaaggcauauuuaggagacaggauugguccaauuuaagcuagagcagaugucuuuuagguugggaccaaaauauagagaccuucaaugccaggcuggcaaagaugggcauuaacugcaggugauuaauuaacaaauauuaauucagaagcuacugugcgcugcagauuuuuccaggagacaauaaagagauuuuguuuugaugcuaguacuguugagguaacaggugaacaaggagugacaucaguuaugcaguacaaugagaggaugccacauaaacuuaggcccauauucuagaacaagacaauuugcuugagauaaauuggucucauuaucgucugcauuaguccaguucuuuuugcuugaguuuugcagguaguauuauuugauauuaagacggaacacagagauguuguauuguuuuauuuccuguagaaagacgaaggcaguuaaaagaauuucauaaacaaaacacuccaggcuaaaggcaaaaaagaaaugaaccuuaaaaaauaacaaguuaauaauuuuguuggcaagaagagcaacaaaagcaaccuucugaaagcaagauaccuggucauugagagauagcaacuguuaaugccccagaaauagaggaaucuuuaaugcagguccauucauuccaccucaaacuccugaacaaaagcucuaauugaggcaagucuuccugggaaagggggccuaacagaaacauguuauggucaguugugcccaugcgagauaauuuuuuugugcuuguagcuaauuccaguaaagaaguagauguuuuagaggguaacguuaaaggggucagcugcaaagaguccuuuuccuccuccucacuguuacaaaaggugacuugugguucuucccuaauugagagcaauggcaacgccauaggugauuacucauuuuguaaaacucuaauuacaaguagguugcuucuguguucaacauaaaaauuagaagugacuugcaaagaugagauacugcagggaggcuuacaaucuuguuuucaguguuaguguuucaguaccuggaacaaaaugugauuuacagccauccuuucuaagaaaauugucaucauuaccaacauauugcuacugauaccaguccuuaaugugcuucauaaaaaacucaauaauuucauaacccguuaaaaccggaaagaaauggagggaagaaaaauaagacacuuuuagcguagucauaaucuucucugccauauuguguuagaaucgaugauacccaaaugagaagaugucuguucucugucacugauuccaguagaauaaaauuauuguuuaaaaguaagcacauucgcugcacuccagccugggcaacagagugggacccugucucaaaaaaauaaaaauaaaagugagcacacgauugcaagaucuaucugguuuugggggcuuauugucaucuuugguuguuaaaaaaauacuuggauauuauugguuauuggucuaguggaauaagccauuaccgauuugaguacaacagugguguauuuagauacuugcuccuaauuuucuguucuucaagaagggauuguacuucagaaaccagagauaucaggguaguuuugauugagccauaaauucuaaauucugauugaaauggguauuguaauaaauggcauaaucuuuuauuuaaucuagccaauugugcccuguccagaggaacuggacauuucuuccuuauguuccauuuauucagcaacuauucguuguaccccugcugauggcuaggcucuuugcuacuguggaaggcaucguuggggcagagcagacagcauuuuaccuccugggagacuggcagauuuuugaagccuuuguugcagauauagauuuucacggucaccacucuugcccuuuaauguaauuuaaauuuuuuuuuuuuuuuuuuugacacgggauuuugcuauguuuccuaggcuggauucaaacuccugaguucaaaccucagccucccaaguagccgggaaaacaggccucuugugcuuuaaagcagugauucucugucuuuaaaccuuguaacuaugcugugugguggaaauuuuacuuccccguuuaaagccaagaucucuaaggccaagaauuuuuuuuuuuuuuuuuuuugagauacagucucgcucugucacccaggcuggaguguaguggugcgaucuuggcucacugcaagcucggccucccggguucacaccauucucccgcuucagccucccgaguagcugggacuacaggugccugccacgaugcccggcuaauuuuuuuguauuuuuaguagagucaggguuucaccauguuagccaggauggucucgauuuccugaccucaugaucugcccaccuuggcggcaccccccgccccccgccccccgccccccacaaagugcugggaauacaggccaccaugcguggccgaaaaaaauuuuuuuaauuggccugggcugggcgcaauggcucaugccuauaaucccagcaccuugggaggccgaggcaggcggauaacgaggucaggagauuaaggccauccuggcuaacacggugaaaccccaucuguacuaaagauacaaaaauuagccaggugugguggcaugcgccuguaauccuagcuacacaggaggcugaggcaggagaaucgcuugaaccuaggaggcggagguugcagugagcugagauugugccacugcacuccagccugggcaacagagcgaaacuucgucucaaaaaaagaauaaaauaaauuguccugggucacauaacugguuaagugaugaaaucagaauuuggaccuagauaggccaggauauuucugcuacacucaugucaaaauuacacuuuuuauuuucuuuauaaauacacacaaauucauuucaaccuguguucccuuguaaaugcauauaccuuugauauaggcauauauucaucuauuauuuuacacugugcauuucugaauuuuuagaauuuuuacuugaagugaucaggcuggcgcuguggcucacgccuguaaucccagcacuuugggaggcugaggugagcagaucaccugaggucaggaguuagagaccagccuggccaacauggugaaaccccgucuucacuaaaaauacaaaaaaauuagcuaggcaugguggcgcgugcccauaaucccagcuacucagguggccaaggcaggggaauugcuuggaccugggaugcggagguugcagugagcugagauugcgccacugcacuccagccuggcgacaagagcgagacuccgucucaaaaaaaaaaaauagaaaaaugaucggggguccacaaauaagaguaaugaucaagggucagcaaauuggggccaaaaauagccuguuuuccuguuuucuacacaaaaguuuuauuaggcacagcccaucccauuuguuuaaaaauugucuauggauguuuucauguuuuggaaguagaguugaggaucgcaaaagagauuguuuugccugcaaaacugaaaacauuuacuaucuggccuuuucaguaaaccauuugcuaaccccugauucucacuauaagacggugacugugaaguucuuucuauuucacauacugccauaucaaguugauuucuuuugagguaggguuuguuuuuuuuugguuagagauagacuaguauaguguuugagagaauuuuuaugaccuugggccaguuaaguaaccuguuuuuuauguguguaguguagaugguaauguuaucuugcauguuucuuguaagaaugacuuuagguaacuuauguuaaacgcuuaccaucaugcccaguaaguguucaauuuacaaacucaagcuguccagauucaaaucuuugccuuacaagcuacuaacuguguaaauuuguauaaaucaaauaaccuugaauccucauugcuucuuuuuguaaaauagggauuaauaagaccuauccaauauuuaacuauuuugugaggauuaaauuaauuaauuuauaggaaacacuuugcauaauuccugguauacaguaacugcucaauuaaccuuaguugcucucuuaguuaugguuauaucaucauuccgauccuccauugcauuugaaacauuagcaaacuaauguuuacuacuaaugaggaauguuaaagguaaaccaauaaguugacuuuuaauuauaaaaggcauaaauguaaccuauccauaucuauugguauaauaaagcugauauuuagagagaacauuauguuaugauuaaaagaaacauuucuugcuuaaauuuuuuuugugugaauauacacuguauauugaaauaucugcacuuaaauuuuaaauccagcugaaaauuggauaagauaguauuagaugccacugcauuucaagauagaguuuuauuucuugcagguauuuuaagccuugugggaguucuucuguuaagugaacagauagagacacugauacagauggcucuuucaccgucucaugugaugauaaaagcuaaaagguuugauccgaauauugcuuauauugggcuaagugauugaccuuggcagaauuaaauuauuuuucuucuucuggugacaauuaaucugggagaaguaccauuugauuuauugcuauacauuucaccaauauccacaaggcacuuguagguaccagacauggcauugguugcugggggcacagagauaggaacaaaguggcuugcucagguugcuucuagccauaucugcauuguccuugagagggaugagucucucaggccugccuaggaaggaauuuuggcagcauggagaagagaaagugcucagcccggaacaaaaguuuucaccuacuauguugcagagaaguuggcguaucaguaauuauaaaggaagaauagggauuuacugggugauagagcaccaaauagaaugaaugcaauacauacuugaaguaaaucagaguagcuuguauugaucucaaggggagaagaaacaaagcuuagcuuaauucucaugccucuguuguuacuuguuuguaauggacaugacacuuacaagguauccuauaauucacuaacgggauuuuuacuuaugauuaauauuuaacucuccacaaagcuugggguaaacugugaacuuaacuugcugugaacccgaacaugaacucacauacuucaguuggaggccucaguaguagcaugcuguacaaaaaugaaacuaaagcuccagggaguauuugggaacagggcaaaaggguaauggcuccuccuuauagagcaagccucaggccuuuaccuuuguguuuugaagauggagaggaugcacuucuacucucgcccggguuguagcaugcuugcuaaugaugucaagagaacuagugucagcacugaccauagaugugacagguaacagccuguuauuuugugccccaugucauggcagccauugauuccgagguguuugauacacacuuugauagaggcagagugaagcaggacauggacaagcaucuuuccguguaguuuaauggucucaaucuagaaagcccacucagauaauuagguugcuuaaaaugugaugagacuagggaauagagccauauagaagugugugugagagagaauucagugguuuaguauauucacaaagauacacauuugacaccagccugggcaacauagugagaaccuggcuuuaccaauuaaaaaaaaauagaauagcagaaguaaucagugaaaggcauuuuaauacaauuauaucuagauuuauuaaaaauaaaauuuuaguccaauuuaauuaaaggccagaaacuagauuuuuaaagaauauuagucuuucucauauuuuccccaaaucaguugcuuuaaaaaaaaaaaagugugcagaugccucaggcacaauaacuguacucaacucaagaauuugcaauuaagaaaaaaaaaaaucaaaccucaaagaagaaauccagcaacucagagguucagguucauuuaaacaugcauacauuuacaugggcacacuuuuuuuguuuuguuuuguuuuuaagauggaguuuuuguuugucgcccaggcuggagugcaauggcgcgaucucggcucacugcaaccucugccucccggguucaagugagucuccucucucagccuccugaguagcugggauuacaggcgcacacaaccgcgccuggcuaacuguuguauuuuuaguagagacagguuuucaccauguuggccaggcuggucuugaacuccugaccucaggugauccaccugccuuggccuccuaaagugcuagcauuacaggugugagccacugcaccagcugggugcaccuuuuuguuuguuuguuuuguuuuguuuuguuuuguuuuguuuuguuuuguugacauggagucucagucacccaggcugggauucaguggcacgaucuuggcucacugcaaccuccgucucccagguucaagcaauucucaauucuccugccucagcuucccaaguagcugggacuacaggugugugcaaccacaccuggcuaauuuuuguauuuuugguagagauggguuucaccacguuggccagacuggucucgaacuucugaccucaggugauucacccaccuuggccucccaaagugcuggguuacugguuugagccaccacacccaaccgggcacacguuuuuagccaagccauaggucugauuaaguacagucagauuccuugagcagguuacaaagcuguggauuugaauggagaucuuuaguucccuugcagaacaaugaguuuccaaaagcagaguggcuuacagccuaaccagcugcuucucucagccuuuaaccauuuugcccuccugaaaauucaucuuugguuuccaaccaccucuuccaauaugccugacuuuuugugauucuguuaguagaagaguaaaaagucaaggggaggcaagaaugaaugaaucucauauaaaaaugaugcucaagagaaucccuuaauuuucaagacagcagcccaaauuguaaacauugagacuuuuacaguguuaaaaaaaaaaaaguguuuacaggccaggcaugguaucucacaccuguuaucccagcacuuugggaagcugaggcaggaugaucgccugaccccaggaguuugcaagcagccugggccccauagggagaccaaaaaaaaaaauuguuguuuuggcuguagugucacaggcuuauagucccagcuacucaggaggcugaggugggagggucgcuggagcccaggugaggucaagccugcagugagccgugaucacaccaccacacuccagccuuggugacagugagacccuguccaaaaaaaaaaaagauuaaggcagaggaaauguuaaagguuacgcuauauuuaguugauaauaaugguaagacuguucagguguuuuaacuaugagaguaggguugccucuuucuuaaauuuauauauguucuuauuggguauaauuucuagacagaauaugcaaguaucacagaauauggauggcaauuuuauguugcuugcacgugacuuuagguucuuauguuucaugauaggagcaaagaaaagucuugcuugccaauucuuaugauugcaucuguucuggaaauuuacuagcauuuguuacccaggauuucugaagugcuggugacugcugcccaguagucuuggugggcaaaguuacuaaaaugcaucacgaauccuucugguguuugcuugggcuauggcaggguuucuggaccuuaguacuauugauguuuugggccagauaauuguugcggaugauuguccugugcauuguaggauguuuagcugcaucacuagccucuacucgaugccagcagcacccccaagugaugacaaucaaaaauguccccugggaggaguaggggauagacucucucugguugcaaaacacugggcuaugguguugagaucugcagugaugagcagcuuuagauaugugaacagaagcccaggcgugguggcucacacuuguaaccccagcacuuugggaggcugaggugggcggauuacuugagaucaggaguuugaggccaaccuggccaacauggugaaaccccgucucuacuaaaaauauaaaaauuagccgggcaugaugaugggugccuauaaucccagcuacuugggaggcugaggcaaagaaaucacuugaaccugggagguugagguugcagugagcugagaucgugccauugcacuccagucucggcagacagacugagaugccgucucaaaaauaaauaaauaaaaauaaaaaagugaacagagaaauacccgugcaauacugugucucaucccccaaagacggagucuugcugucgcccaggcuggagugcagugacacgaucucaguucacugcaaucucugccuccaugguucaagcgauucaccugccucugucuccgaguaccugggauuacaggugugccucaccaagaccagcuaaguuuuguguguuuuuuuuguuuuguuguuuuuugcuuuuuuuuuuuuuuuuuuuuuugagacgaagucucacucugucacccaggcuggaaggcaguggcacagucuuggcucacugcaaccucugcugcccagguucaagcgauucucuugccucagccucccaaguagcugggauuacaggcaccugccacugcgcccggcuaauauauuuuuuuuuuuuguaguuuuaguagagacaggguuucaccauguuagccaggcugaucuugaacugcugaccucaagugauccauccaucucggccucccaaagugcuggguuuacaggcaugagccaccaagcccggcuggucucauuuuaauguaagcucuaacuucuguaucacugcuuugcacauuguagauaaccagugaacauuuuuuauuguauaagaaaaaguaaaauaaacaaaaauaugccaaagcaaauaugauaaauacacauuuaguaagguaaaagcaaguauuugauaaaauguguaauguagucuaguagcuuuauuuagaaacagaaaacaacauaaaauguugacuugaaacauugcguaugcauauuugccauguagacagugagauauggagguaaacugcuuuccuaguuuuguuuuguuuuuuuuuuuuuuuguucaaaaggaauucacucuccccuuguccacuguuauaaaauagcaaauggugauuagcaucugugcuguaaccagagacacugcuguucccagcuggaaucuguagguuguuugccugcuagagauugugacaagaagccaguuaacauggagagguguacaugucagucuuccccagaaaaggacaugaaacaguaggaccauccuuccaacccaugaccuacaucuagaggcauucuuuuuuucuuuuuuuuuuuuuaaaccggaacagaaauaucaucuaauucuuucuuuacagagaagugguauaaggaaguacauucuggccaggcacgauggcucaugcuguaaucccagcacuuugggaggccgaggugggugcaucaccugaggucaggaguuugagaccagccuggccaacauggugaaaccccucgcuacuaaaaauacaaaaauuagccgggcgugguggcacacaccuguggucccagcuacucgggaggcugaagcaggagaaucgcuugaacccgggagacggagguugcaguaagccgaguucacuccauuguacucuagccugggugacagagcgagauucgucucaaaaaaaaaaaaagaaaagaaaagaaaaaggaaguauauucuaagcccuugaauugaucuuggcuuucuucauuauuuuuacaaguaaaaauaaaaacuuugauauuucugauguucugggauauuauaggaaugauaccacuugaauucagcuuucuaagaagucugguauuucaauagucuuaauaugaguaagaaaauuaugaucuugguacuggaucuaaggcagagguaucgaagcuguuuuaauguugcuugagauaggacagaacuucagaguaaaauaaauguguauagacaaucuguucaaucuguucaaauuaaguuguugagcuguauauuugaaucuuaagacuacuaauuuuguuguaucugucuuuucccaaauauauguguacuucuuuuaauaagccaaaaccuaugcaacuuuuacuaauucuucccuaacuacuucuuuuggaaaaugauuaaaucuuaugucucacguuuugacauaucuauugcauuuaaaagauaagguugaucaugcugcuucucaaacugagauauccauucgaguuauccaaggcccuuggaaaacaaucguuguugagucuguauggggggccugagucccaggugguguugacucugcugguccaugauccuauuuugaguaguagacucuaguagcgucuccugccuuccauauggugcagauuugcagcauugagacaggaaguaagaaacugaaaaggaaaaccauucuuaccuuugguguuauuguucuugguauauuacagauaccaacaaguaugaggcaauccugagacaucuaccuacugagcuuuucuuuccuuaaauucacaccucaagaccaaggaaaccgaaaaacucuuacagucucccuacauguguucacuugugccccuauuuccugucauuaacaugguaguguagccaacuccugcuagccuguaaaagcuaauuauuacaguauagaggaauuuuguaagccauagccauuaguagcuugaaauaccaauggugggaguauuuauaccauggcaguuggcauacacuguaacucaagaguguucuauuuguuuguuuuucuagacagugccaguuucccagcauacuccugucucucauucaguaagacaaagcacuuccccuuauuuuccaauacaggacaugauaucccgaguuuugagcuucuuguuaauagccuguugcacgcuaaccacgcagcucagugaagagcaaguuuauucccauaacaaacaggaaacaaagguugaggaaaaaccacagugguacccuuuugugaguguucccuaacaccgucacgggaguccugauuagucuaaauacuuuacaaguaaaucuccuucagguggcauuuuauaaacaaucuuucaucauggagagaugagaauugggucagguauaauuagaaugacagauguauuggcuagccugagagaauuaacgcaauucaguaaaaaggcuagccaacugcggauaucuucuaguuacuuccgugacaaauuagcaccauccucuuguacugaagcagugcuuucauuagcaugcacagcuguuugcaucaucuuuguuuguauuucaauccauauuuggagcuuaagugagauuugucauaagacuucaguucaagcuugcuugccuaauuuuacaugcuucuauuuaguaaaauaugauuacuaggucauaaauauuugauaauuuauugccuuauuagaguaauuuucuaaacauguuuuuugacgacugcuugccacuacguacaagcacuugaaaaauguucuuuucuauuaaaaguacaugguuccagaauugggaaaaucacguucuuaaaaaauaaccaguuuucuauuguguuggcuuuuaaaauuuuuucaucaguagaaucaaaugcaaauauugucugcuuauuuuucaacagaauacaaguuugauuuuaauaacuuaggcucaugaaaugucaccacguaguaauacuuagaauuacagcaauaacuuaggcuaaaaaaauaaaguuguuaugaacuacauugagcucagacagauauauguauuauguaaacauuuauauaaaauguauauaaauuguauauuguauuauauaauuauauauuguaauauauaguauauaauauauaauuuauaaauauaauacauaaauuauauuuauaaauuauaaaguuuuuauauaauauauuauaaucuaauauauuauaauuauauuuauaaauuauaacguuuauuugaaauauugaaguuuuguauacuuaguggauuuuaauauuuaugucguuuucauuuuauuccacuguuacauuaaggaaguaacuuauuacaaaaauaaauuauauuugucuuacauuugcccuuuuuacucuacuuaaaauuggagaaaaagaguucaagauagggaauuucugucagaaaggagaaauaguuguauuaugugaaguuuaaguagauauucuuguagaguauggagaaaauaaugcuauaaaauguugccuuuuaaaaaaaaguucagaaaauauaguuccuagcucucucuaaaugacuaguuugauugugacugcuuucccaaaauuuguaaauuuaaaauuuauacaucacauggaauauaguuuuauuucacauacauuccaguaggcugagaauacuugaaauucaaugauuaaaaaugaaauaauaauaaccagcuuugcuuuauucuaaaaccagcuuuauucuuuauuuaccacuuuauuuacagcgaauuauuugcuaaucuguuaacuuugcuucauaagaaggcauuauaauuaucguacauuugaaaguggagauuuucuccccauucugguugccaguuucacaacuguguucauucuaaauuuauuaaaauauguaaaaucagcuuucuaaccuugguuguccacaaagaauuucacuccaauuugaaauaucuauucagaacuaauuuuuugugguugagcauuauuuuuugaacaaugaauugcauaaucauuuuguauaauccagggagcucuggcuuagauucuguauuauuuuguguuauacugauuuuuagaaaauggaauguagcguugacacgagcacaaaucucagcaagggccuaccuuacaaagauaaaaugcguggaguuuuauuagaagcacaugauuuugcuuuguguuucguauacaccagcauuucaguguaguaaauggcauuuugucuugaagagugagcagaguuguuacaaaagaaggcauaaugcuuccuugccagcagaauucagauaagugaauaucagaaaagcuauuugugaucuugaaaguguaagaaauucaacaucaauaaaggauugugguuccuuagauagccauguaagucuuugccuauguuucuaacauuucucuuuaggaaauauucuugcuuuuauuuuucugaacaaauuuucuccauuauuaucucugauauuuacuuugaacagaaagguggauuggaaaucaaaaaauaaguuugauuucaaaaaugauuucaaaauguuaguuuucucaguauuuuacauuuugagaagagaacaaagaaggcagaugaagaguuuuuuguuuuuucuuaaauuuguuuucuuuucaacuuuauuuuuaauugacauaauaauuacauauaguauacauuuugaagauacgguuuuaauuuucacaggaaucuuauuuggguuuaguuauauaaggucuaauuuugcauccucuacauuuaguggcugauuuauaaauuuccacugagugauaauaguaauuaaugugaaacagguuuuuugcugauguuuuuagaaguuucaguagauuaggaaggaagaaauuaugcuauugagaaaaauagaaaauguaaacauaagcauuugaacucucucuugagauauuuuuaucuuccaugaaacuagaugcggcuuauugaagauguguuucaggucucagugcucuaaaacucuucuacuuggugagcaucuugauugguuagaucucuuacuaauaucccauugcuagagagggauguaaaggaaauuuucucaaacugagauuuccaaaucuuccaaucucugagucaaguaaagagacaagguuagaacucuuaggcaaacugaaaaaucaauauuccuauauuaucauuauuuuuuucuuuuuuugacaccaagucucacucugucgcccaggcuggagugcaguggcacuauuuuggcucacugcaauguacgcuucccagguucaagugauuccagugcuucggccucgcgaguaggugagauuauaugugcacgccaccaugcccagcuaauuuuuguauuuuuaguagagacaggguuucgccauguugacuacguuggucuugaacuccugaccucaggugaucugcccaccucggccucccaaagugcugggauuacaggcuugagccaccaugccuggcuuccuauauucauuuuuuuaugugggcuuuuuaaaaucuuuucaauagcaaagacuugacaccaacccaaauguccaucaaugauagacuggauuaagaaaauguggcacauauacaccaugaaauacuaugcagccauaaaaaaggaugaguucacguccuuuguagggacauggaugaagcuggaaaccaucauucucagcagacuaucacaaggacagaaaaccaaacucugcauguucucacucauagguggaaauugaacaaugagaacacuuggacacagggcggggaacaucacacaccagggccuguugggggggugggggguugggggagggaaagcaucaggagaaauaccuaauguaaaugacgaguuuaugggugcagcaaacaacauggcacauguauaccuauguaacaaaccugcacguugugcacauguacccuagaacuuaaaguauaauaaaaaagaaaaaaaauuaaaaaucuuuucuuugagacaauuguagauuuacaugcaguugaaagauuuaauagaggccgggcgcggugccucacgccuguaaucccagcacuuugggaggccaaggcaggcggaucaugaggucaggagaucgagaccauccuggcuaacacagagaaaccccgugucuacuaaaaaaucgaaaaaaauuagccgguguguggcgggugcuuguaaucccagcuacucaggaggcugaggcaggagaauggcgugaaccugggaggcggagcuuggcgaagccugcagugaguggagauagugccacugcauuccagccugggcaacagagcgagacucugucucaaaaaaaaaaaaaaaaaaaaaaaaagaauuaauacaaagagacccugcauagucuucacucaguacaguaucacaacuauuaaauugacauuaaucccuuaacacugcuuuaacccaagucuaugcugcugcuucuccguguucacuucugagaggcacuggccauuucuugugugcuuauucauacuuuguguaaaagcauuagcaucauacaucgcuggugcugacccuacccucagucccagcuucucccagaguaggcuaagauucucuuuucuacuacauggaaaauuguucuggaauaauaaaggguuagcaaaaaagucagagaaaacaaacaguugcauucccuuucccuguaguagaguaggaauauaauuaugagugauagaggauacguuccauuccuuucccaguccucuccgaagucagcuucacugcuguaggaaguugcuguucucauuauuucccugagggaaaguguugggaagugagaguugaggugauggggaaucaggguugcugacaauugggggaauuauaacgagaagcucuuuuucaccaggagagggguugcauguuaagagaaggccuaucugcucauccuccaugucagcagaugagaaccaguuggacaagguagcugucucuuagagauugagaaguaacaaaagcacacugucaguccuguucuuccagccucacguacaucuucuccauacauuauguauuugacauuaaauuaacauacacuguuacacccauuccugaccgcauuaucucagguagccuuuuguauuugaguauugugggaucuguugcuauugcccaugaugcccacuuggacuccaccaaggcagugaaacucuugggggccguucaaagucaagagugccaacugccccuaacaggauugggagaaccaaccaacacuccccgaauagggacuaacucacucuuuucuuggccuuuaugaaaggaaggaguuaaggcucuuacagcuggagacuccagcaagaguuguaggcucaacguguagcuuauacuauuuacuuaauuaacauguaaauggauuuugaguucugaaugcuuguucuaguugauuagggcucauuuagccuggcuucuacgaauuagcuauaacaaaugguuucauagcuguuauagaaugaggcagaagaaaauaaaaugaauguagcauuauguuuaauuagugguauaggaaaauguuaauauaaugccauuuagauucuggacuggggagauugugccuuuaucauaaguaagaaauuguugcuagguuucacauaagggcacauaguuaucaugaaucaucuccuucgaucaucauucuuuuaucccauuacuugacuugcacccauccaaaauucuaccacuuuuauuuaauauauagacucauaaagacaagguuugugcaucugcagagcugugauguucacugcgaggcccguggcacacaucuauaagaagacacauauuugguacucuaagaugauacuuuuuuuuaaugccaaaaugugagggucagcauaaauugccaaggcaugguaaauuuuguugccaaugcucccgugacuauggggugaagggauucugugccucccuugguagcaaugaccacggugcuugcaaucccagugccaauucccggcacagugcaggcucuggaggcacugcugccuugcagucuuauuggaauuaacacugccugaguaagagauuaauaauggguauuguugugucuuagaaacguuaaagagcaugugacaugaauauguacacauuggugaaggagauacagagaaggaaagcaaagugaagcuguagauguuuguuacaacugaagguaagcucugggagcagagaccacugcuggcuauaguugaugggauccacaaugucaauacaaauggggacuaacuauuguuuuacuucccuauacacguugcucuuucaguagaugcaauaaaguacugguaaaaccagagguggcuaccaucacgaugaugucaacaggagggacagucagcacuaagcccagaaggugucaaacacuccgcaggagaaaugcgccaugcaacggacaugaagaugaucugacacucuucacgugguuuucagauggaaacguggcuacgaaagcaucaaccucauuaucauccaucauuaaggccaucucacucaguacugcugcuuucaaaguccacgcucccaaagcaaauuggauuucuguacacaauacucuuacaggaugaaacccaaccaacuuguugacguaaguaucccaucuacuucgcaauuuuauuuaucuuccaaaauuaaaggacuggcacccugauuuauuaaaagugaauugggucuagggaccauauccccucugaguuacugacagagcagcuucuggccugugaagcucaaagccaugccuagaugugauggauccuugucuuugauuggcuaauuagaaucaaucuguugaaggaccaguggcaguggcucacgccuguaaucccagcacuuagagaggcugaggcagguguaucacuugaggccaggaguucaagaccagccuggccuaccuggugaaaccccaucucuacuaaaaauaccaaaaaauuagccaggcgugcugguacaaggguaaucccagcuacuugggaggcugaggcgcaagaaucacuugaacucaggagguagagguugcagugagccaagauugugccacugggcggcagugcaagacccugucucauaaaaagaaaaaaagaaucuguugaauauuccuaacuuggaaguaaugggugaugcguggcuuucaucuuuuagaaagguguuuuuuccucugucaguaaaacuaagaagacaucugugugugcuaaggcgucagucuagcaagggcagggcacaaacccagagagagaauugggcuguuguuucacuuccaauaaaaaugggauauacaugggagguagaguuauaauucuacucaggauugacuuuauacaugcaauuggaugggucacugauugacuuugaggcaaucagggaugagugaaacugaucuuggggaggguggcaagacauguugacagguaagauguguuuuaauguauaacagugcgugguguguauuaaucaguuggaguugauugacugcguuuuauuguuuggaacauuccugcccaagggucagguaaauauacaaaauauacaaauaauacagauuuuuaauacauaaauaucaauuaaguagcauaauuaaauaauacauuguuauaguuguacuuaauguguauguaaauauauacaaauaauacagauuuuuaauauauaaauaucaauuaaauagcagaauuaauaauacguuguuauagauguacuucaugcauauguaauuaaauuauuaauguauaauauauaaauacauauuuuaauauacaaauaaaauggucuuaaaucagaguuaauuuaagaccguuuauauuaguacauaucuuaauauacaaaugaauggucuuaaguuaaugucauugaguauaagucacauuuacagauaugacauguguuuccagauaaagucaauggacagacagcuuccaacacuggaaaacauucaaaauauaugcaauuaauuuuauauuugaguuaaggcaaucauuuauuaaggaaagcaaucagauguuugugagggcuuaaacuuucgcuucauaaccaaagcaguuuccuuacaugaaaguugacuucuuaaaaagagaaguuuauuuuuuaugauggaggauuguugugaugugcagauaccuuccgucauuucauacucaucuaaaagcagccaaaugaucuuuucaccuuuggccggaauccuuuuauugcuaccgaguccugcacucauuaaaccagaugacagugcaugcucugagagguguaaaucucuaguccugguggccaguuaaauuccucaguaaauguuugguagaugcugccuaauaaaccaguccagguugccacugggaggauuaaaagaaguaaacguguauacaugaacagagagacagugccuuuucaugcuaaaugugguuccccacaucuccucugauuagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaguaaguggacccuucuucgagccuggccaccuuucgucucucucgccacugacucugcuuuuuguaacagauugauuuuccugguucuugggaaugggccuguugcuaccacuaaccacauuucuguccacuucucuaauugcucagagucuccgcaguauguucaaucaugagcacaccucuccgucuuucccugauaaagcauggccauggauguguucucuuccuagcuguagcacauaugucuugcaauccagagggacuuuugagugcuucucuuuuaaacaaagcuggaguggcuguuuugucuucugcagccagccguuucugcaaaugcauacuuauguguuuguccguguacauauguguucauguuuaugcaugugcacuaccugugcagauacugucuaccacuggaagccuggcugaugcagcuugaguugcauugauaagguguauggcugugaugaauaccuuuaaguugguucauaacaugucuuuuauugugcugaugagggaaugugauugaauugagcucaugcaucucaaaugccggaggguagaagugcccgucuugcccccuccgagcucagcacacagacauuugccaggucaaacuucugcuucuucucuugaaaguagaagaaaacuuuugacuuaacgugagaaacuuucaaugacauaaggcucgaggaacauaauuuuauuuuuuuuguuuuuuuaaagacagggucucauucugucucacaggcuggagugcaauggcgugaucuuggcucacugcaaccuccgccucccggguucaagugauucuccugccucagccuccccagcagcuaggaucacaggcacaugccacugcgcccggcuaauuuuuuguauuuuugguagagacaaggcuucaccauguugaccaggcuggucucgaacuccugaccucaagugauccaccugccuuggccauccaaagugcugggauuacaggcgugagccacugcaccccgccagaacauaauuuucaaagucuuucucuugaacauuaagcuuuucauaauuccgggggauaaaaauaugaagucaugaugacuuaagugcaugaugaaauuuuccccaaagagguaauucucaggagguccaguaccagaugugagacuuccaugucguuaacagacuuccaagugaaauucccaauugugcuuauuuauuuauuuauuuauuuauuuguuguuguuguucaugaguaggaaguaugaacuacucaagaaguaauuauucagcucagcuugauaacuaaaaaugaaacucaauaacuguguauuacuuuuuugagagacuccugccuaauucuccgcuguguugcaaggguggcagccacauuuccugccugagauuccuagggauuauauaaauuguuuugcagcaagaucuuaggauuaagcaaaacaacagaagggccugcaccauuaauacccccacuguaaaggagcccaggaucuaagaggaauguaauggaaaagcuccuguuggucuccugccaucgccagugaaugagaugacugcuucagucccaugugugaacagguguaggaacugauaaccucaagggcuuuuuuuuuuuuuuuuucuggcucugauuggaugauugcagcuucuggaucaaaggacucccuucuucaguuucaaacaaagcagucaauuaggucagguauugcgaacacaauggagaauucuguugccugcagccuuuggaacaaaggccuuuuguuacagugauucucacugguuuagccggugggagagguuuccuggcagauuugcaacuuuuuucucccuuucccuggguggauucauuuucugaaauaucauguauaguuuuugguaauaagagauuuauuugguuuuaauuauuagcagugaugaauuugcuucaagagauuaaaauucucuccaccucaccccaguacugccaucccuucaccuaacacucucucccuuugaucaguuugggcugggagugaccagugggcaccuguccagguguccuggguggcacacaguuugcugaggguuuugcaaaaggucgaugcucccaacagagauguauuagaugaggcuagcuaugccugauuuuagaggggaaaggugacagaauaauguaugaagaaggcaaaggcugaagaucaguuagauggguggacaagaauaaguagagaguauaagccucagcaaacagccagagccgagagccacaugcuguccuaugaaugagugaaauaaauggaguuuuugugaaaaaaugcaucgaagggaauuggggauauuuggcacaaaaggagcaagaaauccucuucuguuaagaaaccuguuguuacucggauauacuaucagagacaaaauauccagcauucucaaauguuaacuucuuacgaaaauagaucuuauguuuauauguucauuuugguuuuguuggagggaccaaaccuaagugagugauuuuguuuguuagguuguuuuuuugucaguggacucgugcauuucagccaucauucccauguuucucuuuuuguuuuuaguuauguucucuuauuuuuuccauagugucccaaaguuuacucaagacuacccaggaaccucuugcccgagauccuguuaaacguacguugucauucaccugagggaagggaagaggggaggaggaugcugcuugguucacauaacuccagcaucaucaccuucuuugcaugguuuuguguuucuugaacaccugucuuaguaaaauguuucuucccauuaccuugcuuguaauuacaucugauuuugccagacagcuugagauguugggcuaagagcaucauugacuaaguuucuucuauuucugaccaauuuccuuuuuauuuagucugguuuuauugaauauuauauggacaacaucauuguauuguauuugccauuacuauuuuauuuccuaaaagcuaucaguguaacugagagcaggcuuagccucucacugcuuuugcagaacugaagaacaagggcuaggugcaguggaaggaaagugacuuuacuuagcaaagcuagcaauggggaaaugguccaggcuccugccucaaagcaaccaucucaaauuuuggauuaaaaaacaaaggcuuaaaaaggggagcuuggaaugcagggcaugaaggaggggugaggaggugcugcuauacaggacuuguuccaaagacuugaguuauuauccaguucgguaagugggcuggcgcaucccgcacaaucggguuguaaauuaacugcagccuugaggugaucuccugaugagggagaauucugaaggugccuaagucagucaguggaacuucuaagcaagcauuaauaauuuuaauaauaauuauaagcguaauuagauaauggaagcgcugugcagggagugccuggugggaagaaagagagcaaagguuaccauuucauuacuaaaacuggaaggaaaagaaaggaagaaagaucuuuaaaauagaguacucgguuacaucaagaugccaugauuuaacaagagacuauaauacauaaguaacuuguuuccucagaaaaaguacuuaauauucaugguauuguaguacauggacuaauucguacacgcagauuucaauuuauguguguuauaagacccgguuucaacuuuagacaugaagggucacuuuuagacauuaggaaccccucuuucuccucucccagaaggcauaaugguagguuagaggugcucaccuuuugacuaggaaguagagaaagagccuccuauaaagaaaugcauuguccagccacugcaggccuuacuuacagugucuuauguuuuguuuuuauuucaguuguaauaucagacgaguuuaguuuuaaaaugugguuuuaguacucauauuugaauuuggauuccauccagaaauagauuuauccaguguuagguuagggaugauauaugccauuuaugcuuaugauugcuggaagaagaggcacaauuucaguuguaacuuagauauuuuauaauuagcauuuguguacauuauccugaaaaaaaaaaacccucaucucaaaacugaugaagccaguuaucuuuuuuaaagaugauaaauuauagaugaaggauuagguauuuuaaaaaagacugcauccuaaacuauaaaguuuuuuaauggccuccauaaaauauucagaauaauucacauuauguauaacuuuugaaggaugugguuuguacugcugcaacauaaacguuucuuuugcuguugugaaaaaagcauuuuucucuaaaaacacuguaaguacagcaaguggguugacagacuaggaaaaagcucuagcuauuccacuauaguguugacauagguacgcauguugaguugcauuguaccgagcauuuucacagaucauuuaauuuuucuucagaacacuuugugggcauuuuccucauuccuuuuguacauacgagaaaaaaugaggcuucaagagcuuagugacuugucccaagccaucgaacauggcaggaccaggcuuugaaacccaaaaugacguuuuggccgcacuccacaccaaauggcuaagcauugguucugacauuguuuugccgguuagugaaaucacauuugcgauucagaagcacauuuuaagaauacagaaaacagugaaaagaggaugaagaauguuaacauuuuuuccuaaaugccaugaauagagcacgcaucaguaaauuaaaugucuuucccauucuuuuauaaaacagugauuauuuuucucuuguuucauuuuagcauuuauaagaauucuauuuuuccauuuuuaauaacugauggaaacaagcaucauugucugauaaauuuauuuucaugcuguacacguaacuaccacuuucaucauccacuguuccaaacagauacugaaagucucuuuuguaauuuucuccuucccaguaauuuucuccaucuacuugcaguguauuugggauccugacaccuuuccauucuaggaggaugaagugcuuugggcagcuauauuuucuugucugccuacagagacuauucaaucacagcaagugaaggguuuugcagugcuaguacaaacagacaaggaaaaaaacauauaauuucuaguuauuuauagccugugcagcuauguggucuuauuuauagcaaacugcacauuugauuugaaaaagucauggucaucuggaggucaaauucagauggcagacucaauucagagaaaaggagcugaacuagaagguaagcaagccuguuagacugggcaacuuggacuugacuuugcuccuucaacaaucuagagccaguuggaugauauuucugcacaaaggugguugguuuuacagguugcucagucuaagcugcuucuagucaaauaacaaaugugaaaggagauagaaaaagcucuucaguugaacugauaaaagauuacacuuagggagaaaauguaugaugguuugcauuauaaaaacaauaauuugccauaaaucaggcauuucuagguuucaaacuuuugucauaaaaaccaauuuugagcauugcaauuuuagggacauauuuuauuguuguuauuuuaaauaaaaaucuaaaccacaaauauaaggcugagagcuuucauuuuauucgugaacauaggaauucaaaucauuaaaaaaaaacccuuucucauuugggauaaagaaucuuacgagagcugaguuaauuucugacauuaguuuugcaccugcccauuuggguuuaggacagugcaaaagguuucacauuuaaucuucaaaauauaguauuuguagacaauaaaauuauauaaauauuuguggauucauuuauauuuuaaauaugagagugugaccauuuuuuccuggugcugucuccaucagacugcaucccaaaaggcaaacagaccaacuccuuaauggcauuuaaucucucaaagagcaucaugccaauuuuuagucagcagauugcaccaugugaucuggccaaagugugucccaucucaggcuccuucauuugcgcugacaugugguacaaacaacuaaaccaagguuucucaaccucagcacuauuaacauuuugauucaaauaauuaauuuuuaggagucuguccuaggcauauggguguuuagcaguaccccugaccccuacccacuaaaugccauuaacacaacuccagcugugauaacuaaaaaugucucuagacauugcuaaaugugcccagggggucacauucugguugagaauccuguucuagaguaguaguuuccccacaucugacucagagauagaacucuccugguguaaacacguguacuuuccacaaauuugggggcauguugaaauguuagaaugucagcaucauccaauucucgacagauguuugaaauugaauuuguuagacuauuguccaagcucucaauauuugcaagguaaaguggaaguugcuguugcuguccugacuauaguauugaaggucucguaguuuuccugcucuaauguaagcuacuguggcagcagaagagaaaccagcaaaucccuuaguuugaagucauugguucaccuaugcaccaccccuuucuccucucuguuucaucuuaguuuccuagaaucccaggauaugcuggaggacaaccaucuguagagauguccuauagucuugcuacacagguuauuuguacuuuaggauuauguuugauggccuuauaguuugugcagagguguaggccugaccccaugcaggauugagggagggaaaaagauugauuucuaggcacaucagaaugguccagaugacaugaaacagacugguacacuuacagagaauaugaaaagaauuggaacuuaacaagucaggccccaaguuccauccccagguuccaaguuuguugccgcagaagcucauaauuuucaaaucguagaaaacucacaccacgcagccuuucaauggaauaugccaccuuaaccccagggucguuguaaagacaggagccauaagacagaagucugaaugccuaggccauuuaaucuuuggccaaauuugaacuauuguucuuaaucacacuauucuuguucuuuucacugugcaguagcaaauguuaguucccauuagcacauucugcaauaccauuggaacuaaaacugccaaauuagauuaggcaaccugggauuacacuuugcuccccaaccaaccuagggagggagaacaauuuuaaagcauuaaaagaugugauggugaauuaaacuaccugucacgucagugccaguauauucuaucagauuaacaagugugaaaagcuaaaucuuugguaucuggaaaugcuuagauaggaagaauggcuuuuucuucaaagccauaauaauuagagaugacccuaaaauugaaaggaacuggauugcuuagcaacucagcauuuuuuaaaaagaagggccaucuacuuugaauacagguuaaauaucucuucucuaaaaugggaccagaagugcuucagauuuuggauuucggaauauugauguauucaugaugaaauaacaugaaauucauuuauguuucauguacaccuuauacaaaagucugaagauaauuuuauacaauuuuuuuuuuuuuuugagauggagucucgcucuguugcccaggcuggagugcaguggcgugaucucggcucacugcaaccucugccuccuggguucaagagaucccccugucucagccucccaaguagcuggaaugaaugacaggcgccugccaccacacacagcuaauuuuuguguuuuuuaguagagauaggguuucaccauguuggccaggcuggucuugaacuccugaccugaagugauccaccagcuucggccucccgaaguacuucgauuacacgugugagccaccacgcuuggccuauacaguauuuuugauaauuuuguucaugaaacaaaguuucuguacguugcacugugagagaacaaagguguugcuaucccagccaccaugaugucaugucagugcucaaaaauuaucagauuuuggagcauuucagauucucagauuagagauguucuaccugugguaaaagaauguucauuaugucucugcucuguuguuuagcuauuugccaaaagaggguaaguggaucguuuaauaaaguggucagcaaauauuuuucauacaaggccagauuauagauauuuuaggcuuuguagaucaugcaguuugucauaacuacuuaacuaugcagugguagcaugaaagcaacaauagacaauaaguaaacaaauagacaaggcuguguuccgauaauacuacuuuuauaaaaguagccagcagcugggugcaguggcucacgccuguaaucccagcacuuugggaggccgaggcgggcagaucaccugaggucaggaauucgagaccagccuggccaacauggcgaaaccccaucucugcuaaaaacacaaaaacuagcugggcguggugaugggcgccuguaaucccaccuacucaggaggcugaggcaggagaaucacuugaacccgggaggcagagguugcagugagcugagaucacaccaucgcacuccagccugggggacaagagcgagacuucaucucaagggggaaaaaaaagguagccagcaagcugauccuugguuuaauacagcagguuuuuuuauuuuuauuuuuauuuuuuuuccaauagcuuuggggauacaagugguuuuaguuacggggaugaaguguauaguggugaugucugagaguuuaguguccccauuucacugaguaguguacauuguacccaauacguaguuuuuuaucccucuccuccuucccacucuuccucauucugagucuccaauguccauuaugccacucuaugccuuugcauaaucauagcuuagcucccaauuuauaagggaauacauacuguauuuccauuccugauuacuucacuuagaauaauggccuccaccuccauccaaguugcugcaaaagacuuuuauuuugugguuuuucuggccuacuaguauuccgugguauauauacaccacauuuucuuuaucccucauugguugaugggcacuuagguugguuccguaucuuugcaguugugaacugugcagcaguuauuuuugaccccaggaugugcgaggccagguauuuugagagacaccagcaaaggaaucugaguacuggcuaucaauaccugauaauuuuauuaaugaguugagacccagauaugccguagagguaaauaaccauauaaaggaaauauagaaguguaggagaagauugcucuggaaggcugggguaaaaugaaaucagcuuuauccuuaagaccuccauagagguuaacuguaccaucuccuuuuacugcuacaguuuauaugaaacuggacaauauugaagauuuugacuuuucgaacucaucuauugaguguugagcagcuaugacagguuauuucuuuaugugccuccauuaacgaagucaagaauagcuucugacaaauugacaaaaaacaauaaccuaagguuaacccauucuggacgccaguuauugcuauugcuucacauauauuuuuuagauucaaacuugagguugcuuuuaaguuuuagugugaugugcugaauagagaauagauguuaauaaaaaaauaaugccagcauucguuccuucacauucaguucauauauuugaaaaaauucccaugucaguauguguccauggacauaaaaaagaaauguagcuugacuagaguaaacacaucauagauuauauuuuuauuaccuuauguccaugugaugcauugauaguguucuccaccaacuaugauugcacugacuauaaaauuguaauacaagggcauauuagggggagaaugccuuuguuuuuucuuuuguuguuauuuuguuuuuaagagagucugguauuacacuggaggaucacaaacuguauuuucuuguuauaaauggcuccucuaucuuggacuuaaugguuaggauaaauauuugaauguagaaugcguuaggaguuuuaacuauuuuugaaauuaggaaaauggagagacacuuuuuuuuuuuuuagagacacuuuuuuuuuaaguuauaauaagcauggcacucggaaagcucugccauguuucaagauuaaaguuucacaugaacgcuaacaaguuuauauuucacucauauauaaaugauccuccuugucuccuuuccuaaauuauagccaucucaaaugacaacauugcugggucgguaucaaauagcauuuucaaugauaaggcaaugauuuauauaggucuuaauuuguuuuaaucuucuguuaccaaggcuguagagauaaauugcuuuucugcugaugaaaggagacuaacccaauuuucuuguuagaaucuaauauuaauauaucgacugaaugccauucauaagccuugguuuagggaaacauucagccuucuggccuguuggagauggccacggucauugcuguuugaaggugggucauuucuucuuuuguguccugaguccauugugacuguaaaauuaugggucaccccagaagccugaggaaacaaaugcauaucaaaaugauaggggcaaucuuucacagugccuuuaauuuugaccccacauucuuauaugaaugugaaguaccacauuaguaugaauaugaaauggagugcuccgcaaugauuacaaaaucagaacuaaaaugagggaaaucagugcauguacaguucaacuuaauggauuauccucuaaggagucuucagacaggcuaggagagugacgucugccucauccugaagauauuagcagguuuuccccuguuuuaaaguaacuucccuucaaaugcuaacaguuuucucagaggaaacacagguauggaaaauguuucguuggugucuuggccccagugauggaggagcauuuugugauaggaacguugggugcagcaucgccauuuaugaauaaacugaaagcuaaccuguguuacuucaccccagaaaacagagcucuggcagguauugagaauagaucacagugugaaguggcaguauugugacaagcaugcguguaucaguauuaaaauugaaaugagcccucacgcacaugugaaagcaguuucucccguuuucauauucaguucccugagguaauacagcauuuuggugugagagaaagaagggaaucugacccuucucgugugggaagggggcugagggcaacaaccuccugugacagccacccugguccaagccaccuucaucuuugucuccuuuuuuuuuuuuuuuuuuuuugagacagaguuucgcuguuaucacccaggcuggggugcaauggcacaaucuuggcucaccacaacuuccgccucccggguucaagcaauucuccugccucagccucccgaguagcugggauuacaggcgccugccaccacgcccagcuaauuuuaguauuuuuaguagagacagaguuucuccauguuggucaggcuggucucaaacuccugaccucaggugaucugcccgccucagacucccaaagugcugggauuacaggcgugagccacugcacccagccugucuuuuccucuuaaaagaucuuccuucuacuuuugucccauagcagccagagugauccuucaacaaaacgccccaucacauauacucccccucaaacagcccacgcuggucccucagaauccuuacuguggcuuuaaggcuguacaugaugucccccauuucuucccugccucucccacuacuuccucucuugcuucuuuagcucuggccaugcgggucucguggaauuugccagccagcuucaacucuuagggcuuccgugcuaguuuugucaucugccugccauguccuuccagcagccagcugggaagaucugaaugucaccuccucacuuaagacucugccuggucgcucacuuacugcggucuaccuuuccccucuccccucagcucucccgauccuucugaacucugcucuguuuuucuuuuuccucuuuuucuccauaauacaaaucacauauuaacaauaugacuuacuggcuuuuaaaaaauucuugugguaauuguuucuuucccuagaauauaauuccaccaggaucagggccuucauguuuuucucauugguuucucccaugugccucacauauaauaagggcugcaauguuggugggcuggaggaauaaaagaaugaacaggcgcacuaaaggcaggauaguuuguccaugucagagcugcugucucagcugcuuugauaccucugacuucccaggguggcaaagaauaaggauguggcuuauguagaaggcguuagucauccaaaaugccacuguauauuuggaagcaaauauucaccuugaagcagugauguacuaggaauuagaacugcuuuucuguuacauuuuuucauuuguuaugaguguuuagauacacaugaucacuauuaaaaggaagggagguaauagccuauauauccuaccaugccccucaaggcucuguuaggagacuaaaauacaaaggucauuuaaaaaguuaaaagcuuaugcaugugauguugguauugcugcuaaugacuaggcaucuagaggucaaaaccuagagcuaaggauauugaacccuguguuuugucucguuuuaagucuagguuuuuguggaggggggaacauaccuagccagcuugcuugcagaaggcaugagugagcaggcugaaggagggacccaaggccagaacguccuccauauucuagcuccaugggcucuuucacuugaucccugcuuuaugacccaacuucuguugaaggauuugccagauaguguuuggggcaggaacagcuguuucauagaaaacaagccaacggacaucauaacaaagcauaugguuguuuugccaaguugugcugcucauuaacaaaacaaaacaacaaaaacccuuuacagugccccagcauguggauggauuggcccuuuacuacucuaaaaauuagcuuuacagccuuuuuauggcuuacccaaucuuaacagacuuuauuuguguguguuuagggaugcaaauggguauguuaaaugauaguguuuugccucuacgcaauaaaauaggguaauuuuuucuucccauguauuaaacgagaacacagaacaugccuagcauggugggcucugaugaaaagaggcuguuaucauuuggccaacauggaaauccuagccuuuauuuauuuauuuauuugagacggagugccaacauggaaauccuagccuuuauuuauuuguuuguuuguuuguuugagacggaguuucgcucuuguagcccagacuggggugcacuggcaugaucucggcucaccgcaaccuccgccucccagguucaagcgauucuccugccucagccucccaaguagcugggauuacaggcaugcgccaccacacccugcuaauuuuuuuauuuuauuuuauuuuaguagagacgggguuucuccauguugaucaggcuggucucaaacuuccguccaccucggccucccaaagugcugggauuacaggugugagccaccccauccggccgaaauccuagccuuuaucagagguuccguggaaucucagaggucugugagcaggauaaacugcuuuaugguaguuuaaaaugcaaaaccagaaauaaacccuccuaaagccaguuuguuuccacuuucuaagugguuacagugaccuguguuuuaaguaccuuaaauauaucagugaccugcugauauacagcuuccuguuuccucuguguccugugacauauccugacauuccuugagccccacucccuucccaaaaggaaguaccuugaugggugaggacauagggcacacgugucucuggccuucuguggacauaaucacaaaaugguagucaguccuaugaauuuaaucucuuuaggauauaaggauauucacgaaauagaaguugagcucucuggacauacuccaccuuaaaauugcucucuccuuccgggauccucaccagcugcagagcaguaguaaugaacuauuaaauucauuuaacaauaucagcauaugcuauccuucucugcuugacuagacaguaaucuggcuugcugguugguaugaauauaggauaauuucacucacacuaauugagauggggaguuuguaugaauggcugaaaaauuugaguuaaagauaaaaagagacacagcuuccucaacuaugggaaauaacugggacuguuaacaaagauuuacuugaagagaaauuguauugcucaggguucuccagagaaacaggaccaauaggauauauauguauaggaagagauugauucugcagaauugacucacacaacaauuauggaggcuaagucccacaaucuguugucugcaaguuggagacccaggagagcuggugguaugauuuaguccaaaucuaaaggccugagaaccagggaagacaaugguguaaauuucaguccagggagaagagaagaccaauauccugacucaggcagccaggaaauaaaaagggugaacugcuccauccucugcccuuuuguuuucagacccucagcagaucgggugauuccugcccauguugaggagggugauuuacuuuacugagugcaccaauuccgaugcuaaucucauccagaagcacccucacaaagacacucagaaacaauguuuaaucugggcaccuugcggcccaaucaaguuggcacagaaaauuaauuaccacagaaauauuucuggauucaauggauuaaguugguaauauaguauucauauucauuuccacgugccuaaaaagaagguuuuuauccuuuuuaauauccucaguccuauuaaacauaccucacauucauguuccaugguuauucucuuauuauguugcuaagugcauuucuacuuaggccaaucugauuauagugauucagauuauaguguuuaucuucuuuccuuuauacaguagacaguguucgcaaaccauaggagcugaaaaaauuuccuucuuauauaguaaguuuuaugauuccaguuuuccaaaggggugcuuauguuaugguuauaacaguuacagccagaugacuaucuucaucagcagguauaaccccaaauauuuauacauuuucauuuguuucaaacauaaaauaugguuugccuaaacaugucauucugccagauuggacuaugcaaaagaauguuacuguuuuauuuucugcuuuuacuuuaacuuguucucauuugagcucuaccaguuaagaugagaagaugacuaaagcuagggaagcacauuuuaaaugcuaaauaccauguucauuucaaguugggaacuugaaaugcaaguauuuuuaacuuaaucauuaaguuaaagucaguaagaacgugguauuuagcauuuauucauuuuaacuuaaugauuaaguuaaaaauacuugcauauugguuugcuugaagcuauggagaaaaacauuuaccuuuuuuccaaaaaggucuuaauauucaaaauuauuguuucaaucuuacaaauuaacaauuuacuuauuuuugauacuuucggccuuuuuuaugugggcuacaccuaacauuuuuugaaaaauacauacugcuuuuccuguagguugcacuuugugauccuguguguaauucauuuucagugguucuauuuuauuuauuuuuuguuaguuuguauuuucuuuuguuucuuuuucucaauuuuuaaaauuuuaaaacuuguccuuuucuuuuuuuucuuuauuauugcacucuucuaccaaaacauuuucaguggcuuugaauaaaaguaucagaacuuucccgugguuagcauuagcucugagauuugaacaggauguauuaagcagaggaggagggaaggccacuaacauguaugagcuccacugugugucacccucucugccggaugacuuacaugugguaugguaucucauuuucccagcucuccuaucauguccugcggcauguuaucaccacuugauaaaaaaauugaaacauggagugcuuaaguuuccugccccaggucacagcugaucugaaaaagaaaugggauucaaauccaaaugugcuuaauugcaaauccccacaugacucuuuccuuccuuccuuccuucccccguugcugccaauguaagaaggaacaccacucccucauuugcuacagagaagacaggggcagcuguguaaaggcaccaggaauaugcccugccuccuuccuuccacuugaaagcaacaucuggauagacacucaacugcuuuuauuuuuugaaaaaugauuauuaaucaggauugaaguggagggaaaaaaucaaaacgaauguuucuuuuuaaaaugaaagauacuguuuaauuauuuaacagccuuccgguuuuaguuaauaucuuugaagacuuuggauuaagauuccagacauuuucuugaaggauguagaaaacguauuuaacuucaaguuuaguuucaaaaugacuuagcuaucaauucuucucauugaaguccucuuugagauauuauaucccaaauguaauacacagguaauaauucaauaggaauacuuggaacauuggugauauuugaauaaccuuuugaaugaaacaauugauuugaucucaaaagauagugaaaacgucucauuuuguuuuuuauguuaaauaugcuuccucuuaagucaaaauucuuuuuucuuuuugcuuuuaagcucauaaauacucugaauucucacuaaucuuuuggaaaauugcuuguauagguauuauaauucacuuggcucaugaguuacauaauauagcaguauauguugcaauucaaauauugcuuagcaguauuaguugaauucaaaauagaaaucacuuucuuuuugacaacuagcauaaugaauucauugacuauugucaaauuuaugaagacagaaaaguccuuuugugauucaaaaauguguuuauugauguuuauauaucuuuugucguguuuccauacugucucaugaagguugucuucguaauucaguuaucuaaauacaucauacauuuaccuuuucccuggggugccguuauucuacaacaggcuaauuacagauaucugugguuucugcaggagucuuaguguaugauauugaugauaucaucauuuacuuucaaaauugcaaaauaguaauuuaggaaagcauggggauuuggaaaaacaugucuucagcaccaacuguuuuugcucuuugcaugcuuguuucguaaagaacucuaaugcuauaauugcaaaauggaccauuuuaaagauuuuuccuucauucuguacuugggaguggugaaagacauccuuacugugcugcacagugucucaugguguucucuuaaacagcauuaacgucuuguaugcgcugcuuuacuaaauucucuguucugagaaauaacugaaaauacggcuuucuauuaaacgaguggauuauucuguuguuguuggcuuuuuuuucucaaaccuccuucucuucuacuuuauaguuccuacaacagcagccaguaccccugaugccguugacaaguaucucgagacaccuggggaugagaaugaacaugcccauuuccagaaagccaaagagaggcuugaggccaagcaccgagagagaaugucccagguaagucuggcucuuccaucauucagcccuacgauauugggaaaccugagcuugccucugccucagucuccccacaggccugcuggcuuuaucaagaucuuuaaagauguaaaguucuaauuuuaaauguuuacugugugggcacaguuuguggguuuuuugcauccuccgugaacaugcugccuaggaaggauccagguauaguuggauuuuguaagcacaaauuaaaugaugucuguaacauucucucuggcgaagaaagguacuuggcauuauuauucuguguauauguaguaccuguaaucaacauguuguaaauuaaaauccaucaaaaugcucuuuaguaaagaugagguuuuguauuaaaucccagacuguuauaauugugaaccuacgauuguuuacagucuguaaaaucauagagacuuaaaacugagcugaaccauagugauuauuucaucuagucuccuaagugauacauaguggaauagagguucgagagaguggcuucccauuuuagcacaaagcaaaaucagugagccagagacaacauuuagaauccaggccuuucuugcuccuaguacaguacuccuuucauuauacuuugcugaaaaaaaaaaaaaaaaaaaaaaccuguuuugguuugguuuguuuuuuuuuagcagguccuuaauuaagcaaauuaaaaaauaacuuaugucuaaaacauggcuaauccauauauacuaucaacuacaauugaagcuaugucugcuaccaggcacuggauguuguauuggaguuugauaauauggaggauuuuagcccuugcucagauuccucauucauucauucauucaaucaacaaauauggacuuauuauuuuccagucacuuuucugauuuguagucuacaaaccuaggagugaauguggggggaaaagaaguaggacauaaaagugaaugaauaaagaucucagguuaaaguaagccauucauuuuuaguguuaauauucuguggcaaauaucagaagauaggagaaauuuuugucuuagcacagaugcuuaaucucuugagagacauuaaaugcaauuuaugaauuagacugcugcguauuuucuaagaucacagucagucuuuaguagacaauuaaucuuuccuguaauuucugaucugggucccugcugaccccaggaagauuccucccucccagggccaaaugaauggccccugagcaugucuuucccaugcaaaccagucaaucaaaagcuccuuacucccaaccaccuucuuauacucugggccacuauucaccugcucuaaucaccccaggaccagguaccagaccacuagggacaaccucaugccccaucaccauuauuugaacuaaucaguccuaaacccgccuacccugcuucgcucauucuuuccaugaaaaccacaauaaaaggcucuugcucauguuuuccccuccugaccaacccuggugcuucccauaugacccugcauguaguggcauguaccggcuucuugggagcugaguaacaaacugucuuuuccaugauaaucaucuccugaccucuuggccucaccugaauaauaagaaaaucuacccuugaaaacauaaaacuaauaguuuaucuagaaagguacaacacagguacuguuuuuuguuuguuuguuuuguuuuuuguuuguuuguuuugccuuaagaugaauaacaauacuuggaucuacuuugguauaauaacauaaagaggaaaaaagccuuauaaucacaguacuuuuggcucuggaauauaaugugcaguucuaguggcugcccacgaugaaaaccuaacagcuaauugaacuagaaagcuagccacagggaauuauuaaguuuucaccugaugccaagaaaaucagaucuuuccuuaggaaagacacaggcacuguucggaaagcauuggaggacuaugaaucauacuuauugccacugaaauguccucauuugaauuuacauccuaucucccuucuuuaugaagcuuucagaggcuuccugugcccucacaaauccacuucugggcacaugaagucguaaaaaaagaacaaugacaaaaauaaacaccgaaugcucagcuugucauuuucagcgccuaccacuguacccugacucuggucuuccuaccaccucuuccuucucaacugcuacccuugcuuucuguacagcguuaagcugcuguucugaucaggccacucugcucaucgucuguucaucucaucuugggcuucccuuugcccuuggcauugaguucuucuggaaaugcccucccacucuucuucacgcugacacaucucacccauuccuuacaccccacuucauacucagaaugagacaggcagucauugcucuuaccuuucauuuaauucuaaauauuugcuccccgguuuuguuagugauuucuggacacaccugcauuaucuuuccaagcuggauagaaaccuugagaccucaagucaugaagccugcuaccugcauucaucguggacccacuguagcauuuuuuuuaauguguguuuuuuuaauccuggauuuuuucuccuaguauaucuuguucauuuuugaccuuauuaagaaaacuuauuucaaauucucuguuaguuuuagaugugacaggucuucuuuaaaauaauaauuuaacuuuuagcacaucuguguaacuugugacuuaguucaugauuuuguagauuuuguucaucuuuuagucaucagauauaucugauauaaccuaagagauguugucccagagcagagaauguugucuacuagauuccaguggucauaggaaugugagacaccugaaaucaauauguaucuucauagucuguggugcugaaaucuagggacuuuucaacuuuaaacuugccugccucuuaaaucucuacuuaguaguagucauuuucucugcaugaaacagccaagucuuugaagauugauaaauccaaaugaaauugauaccuuugugccugcaguggaaaauugcuuuauaagaauccauagagccacugcaagggccagguccugagaauuuuaaauuuuaaaaauugugcgguuuuuuaaauuaaguuuuauuguaguuuuuguuauauguuuucuuacaaauacagaggauuuuggaauuuuuucauauuuugguuuguuguugccauuguggaguauaacucuaaaccuguagauuuuuguugcuaaaccuguagauuuuuguugcuauaugucgugacuagcaucuagucaaauagaaaucuacagcugaaccaugugugagcacuuuuauuacuuauaaacuuacuacuuuuaguauaugcuuaaaaugaaguccuucaaauugaaagcugacccaacucauagguuuuuauuucuuaucuuuuuuggagauggagucuugcucugucacccagcuggagugcaguggcacaaucuagacucacugcaaccuccaacucccugguucaagcgauucuccugccucagccuccccaguaacugggauuacaggcacgugccaccacgccgagcuaauuuuuguauuuuuaguagagacaggguuucaccauguuggccaggauggucucgaucuccugaccuugugauccacccgccugggccucccaaagugcugggauuauaggcaugagccacugugccuggccuagguuuuuauuuuuaagauaagcagcaacauuuuaagagcgccccuuucuccugucacuaaauauaaauaaacuuagcucaccuaaugaauuuuuuauuuuauaauaaaaaauuggguaccacaggguacaaaaacaugaucuuuagagccacagagaucuugguuuauauucuucccucucccuuuuuuaccugcauagccucgagcugguaccuuaaccugguucguaaaaugggauggcccuggcuaaucucacaagcuguugugaggaaucaauuaaauuagauagauuuuguaaagcucuuaauacagggucagcaguaaugcuacuuguuaucagucccacagugaaauucacuguucacagggagauggucagccuacauauaguguguauucauuugcaguagagucuuagugggauggugcaggugauuuguuuauuuguggggguauaggauauuguuaaauuguucugaaaaucaaaaugugaguuaauuucuauaguaaugcuuauuugcaacucauuagcuaaauaaaucucuuuaauuauuucauggauucccccagcuuaaagcuuaaaguccaguuucuuaaaguguaugagguaaaauggaaaaaauguaaauguaauaugggaaaucaguucucacauugcaguagaacauugaacuucuaucucaaacuaauuuugagauuccuugcuugaagaauuguugguagaguaccaccacugugaacauucccaaagcaggaaauugaaauauuuauauugcaaggcuuaucucaucuauaaagcaaagauggucuuccauuucccccuugcccacagguucccuuuauuaacgugguagaagcaccaaagcagaugggacaauauguuucuuuucuuccauguucuauucuuguucauugcagcagggcauuugucccaauuuugcugugaaccuugagauuauuuuugauaugcuuuucaaguguaaugaaauauuuauuccaucuuguuuccuccaugguuuuacaaaaacaacaagaagaagcuaauugccuaucauauacaaagaaugaaugccaauggacaauaaaaucuguaauuaggaacccacauggugauuugauauaguauugucucauagaagucuucuaucuauaguuauuuauuccaagccucuuuuucuuucccaucuugaaguauguuagaagagucuauuccuuaaggcuaaguaccuacaaaaaacaggcucuuauaauacaguaaucaaguuuucucaugcuuugggaguacacagaguaugcaaguacacaucuggcaccaaaccaauauuuuguuuccuugaucuuucuucauuuuaccuaguucagaguugcacuucaaacaaauucuacuugucauacacuugaaaaggcagcuguaggugguaggaaguuaauauuuucuuugaacaacauacagaggugcagacuuuuacuuuuuguaucagguuaaugagugaacuucucucagggaaauccaggugaacaucaaaguugagagcaggaagcauugauuuccuacaaaacacauucaccugauaucuuagucaguuuguguugcuauaauagaauaccccagccuggauaaucuguaaagaaaaagaaguuuaaaauucggcucucaguuuugcagguggggaaguccaagaacauggugcuggcaucuguugaggacuuccuugcuguaucauauaugguggaaggaagaagggcaagaggagggcaaaacugaguuuuauaacaacccacuucucacaauaacaaacccacuccccccauaaugauacuaauuuacucaugaggacagagacugaaucaccucuuacaggacuuaccccucaacauuguugcacuggggauuaaguuuccaacacaugcuuuuuagggguuacauucaaaccauagcaguugguuacuaaauuagugcuacuuguaaaaaaauacauguuugcugcauucagaauauuacauguuuucuuggaguuuuuggaaggacuuagcguaauccuugcuguucaugacuuagguuggcaagcucaaagggccuuaauuccccaucaguucuuuaaagggggauaggucuuaggauauuagacagcagaagucuucuuuuucuucccccauuauguacugcuuuuuggcauuguauucaugacacacacacacauaaaaugucauauuuucuuuaaagucaaaauauacaguuuaaaaugguuucaguugcuuucauaagagaguaaaacuuagguguucaguuuaauauuggaagaccuuguucaguuaaugugugccuuccaugaauaguugguauuuguucacaucaaaucaaaugacugucaguucucgggguaaaaaaagaccaaccuugacucaaaaagcuauauuccugcaauaaauaugaacauuuauguuuaauauacugcugugauuaauuauuuauauccuagugggaggucaaauauucuucagauaggaagggguauguaauaaauuuuuuaaauaucuaaaaugacaaaaauagaggaaaaacauaaucauccauccuauuaagucuguauucaaaggaugaacugaugauuuuaaauucaaauguuuccuuaauuuauaggucaugagagaaugggaagaggcagaacgucaagcaaagaacuugccuaaagcugauaagaaggcaguuauccagguaaaaccugaacccauuuccuaccaaacaucacaugccagcagucuuuuuaaugagugucugcagguuuaccuuuaucugccagcaccucacgugugauuguucauagucccaugaacuucagcuguucuuaaucauugucuaguaauugaguuguuuaaauccugccuuauauuugcucccaauuauuucaaguuauaauucauugccauaaaacucacauuguaacuugcaaucuacuuuuuauuaauaauacaucuuuucagucaccacaaucuucugcugcuucucccuccagcaaaaauuaugagaauuugaauuuuugauggaaaccagucucaaaauuaccuuaaguaaaccaacaguuuauuauggucaauuacuugagguacuguuaguaagagagggauuuuuuuuuaauauguaauauaagaguuucaagagugcauauauuuauccaaaguuauuagucaaaucagccuucagagagccuaugaaauacugauuuucaaugagaaaguagguuugaugaggguuggagagugcaagaaagugaaguaagcuauaaaacguagaauuagucaauguuggaaugacuaugcagucuuuaggauacuuuuuagcacuagaagaaaauggaauaggaugucuuuuuuagaagacuugaaauugcugcuucauccuacuuauucaguccccauggacauauguguuuaugauggcagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggguaggucucgcugcagccgaguucacacuucaggucacagcacagacaguaaggguggggcacugggaacuggaagccauacaaaaagaaugaggagaaaugccuugagcacuguuauucagagguucaaccccuguccauuccaucuugaaggucaaagggucacagggcagcuaccuccacaaggucaucucuacacagcagguacucacacuuccccacagagcagccagacaggacucccagggacucacauugcaagcccugacuugauuuaauauuccugagguggugacaauugauggcauaguucaaguucgaacacaaaagcuggaaggaugucuuccagucccuucaggcugcuguaacagaauaccauagacuggguaccuuaucagcaacagaaguuuauuucucacaguugcagaggcugagaaguccaagaucaagacaucagcauacuugguugucuggugaaaguuugcuuccugguucauagaacuuaaauuuuguuuaucuuuuauuuauuuuauuuuuguuuuuguuuguauuuugcuguauccucauaugguggaaugggcaagagagcucucugggcccucuuuuauaaggguacuaaugucaaucuugaaggcucugcccucaugccuaauugucucccaaagcuuucacccucaaauagcaucacacuguggcuuagguuucaacauaugaauugggggugggagagacacaaacauucagaccauggcaaaggauuuuagaaguaaccuugcccagcccccucaucauguaaguauaauaauauaacuaaggucaaggaaaguugagauuuggcugaguuguaagaauuuuuaguggaccagaaagaauuagaacucaaauuuccaucucagagcaguggccauauucucuguggggaagcauuugucagucaugacauuagcaaugaugagacuuauucaugguuuucagugaucauugccccaaaaaggcauguugagugguacaggcauagauguguucaccggcauucugugggagagcuuacuuggaauggaaggaacuuucugagcaugaguguguaacuuauguccacuuguucuuuuuuuuuuuuuuuuuuuuuaaaugagauggagucucacucugucacccaggcuggagugcaguggugcaaucucagcucacugcaacuucugucuccuggguuuaagcaauucucaugccucagccucccaaguaccuaggauuacaggugagccacgacacccagcuaauuuuuguauuuuaguagagacaggguuucaacauguuggccaggcugaucucgaacuccugaccucaggugauccacccaccucggccucccacagugcugggauuacaggcgugaaccaccaugcccagccauuuguucuuucuguuugucauugagcaagggauauugaaagcucugccugugauuguggaccgggccauuuuucuaaacagugcuaucaguuuuuauuuuguauaguuugaggcuguguuuuuaggcguguaaauguuccaggcuguuaggcccuccuugagccucuucuuaugaaaugaucuuuuuauccuuuguaauguuuugcuccaaaaucuacuuuaauauuaauaaagcuauuccagcuuucuuuugauuaauauuaauguggugcauuuuuccauccuuauacucuuauugaccuuguuugucuuuauauuugaaguguauuuuuuguaggcagcauguaauugggucuugcguuuuccuuuggauugggaagaccauguacacugaaugagguuauggauaugguugucacugaaucugucaucuugauauuuguuugcuauuuguccagucuguuccuuguucuucuuuuuuccucuuuuuuuuuuggauuaauuagaaauuuuuuaugauucuauuuuaucucuuuuguugguuuguaaguuacaacuaguuuguuauuuuacugguuuaucuccuuuguggguuuauaaguuauaacuaguuuguuauuuuacugguugcuuuaggcuuauagaaaacauucuaaacuugucacgaugauguuaugucaguucaaaugauauuauaccacuccacagacaguacuuuacaaaaguacuuccauuuuucaucucucucucucucuguaagcgguuguugucauacuuuuuccuuacuacauuguugauguuuuucuuuaaacaguuauuuuuuaaugaguuguaaauuuaaaaaaaaaacaacauguuuacccaugaagucaucauuuugggugcuguaaacucuuugcgcagauccagcugguaucauuuuccuucugccugagagauuuccuuuaaaaugucuuagagacugggcuugguggcuuguaccugcaaucccagcaacucaggagguugagauaggagaucacuugaacccaggaguucgagacugcagugagcugugauugcaugacuguacucccaucugggugacaaagggcauccugucucuuuaaaaaaaaaaguuugagugcacauaaguuggugaugaaaucuuuguuuggcuuugaccaaaaaugucccuuuuauaccuuugguuuugaaaaauauuuuugcuggguaaaaaauacuggauugagguuucucuuucacugccugaaagaugauacucugcugucuuauuuguguugauaucuuuaucuuuauuucucuaaaaauaacaugucuuuuuuuucuguuuuuacaguuuucucuauaucacugguuuuuaacaauuuaauuuugauaugccaugguaucauucagucugcccuuaauuccaucuggccguuuuucaucuuaucaccucacauacuguaguuguuguauauagaaauuuaaccugggcuacccccaacacccauaauaucgucuguaucuuaacuuuugaaccuauggaauacaguuauuauaugaaaacuguuuaaauauccauguuugcuaauucuaacaucucugucaacuuugaaucaauuuugauugcuuauuauuacauguggcauuucccuguaucauuuuaugccucauaauuuuuuauuaaaugucggacgcugaauuuaaaccuguugaaugcuagguguuuuuguaauauucuugagcuuuuuucugucacauaguugaguuacuuggaaacaguuugauccuuuugagcuuugcauuuuuagauuuguuaggugggauagaagcaguuaucagccuaggacuaguuauuccuuacuagugaggcaagacccuucucagucaucuaccaugaauguuaaguuuucucaccugacucgugggaagaggcauuauuccugucccugugugaacaccaagcacuguuaaugcuaauucuuuuuggugauuuucccccuggcuucaguuucuuucacaugcauguacccaucauuacucagcuauauucucagggaucacucugcacaucucuggauucucuuuuggagcaacucucuccucaccaauacccuguccugugaauuacaacuaccuugaucucuccacacacuucauguccuccacuccacgaguccucuaggcucuguguggguuuccccaccugaaaccaugaccuggaaauucagggccaugaguuuggcagcuguaaguccucauuuguuuccccuuuucaggaaucaguguccuucaccugaugucuaaugucuugcagaaauguuguuuaugccaggugugguggcucacgccuguaaucccagcacuuugggaggccaaggcgggcggaucacgaggucaagagaucaagaccauccuggccaacauggugaaccccgucucuacuaaaaauacaaaaaauuagccaggugugguggcgcacaccuguagucccagcuacucaggaggcugaggcaggagaaucaccugaaccugggaggcagagguugcagugagccgagauugugccacugcacuccaguguggugacagagcaagacuccaucucaaaaaaaaaaaagaaacgcuguuuguauaugaauauauuguccaguuauuggugguucaggcaggaggguaaauccaguucuucucacucaaucuuggcuggaauuguuugugcauuuuaugcaacuuaaccagaaagucacccauuugcaccgauuuuccucaccauuuugauuuuucuuucuauggauaaaguuacagugcacagaaagccaugaggagccguuaaagagcucguggcauucuuccaagacguaagauacuauuuacccuguucuaccgaugauaucacugcaaccucgggagauggagcggcugguucagggugacacugcugggaagggagaggguagagccgcgagucacuguggugccuucucacuagaacgagcuuccucucuaaacaaagagcuuuugaaaaagaauauucauauuagcguuuucauuuucuauuugccaaaauucucuaucuuagcaaggcacuugucaggaaauuuuuuuuuauaucucugcagaacaaaaguuccuugguuccucucuuuuuuggagaacacgcuuucaggagaggagccgugugaucauuugccagagaaggauaggcuggugggugcugagaccagaaucuuuauagcagaaacuugugaagcguuccagcugaaaguccaaucucuaaaguaagaucuuugcuaaauggacauugaugggacuaaaaauaagcugagggcugaauggaggcuuuaacaaauguacauuuaaacucucaguuuagucucaucagccaucacaggaaaggcaguggcaagaauguuugccgaagugucaucuuuuaucaaaggggauaauuuuagagugguuguaaucgugcuuauugugggccuccgcauugcuucauauggaauuaggcaacauguucauuugaaaaaaaaauuaaaaacuggauuaggaagaaauauuuuacugucaaaaaucagaucacuguuguugauugaucuaaggauuccuguuaaauucuuaacucggauuuauuuauuuauuuauuuauuuucucucucucucucucuuucucuguuucucuuucucuccugccuuccuuccuucccucccucccuccuuccuucuucccuuccuuuccuuuccuuuccuuuucucuuccccuccccucuucucuucucuaaucuucucuuuucuuuucucuuuucuuuucuuuucuuuuguuuucuuuucuuuucuuuucagggucuugcucuuucacccaggcuggcaugcagugguccagucguagcucacugcagccccaaccuccugggcucaagcaauccuuuugccucagccucaugagaguugggucuacagaagcuccaccauguguggcuaauuuuuaaaaaauuuuuguaaagacagggucucgcuguguuacccaggcuagucuugaacuucuggccucaagcgauccuuucaccucggcuuuuuaaagugcugauauuacaggcaugagccaccaugacucaccuuuaaaucuuuccuuuguaauaaaauguggcuggguggucacaggccuggagucuagggggcauuacuugccauuuuuguuaaguuaccaucuuuagguguucauuuaaguuuuaauguuguauggcuugaccuggcacuuaggucugcacuuuggcaggcacaagaaaauuguaaauaccuucuuuuuuuuuuuuuuuuuuuuuuuuuugagacagagucuugcuuugucgcccaggcuggagugcaguggcgugaucuuggcucacugcaagcuccgccuucuggguucacaccauucuccagccucagccucucaaguagcugggacuacaggcacccgccaccaugccuggcuaauguuuuuuuuuuuuuguauuuuuaguagagacgggcuuucaccguguuagccagguuggucuggaucuccugaccucgugauccgccagccuccgccucccaaagugcugagauugcaggcguaauuaaaugccuucuugaggacuuuuauaccuuccucuugaagacauaaauccagagcuuacuggugguugucugaaaaagaucacaucuuguaauaggagucauacauaaauauuucugagaucucccucauacuuaaccaccgugccuggaaaaugcagacaacuguauucaguaaaugguauuugaauauaaguaaaucaaaagugucguuuccauagauucuguagauguuaccacuuagaauaauuaccugucuaacccuuaacaaauucuaccguauauucucagacuuugcaaacacgggauuccaaaacaauguggauuguuuucaguuucuuugaagcucagauuuaaaucauacuuuuacucaguuuuuaaaccuaaacguggaaguguuaugagauguuguuuuugugcagcuagaauuccuuguucuacuaaugaauuucauuuccugagucccugugucugaguauacuguauguuucaaauuucugauuuaguuauguaccuauaggcaaauacacugaauggucaaccuaaaaaugcauuguuugacucauauuuagagucauacauauauaggcacauguauuuaaaauaaauacuuuaggcuagaugugguggcucacagcuguaaucccagcauuuugggaggcugaggugggaggaucccuugagcccaggaauuugagaccacccuaggcaacauagaaaggcccuaucucuacaaaaaaaaaaaaaaaaaaagauuuuuuuaauuagccaggcaugauggugcgcgccuguagucgcagcuacucuggaggcugaggugugagugugaaccaggaagucaaggcugcagugagcugugauggugccacugcacuccagccuggaugacaaagcaagacgcuguuccaaaauuaaaaguuaaaaaaugagauaaauacuugaaauauuacaauuauuaaaauaguuguuuuccccaugggaaaaaaaaguugagcagagcugugucuuugcacucagaaaaaacucuuacucuguugaaggcuagugacucuucuaaacaccaaccccuucaccuuuuuacuuuccuuagacuuucuuuggaaaaucaaggaguuagcacuuuuucccccuggaagaauuaaaugccucuccagaacugcagcacaggagguuaacuucuaccaccuuuggaggccugcaagcuaccagauuaaauacuuaaagcuaagcauucaucauuucuuaaccugcccucuacagucaugcacuuccugcuuuuuacuuugucagggcucguacucaaacuauucauagcuucaugaaacaggaacuaaaugcugucugagccuuuccccuuguaacucucagcguucugcuuauccuucauagacagaagaugaugauauguccugacuguugaagagaaauuagacuuaaugugauccuguacaguuaaaccaaaggccagauagggauuuuuuauuucaaucaacuuucuauuguaggccuagguuuggaaaaccuuagcacccccuaauuuguaagacuugaacuguuuuaaagauaagggauacacagccaaagcuuucuuuguaauucugagauuuuugguguuuuuacagauacuuagucuaaaucuuucaucagacaguuaucaugauuauuauucugacuucaacaacugcauuuucuaaagggaagugagaauuaggaaacauuuuccuguacaucuguuuaucuaucccaguuguguuguuuggauuuuuucagugucuuaacgauugaaaccaucuuauccauacugaaauucauuucaugcuucuaucugcugcuucacauucaggcuaucaguuuaauugagcaaaaaaaaaauguuggcaguuucuauagcaucggcauccuucuuugguuucucauuuuugaaugguucagccacauguuaaauuuugcugagaucucuggaaacuucuucacauaauucuuugauagaacaugaauucugugagacucuucauuaaagagcacgguuucaucacuaaguugagauuuugcucaaggcuauuugguaaauuccagcagaagagcaauaaauguucaacaagaaacagccgucauuggagauaacaaggguagacauuaaugggagguuugucacagguaaacaggugauggcaugagaagguuuaaaccaccucauaaauaaauuuuucgccacuauaugauguggauuacaacuaaaccaaacuuuaaccaauguggguguugguguaccuuucuuuucuaaagcaaaaaagaaauugugguacuaaacuugagcuuuuauaugauaccgcuaauugcccuucacccaacaaaccaauuauuucuacccaucacuuuucguugcaaaagaaauuaucuuauaaaauauauguauauagcauauaucuccaaagcaaauaugggacaucuguaccucaauguaacugauaguaaguuaaaaauuauuugcugaguucuugguauguggacagaugaauauuauaauguuuaaggcauuccaccagcagguuuugaauuuaaccaaaauuuuaugaagcuaaucagaauggaauuaaaaguugaaagacugccaggccaaaaagaucaucuuucagaaaaguaaauaauugcucuauacuuacauauuuauuauuuauuuguucaccauccguuuauuuuuaguugaguucuguauacauuggugagcaaagggggacucauuagcuugggcacuccuaagggcaaacccaauaacagauagugaaugggaaggaaaaugagagaauuagcauuuagugaacaaaaucuuauaaacuaugcugaaugguauacaugcucuuucaguaaagccacucaguacuauuacuucccuaccuucugaauguuuaccaaguucgauaaaaucuugcuacauacaaaugggaaguauguaacaagagauacuagugguuucuggguuuaauuaaguuacauagaacauuaagaaguauguugggaaggcauuagcuuaaaagcugucuuuugccacugaggccauauucaucacccagauucccuccacaguggagcacugcucagucacugccuucagaaugcaaauaggucuucacaggaugcuauuaaaacccauagcaccguaugguuuuacgcucugcuuucuuccagcaaaccuacguauuuuaauguuaauauauauguucauuuuaucuuugagaaugaaaauguauuaugaaaauauaaauauuuaguuuuuguagacaaauagcacauuuaaagauccaguaguuauucaccugccugguaugacugauagagaacagauggguagcaaagaauccucacccuggaaacauguacgcauacacacgcaaacacaaucucgcauaagcuuuaagggguucauucauuuugugaagguugaccauggauaccaguuuaaagaugccaggugauguuuggcuuuuaaguaucaucaccuugaguuuccuuauauaaauguuuuaauaucaacaaaaaacucagaauuucuaauaggucauaacacugccuagguaugggaagaggagaggguaaaauuaaaagaaaugcaaauguacuuuucuuugaauaggcuaaccaguuagaggauguaugaagcaggaccaccauaguccaaguaugaauaugcaaaauuaaagcagauugcuguaaaucucucuuaaaaagucaagaauaugucacaguuggcauuuuucggaugaucagaccguuugacaaaucucugcaaggguccgaguuagucgaacauaucuuuugcuuaugauuucagcaacacugugcgcuuugccuucuggguuguauuacuaauucuguucaucauuaaguguacacauguuucacuguuugacuaaacaaagcuugaagacauacaaguccaaacauuuucuguccuuucuguauucccaggucagaagaucuuagcucuuuauccauucugugcuagaguuugucugaaagcaugaaucaugggguuguguugggugcuaaauuucaguucuauaugcugccuucacuaauuuaugacuguggucugaacaaccaaaauaaauuauuucugagaacuagcaaaauacccuggaaaaaauuuaugaaaccuaccagauuuguaaaaaggucagccaggcgugguggcucaugccuguaaucccagcacuuugggaggccaaggcggguggaucaccugaggucgggaguucaagaccagccggaccaacauggagaaacccugucucuacuaaaaauacaaaauuagcugggcaugguggcgcaugccuguaaucccagcuacucgggaggcugaggcaggagaaucgcuugaacccggguugcagugaggggagaucaccccauuguacuccagccuguauaacaagagugaaacuccgucucagaaaaaaaaaaaaaaaaaagaaaagaaaaaaggucacuaagugaugagagaauuaaaaccacuccuauuuucuaccuuuuauaacauaaacucuugucuuuacuucccagguuugccaucuuuauaaccuguaacuaggagcaagugauuuaauaaagggauuccuccuauuccgucugcaaauuggaguuaauuuuucuccucuuucugcaauuucuguuguuuuagcuuuuguuagccauaauuagaaaaucaaaaggauucauugaaaguugagacaaaauugugaaguaggaagaugucuuccuccguaagaggagaaagauuguuagaggaaguacauggaggcuuuggugacacaucccuaugaggaagugaucugcuuccacgggaaggagagaacagaugauagaugacuccuagaugcuccugcgucauguucaguacaaaaucagagccgcaucagcaaaccggauacccugggaaggaacauugggauaacuccuuggccauaaacaaaaguuuugcucuggccuuaugacuaaguggauuaauagagauuaguuguucaauauccuuccaucuaauggauccauauuguuaaaacuuaagaaacaccaaagggggagagugugagaaucuacugccauuuucuccauugcuucauucaagacuucuguguccaccuuggcaugggauuaucauuugcccuuuuauacucaccuuaaacuacaaagaucauuuguuugccuuucugaagaaaggaagguggauaaauuuugcaggagacuuuaaaaauucagcucaacuccuggcauuaaagacaauaaagguggugauucagagguccccauggcaguuuccccaaauauuacguuuaacuaagaucaucucaagcacagagagacuuaacucucuaaagugugauuuuuaaaccugcacacggaaauuuucuacauuuuauaugcucaagauuucuugaaauccaggguguaaaacugugaaaauaauaguucugaaccuauuuaugaaagcaggagagaauugcuuuguucaguuuuggaaaccaccagggugcaauuuaaugcuccaggagaggguuuucugugaccuggaaagguuggggugauucccguacagugagucauuuacuuccuucuuggcaggauuaugcccagggcuuuuaaacgcucuugacacuucacugccuuccauaagaaacggguuuagggcacaagugucuauuaugauaagaugccagauuucuagaucaagcauaaagcuguggagugggacaauaggacuuaauaauuuuaauacacuucccacgugaacugucaaguaauaagcuacauauucagacgugacuggcauugagucauccugccauuagucaaauguaugagacuuuucccaagucccagcaacaccaaauuugagaaaucguauaaaagaaaaaugaaaaaguaaauacgucuaagaaauggggaaaucaauaaaaaauguacuagcaccaggggcgguggcucacgccuguaaucccagcacuuugggaggccgaggcagguggaucaccugaggucaggaguuugagaccagccuauccaacauagugaaacccuucucuacuaaaaauacaaaaauuaggucggugugagggugcacgccuguaaucccagcugaacucaagaggcuggggcaagagaauugcuugaacccaggagguggagguugcagugaguugagguggaggugcaccacugcacuccagccugggcgacagagugagacuccaucuccaaaaccguguuagcuuuuaucaggaaaggccauuaaauuuucuucaauauuaccuacaucaauuugacaucaaacuauaagaacacaauaugugagauguuuugaaauuaaugaaaugaaucuucucuuugagacgaguuugugcacgcuaugaaguccauuaaauauuuucugggaagaguucccaguuaaaacuacuuucuaaaguacccaagcacacuauauagauacaucaaguagguuuauuaaugucaguauuucggugaaaauugggaaggccacuauucugaguagagagguguuuguuuucuacuugaagacuaugaaggauauucugcacuacugggccuauuucugaaauuguaucuagcugcaaguuacucauuaauuuaauuaacaaauauuuauuagcaaccaaauuguggcaggaacugugccuagagguagaaauacauuacgcucuuguuuccagagaggaaaaugaguaauguucuaaaauguaaaucuuauguuucucuuuccucuugcuguaaaugaugucuaagccauuucgguggugccuguucuuaauccuuuaauaaauuauuuugaaugauuuuuuaaaaggcagugugauugugaggugaguuuaguacaaauuaaaaaaugucacaucaguugcaaacagacagcacauaauuaugagcuaaacacuguuucagaaacaguagugacaauaaauaggauucgguauaauuaguccuccugggacagaucucuuccucuguucuuugccauauauuuuaauaaugagauuagccaucuaaugccaauauaaccagacuguaguauuaauacacagaaaaauuauugcuaguaacagaagauuuaaagacaugagggugauccggauuauaugccugcagguuaaaaaaaaaaaauguuucuuaaacucucuuuaucaauauccuuuucgugagccacugaauucuuuuguuuuucugaucauaugaauaacccgucuuaaguaugaauauugugacaauaguaauagcaauuacuuuaagagaauauguuucuauagagauaacagagggguuuuucccuaccauuccuguaugaagguuucuguguuuuuaauuaaaauuuuaagaaauucaucuuugucuuagcauaauaaaauaaaccucacuagacaaucaggacaccuuguuauucuuagauacauuauuauagcucaagaaauaacaaauguuaagccuggaggauuuguauuuuggccaaaaguugugagggcaauuauuuauuuauuugagugaaauaugcaggaaucauauaucaaaaggagggaggucuuuuuuuuaaccucaacaaaaauauaaaaguauagggaacuguuaucuaugugaacccagcaaaucugagacaggucucaguuaauuuagaaaguuuauuuugcccugguugaggaugcaccugugacacggccucaggaaguccugaugacaugugcccaaagugguuggggcacagcuuaguguuaugcauuuuuagggagacaugaggcaucagucaauacauauaagaaguacauugguuuggucuggaaaggcgagacagcuugaaacaaaaagcaggaagacucgaaguggggaggggccuucuaggucagagauaggugagaugaacaguugcauucuuuugaguuucugauuagccucuccaggguagacaaucagggugauuggcucuaagcaguucccagcuagacuuuucccuuuagcuuagugauuugggggccccaagaauuauuuucuuuuuacaccuguguuuuuucuuucuuaacuaaaaauaguauuuguuucugagggauagagauaacuaccauuuuauuugguaugauuuauuugccuaccguccaacaaagaagguaaucugauuuuguuuucauuuccaagcaugauuccuagagauguguuuagguggccaaaucaaugaagcagaacccugcaaauucauuuauugggagauauccuaaggucuuccugaauuaucugauguucccaggcuuugcuuauccaauaggcauuaggaagaaaaggcuuguguuuauguagaugcacacaaaaugcgcaucucagcuuacauaaacagugaagggguuucccaggucucauuaucccuggaggagcugaggccuggggaguccucagagccuccuuugcuacucuguuauuguggcaggccaaaucucacuaaugcaggccuccguaacagcuguuuccguacugacugagugguucaguuaaauacuaaaagcuaaaaaaaagccagcgcccuuauacagaggcuggaauguaacaaaagcccaccaagaguuuugccuaggccuuuccuggcaaaaccaaggaauucuuaacaggacccauuuaggauuaacaaguuuuacugggagucugaagaaacucuacaggccuccaagaacaaguuuacuggaggucugcaggaacuccucaaaccucccugauuuagcaggagacaagauaagaguaaucaccccagcaccuagacccauuuagauuaaguaaauuuacugagacuccagaggaaggucuucaggacucagaccuuaguuauggauuaaagaaguuaaucacuucugucaugagaugaaugcacacuuacacguagacauacagcuuagaaggcauauaaguucuggaaacuuuguaauuuugaguuggucuggcacuaauuuccaggccaucucccuguaaaagguuacaaaaauaaaaacucucuuccucccaguucaucugcaucucguuauugggcugugagguauaguagcccaacccucaguucaguccgggaacauuauuaucaaacucuggggauuuucaggauaaguuaggaauauauuuugaaggagaauggcaguauuaaaugagaucagcaauugaaaacaugugaauacauucaccauuuaauuacccaucucaauagaagauaaggaugaauuuagcacuagaaaccaugaaugucacaaaagccuaacuuuaauaccuugaaucacuuuccaguaauccuaauccuuuauccacauggauagaggacauuccuaucuugcucuuucuucuccccacacauuagcuuaauaauuagcuaaauaauuucaugcauuagcuaaggaauaauggaacuccagaaaccuaggacaguaauugagagacugaacaagcuaaaucugaaccuucugcacaauuaaaggagcugauguuagcauggcccacagaauauuaccugcacuuguaaaaacuagaaagucaggcaaguacuccuggaacagacugucuuuucuaaccaugcacuuauuucuuuguuuuuaacuuuguuuuuguuuguuuguuuuugagacggagucucguccugucgcccaggcuguagugcagugguggaaucucaggucacugcaagcuccgccucccagguucaaacaauucuccugccucagccucccgaguagcugggacuacaggcgcccaccaccaugccuugcuaauuuuuguauuuuuaguagagaugggguuucaccauguuggccaggcuggucuggaacuccugaccucgugaccugcccgccucggccucccaaagugcugggauuacaggcgugagccacggcgccuggccuguuuuuaacuucguaaguugcuuuguagaacuaucuuaaacuuggucuauuuuagauucuccuugaagggccagaucacaaagugauuaggagaaggaggcucuggagccaagacagugagacuaacccauucuucaaaucuaacacuaacuagcuguguaaccauugggccagggauguagccuauguaaccacaaucuccuuugugcuucaugccucaccaauaagguggggagagcugcuaugacucugucauagggcugagacgaagauuugaugaguuaccagcaaaaagcauuuaauauacugucucauucagaagcagucaauacacauugaacucuuauuacuuagaggaaagaaaggggucgaugauuuauagauaaggccugagugaaagaaauaaauguguauugaguaucagcaauggacuacgcaucauucuggguaacuaucacugaacacauuuaaucugcaaauacuaucugaaagauacugccaucugaauugcauaggugggaaaagucaaggcuuuugugcuuauuuuuaaauguauguuaacaugaauaauuaauuggccgugcacuggucgcacgccuguaauccuagcacuuugggaggccaaggcgggcagaucacgaggucaggagauggagaccauccuggcuaacauggcgaaaccccgucucuacuaaaaauacaaaaaaauuagcugagcaugguggcacgugccuguagucccagcuacucaggagacugaggcaggagaaucacuugaacccaggaggcggagguugcagugagccaagaucacgccacugcacuccagccugggagacagggcgagauuccaucucaaagaauaauaauaauaauaauuagugggaauauaugcuguuuguugugauaggagaagaaaaggggagauccagauguuggucaucagaaaugaccugcaucuucucuaaauugaaauuuagcuugaaguaguaaugccaaggccagccuggggccauggcauccugguguaccugcuuguuggugacaguccuuuuaggacaaaauaucuuacaaaaacauucauagaugacuaacuggaaaaaaagaaguuaugaugaaaagcaauucuuacuguuuuuguuuuuuguuuuuuguuuuuuuuaauuaaaagacaggcaguuauucucuuucccaggcuugaguacagucgugcaaucagggcucacuacagccucaaccuccuggguucaaauaauccuccugaccaagcuucccaaguagcuggaacugcaggcaugugucacugcaccuagcuaauuuuuaaaauuuucuuguagagacagguucuuguaauguuguccaggcuggucucaaacucuuggcugcaagugauccuccugccucagacucccaaagcaauccuuacuuuuuuaauugaagugcuuuuuuuuuuucuuauuuaaacucuuaaaaauucaucccauuuucuucaaaacaauaaauccuuuacaagggagaaaaaugaaauagagcaacuaagaaagcauccaugaaggccaggaaggaacaucaugguuaaaugcgauuagucacagccccuucugucuccagucuuggaugaauaaugguaacagaacuagagagauuucuaagaccuuggugcuuaauaacaagcaagcaucgagggugguugugcaagauccugaucacacaacucugcauaucaaauauccuucacaaucaacaagagucagccuuuaaucucugauguuuucaaauguucuuuuuuuuuaauucacauguauaaccuauccucuuuucaauauauagagauauagcuuaucagucauuaccucuuuuacuacuuuucuucugagauuuaaaaggucauccucugauuuguaaauucaaccagauuucacaguucagaugagaguuguaauaaguugccaagaacuguugcaagcugugauggcugucuuucuggggauuauagagaagcacauuucuuuuaggaaaaaagaaggcagaugagcccaaguuguuuuauuuuuauuguguauauguauuuguuuucucaaguacaguagcauggccucuguggcaggcauucaccaagcaaauacagagcacccucugggucaagcacuguguuauugggguuccaaauaaagaaaaaagaccaaauccagcccuguggaucucacauuaaagaggggaguaagaaucauagauaauuuaaugaguuagguacauuaauggggauuugcacaguauuucauaggagcacagaaaaaggguaccucguuccaccugagauggcagggagauggcuccuaaguuaacuaagcaaaaggggaaggagaggcacaucccauaggauauggauaacacaacaaaagcuccauuaccacccgccccaccaccacacacaccaucucuggaauaaauuuuguaccuuccaacugguuuucaggguacucaugacacauggguuaauaauagcuagguuugcccaaaugaccaaaauucuauucccaacaugaauuuucacaacugguuuuuuuguuuguuuguuuuaaugaagaagaaauguuguguuuuuggaaaucaucuuacaaaaucauguaguggaaugcauauagugaugaaauuguugaagaccagggaaucuuuguccuuaguuuuuauuaggauggauguuuucagguaaaacuaaaauaaaaaugaaauggaaccaauuagaaagaaaauaggagcacuuaagacgaaauguaauuguugcugaaagaauuagaaucugauagcuuagaaagaacuuaauuaaauuucagaguaaaauaaauacaguuuagcaauggccuuucuccuagaaaaauauaaugucucuuacaguucaguuacuccuuggcuuacaaaauagugguuaaauuuccuguuuuucucauuuugauuucguauguuacauguuacuggugaugggauuaucugugugacauuaccucuggucuucaaaauguacacguagcaauguagucucacauaugccccuugggugcgaaaagagaaggaccuaacuuaaccugacagaccucaaaucuguucucuuucuauagcagaguacuccuauuuaaaaagaaaauguugaguaaggaggacagucaucauauaugucgagaauguuaaaugcucuuguggaagugaaaagcagccgaucuaaguaauuacccauuaagaaaggaguaggagaaauguuuagaaggcagaccugcaaaaaggugacucacaguacguucacaugaccggaugcauuaguggaaccucuaacccaucgccaauggaagaagcaguguuuugcacaaacuugaaaaagaguuuuucauuuuccucccacagccucgucacguguucaauaugcuaaagaaguauguccgcgcagaacagaaggacagacagcacacccuaaagcauuucgagcaugugcgcaugguggaucccaagaaagccgcucagauccggucccagguaagcgugggguauaaucaucuucugcagcuuugacaauccaggauucuugcuucuuggguuggugacaggaucccacgcauucuccgagcaccuauagguguuuucccuauggcaagagcucuuuaacuucugguaaauucuaaaagcuugucuuagagcaauaugugguuuggcauuuucugaguuaugaaaauaacaaauguaaaaaucuuagucuacugcuaacugauugcuaaggaacugauuaaaaccaaugacuaaaaugagaaaaacaaaaguuguauaaacuaaaaucuugaaaacugguucaacugaaguauggcaggcaaucauaaaccuacuggaauguugagauuucaugugagccuaaaugaagcccaguaauaauguauuuuauacuccccgguucccaaaggcugaaaacugggaucuaccuuaggaaaugugaaauuuuacauuuucuugaaugaaagaguuaaauauauauagcaugaaauagccaaucaaauugaaauacguuguuuucuagggggaaauuugcaaagaaauguauuuaggcaugaggguccuguuaagagagccucaguauuaggaaucagagguggcagagguagccuuuuuaauuggcuguuauaagcauacaagauaaugguaaguuucaagaucaagucuuaaaccugagcucaaaaaguuagagaacagaaauaggagaacaagaaaaauaaaguugcccuuucaguucaaccuuuuuaacaguagcaguguuuugucaguuuucuuuuggaaguuuguaucuaccugcagugcuugguaagaaaaauaaccugggcgacagagcgagacuccgucucaaaaaaaaaagaaaaaaagaaagaaaaagaaccauuccuacccccagacauuguugaccuggaguugucauccuuugaugcagguuaugacacaccuccgugugauuuaugagcgcaugaaucagucucucucccugcucuacaacgugccugcaguggccgaggagauucaggaugaaguugguaaguaagcuguucuuuugaugcugcacauggacauguauuuucccccagaggaaaauugaggaagugaguuaucuguuugaggaauauggaaguuaauagaacagcuugccuuuuacgaugaaacugucaggcuggaacuagcuuacuagccuuagcaauugaaucaguucuuaccucuccauacuuguaagacuggaggaaugucgccugacuuaggguauaguuuuguaauaauuggacacuuguuauugaauuauacguggcagcauuuuuucuaauuugcccaaucuuguuauggcucucaaauuaugaugcuuugguacuuuacaauuaauggggaaaaaaacucauucuucaucuuuugagugucacgauuguuccaucuuacaaaugaaaaagcucaaacuuaaaauuugaguaacuuacuggccugugucacaugcauuauaaguagcacagccaaaacacauaacugugacuugugacuuugagguuauuguuauauucaguaagucacaauucucuuugauggcugagcagggaagccaugaguguucucugaaccacaucauuguuuaaacuuaaaagauagugggcuauuaaacuuauauucugaaauaauuguacucucacaagaacuuggaaaaauaguacagagaggucucaugcauccaucacccacaugccucaccagugacaucuuacguaacuauaguccauuaucaaaaccaggaaacugaccuugugugcccacugucuuuuaugucccuaguuuuccuaaugacuaaugauuucauuuaagaucucucauuucuguuucucuuggaaagagaaucaaauaccacaugagucucugucagcugccaaaaugcccauaacuguuuaacuuacuucacaaagguacauagaugacgauuauguuggugcaucuuucaauauaagcauauguaccuauacuggagauuuaguguguagucuaccaacauauaagcaauauguaucuggcauauccuuccccauaaagaauccuacccuuuguuaauuggguuggaaauagauacagguuaucaucuggaaucagagcacccaggauguuguagauggauguacccauuacaguaaguccgacuuugaagugccugaaacaccgcucaagggaacagcuggcccucacuuuuucccauuuuaugccaguguuauucugcucauucuuuccugauuuauguggccuuguaaauauuguuuguauugcugugaaauauuuggcaugugucaagugaugauguucuguucaguacugcacauuaauggacggaaucugaaauuauacuuugagcuacauaacuugcagaagaaacuucauaugucagggaggugcagugucccagaacuuugggaggccaaggugagcagaucaccugaggccaggaguucgaaaccagccuggccaacauggugaaacccccucucuaauuuaaaaaagaagagaaaaaaagcaacuucauagugugccaagcuuuuguucagaaggagcaacucaguguugagcaagaauuuaugaagauaguggagguggaguuuuuagucuacaccaugaauugagaacagagaucuccaauuaauuuuucacuguaucaaguuucuuuagcaaacaaauauacuuuucagguauacuuggagaauagacaucaguaaggaaccuuuaaaauacuauguauuaaauaaguguaaagaaguucuccaaaaaguuguagaagguacaaaaugaaauaauuuaucagucuuaaugaacugaagcuaaaaucuucuagaaaacaugguuuguuuguuuguuuguuuguuuuuuacagcuaucuuaagccuguuuucacaugugacuucaguugaaguggcauagguaauaacuauagggaaauaagccauuacaaaggacuaaaaaguugaugaccaauauuccacccucacccagcaauuauuguugacucuuuauaauuaaauuauuagaacuuuuuauuuggcacuauacuacugaaaacauuagccacuaauuagucacacuuccacagaacagauggugguucagauaucuugaauauuacgaaaugcccaagaauagggcagcacaauaaacuucaaaucucaguaccagggaggauauuuagauaacuaguaucauggaaucuuuuucuguaaaaagaaaaaaaaaaacagccauuagguuggauuaagaacauauuagggggugcagcacaccaacauggcacauguauacauauguaacagaccugcacguugugcacauguacccucaaacuuaaaguauaauaaaaauaaagaacauauuacguaugugcucuuaauguguguguguguguguguguguguguguguguguauguauguaauaugcucucaauccacccauuaguuggguuuuuuuaaguaaugacauauauaucauucuaaauauaccagaugccacauucugaaagauaaucuuuuuuaaaaaccuuucauuuggaauccugggugcuuccauuuuuaaaugacuguucucuauagaaagagaaguuugcaauaacgaacccuguacacuaucugagcugcuagugucaaagcuacagaagugguuugcuggggagaauagcuuuucuggguugaaccuaguugucaucuauaguccuuuuucauuugaaggaacauuuaaaacaauacgucccuuuuuaguaggaauauaguugaaacuucaagauuggccaggggugcuaauugcuuaagccaaauguuauuagagguuccucauguuauucuuuuuacuuuuguauguguuuaaaauuucucauaauaaaaaguguugcuuuuagcuuacuuucuaaauagguucuucauagauuuuuuuuccagguuaugucuuguagucguucuaauauucucugauuaaaugcuuugucauuagucugaguugcauuuauuugcuauuucuguauauaaucaaauuuuagauuuggagucaguucaguacaaauagcauacuaaaauucagagacacuggcaaaaggagaaaauuuuaaagucccuaaaaaugcaugccuuuuguauagaaguuugugcuuauaaauacaagcaauuaggaugugcuuaaugcagucaaacaucuguagagagauacaaugguuuaauuaaauaaugguaacaguugcuuuauggauaagagguuuucaccagucuggggaacugccaguaucuuuagugggagagguauaucugcuucaguaaauuaugcuuccaauuagaauucucuuuuaugggugaaaaugaggaagaauggagucaugcugagaagaaggaaugcuaucggugaaggggaaaauugacauuaaauuugugagcaguaaacugugaccagagcauaggguucaucaugcuugugaguucuggcccuggccuuguaucuuccauugugcuucccugaggcauccugucuguucaugcuacuuucccacuaacuucagugaaucccaaauucaugggucuagccacagccagcguacugaaucccagugccauauuccagaccccaaauaucccaugugccucugaaccugcaaucaauguguauaacacucauguccuucuggaaauuuacuuguuuuacacacucuauucugaguucucuugguuggccuaaacuauccaugaugccuuccucucccucacccauuauuucuuauuaguugcaaguucuguauauuuggccuucuguguucaugugaaaucucugcacauccccuacuuaccugagauccuguccucucaucagugucauuagacucccagccagucacccuaccucuuaucucacauuggcccccucccacuucaauuccuccuuuucggaacuaugcaaguucccuuaaaaacaaaagacaaaacaaaaaaaacagcugcaggccggcggcaguggaucaccugaggucaggaguucaagaccagcguggccaacauggugaaaccccaucucuacuaaaaauagaaagauuagccaggcaugguggcaggcaccuguaauucccaguuacucaggaggcugaggcaggagaaucacuugaacucgggaggcagagguugcagugagccaagauugcacuauugcacuccagccugggcgucaagagcaaaacuccgucuccaaaaaaaaaaaaaaagaaaaaaaaaaagcugcuugugguuuuuccuugcuugaaaaguugcaccuuucaagauucaaguaaaaugcccaaguccuauaaacccuuucuaauuugcauagagaacggagaaaagagcuggcauuugagugacaaccauguaaccaacuaaugagugccucuuugugauaaugcugauggucacauucuuucuuuaugaauguuccccguugagguacaggaccgccauauagagauguggcaguggcaggugguuuaggguaagaguggagacugauaauuuuauucuacaucccacucaaggagccaagcccucuggcauugugcacacccacuggaagugggcuguucuugcauuucacacaaaggcagcauaugggcuagugaagauacucggaaauucagugauagcauccccaguuuacaguugaagaaauugaacuuugaaccuaagagaguuugccaacuugcccagcccagauaguaaagugaugaaagugggguggaagccaagaccugccagaaguccaaaaucuguguucuuucugcugccuauuuuccucucugaaguggaauuuuccccuacuuaaccucaaugugaaagcacuggguauccaccuccaauaccauacucuaacuuggaguaaauuauuuguuuauaucucuacuaacccuccauccugugaacucuuccagauauauguuggucauccuugccuccucaagauccagcaaggacccugguacuuuuuagauauuaguaauuauaaauauaagguugaagccaguccccaggauaaaaaggcagaugcuccuuaacuuggacugaugaagugggcuccuccguaacccuaaagaccugaccaaaacuccuuccuugacaucuagcguaagcaccacacaaaacaaauuucuuuccuaggccacagcauccucuaaagcugugauugaucaagcuaacuaaauggaugugguuggccaagauaacaaagcauaaaucaggguucugaggaccuuuauuaauaaaauuuuacaacaugguccuucuuuguaccaugacccucugcuauuuggucaucuacuugauuuaauugugcuguccuguuugaccgccaaccacagucugaagcuauucccaugacaaauaagugugaauuuucaaguguccuguuguguuauaaaaggcccguguuuuauuuuauaauuucauauuuuuuucauucaauuuuaauuauuaugugcaaguucccaggcucagucauuuauuaauguuuuuauuuuuuaaaaaguuauuuucaggcagauuaugaagauuucuugcaaagaauggccucaggcauuguuuguauagagauaaaaucuccucuuuuaaaucacuauguaggucuucauuaauauuuuuucauucaacaaacgauggaaucauuauuucagugaaacuauggcuccucuucaguguucauauucugcuuuaauuauuuauuaauccuucaaaagggcagaaucccuucauccuuucaaccuuugcuuugucaaauuguuacuuaaaaaugaugguguuuucuuuguccuuuguaaucuuccuuaaaucucugcuaaaaggauucuauucuacucuuuguauuggcacugagguuauuuaucaaagugugcuucucuuugcagcuaccucaaggcuaaaaauguagcucuuuucagagauggcuguuuuacagaaugcuauaauaaccaauuuaugagaaaggcaguaggaaauaaagagggaacaaaggcauaauuguuucauacccauuuuuuuucuucuagcauucaaaauuaauaaaaacaugaauuauuauaaaccagaugcgggaaagaucucuggcugaauaaauccauagugaauggggcaggauugaaagauauggcggggaaucaagaaauucgcaauaaugaaaggaugcuuauuuuuuauuacaauuuuacuguggccucuugauaaaauguuccacucuucaggaaaaaugcagcaugguuauuucaaagacaguguuuccauauucuguuucuaauaagccuguugauuuggggguuuaguggguccaaaguagacuagguuuaaaauagaauauuuauagcacuucccagcccaacaaaauagaaauuuaauguuauugagaauuucaaguauccuuauguguaauuguuagucaaggaugaacaucaaaaaaaaaaaaucauaacagcaaauagagagcugucacuuuguucuuauaagaacauaggugugacuuuguuuuucauaagaaaugacuuuuaaauguauauagauuuaaugguuuacagcugacuuaaguauuuggacauaagaacuuuuuuuuuuuuuuuuuuuuugagauggagucuugcucagucacccaggcuggagugcaguggcgugaucucggcucacugcaaccuccgccucccggguucaagugauucuccugccucagccucccaaguagcugagacuacagacgugugccaccacaccuggcuaauuuuuuuguauuuuuaguagagacaggguuucaccauguuggccaagcuggucucgaacuccugaucucagguggucugcccaucuuggccccccaaaaugcugggaauacaggcgugagcccccacaucuggccaagaacauuuauacauauuaucaacaaccaaagccuuguucccccauugguuucauaauagucucagagcuccuuauucauauuuucccuaguguuauuaaguaacagacaugaggccuguaaguuuagcugccugugucuaaauguauaucuuugacccaagacaauuucucuuucaaaauagaaccacucauuuauaaaugaaaaugcuuugucaaaugaauggcaaaguacgguauacuauuaagacagccuccuaguuuucugacauuuggacugccauguugaaaugucuccacacagcaagauacaaaugugugaaugccaguacacuucauaccuuagguccccaacuggucugucugcagacuugagguuacagaccugcaggugucgaacucaccccauaguggugguuaguagagugcuuuguauacguuuagcucucuaugccuuuuuugguugugauauuagguaagcucucuuuuucuugcuuuggagcuuaauuauggaaucuguaaauauagugcauaugucauccagaugaucuguggaagucauugauaaugaccuuuaaaaauucacauguaauacagcauccguuuuccugaaugauuuuuauaguuuuaccauuggcaaacagauacuuucuuuuauguauuucuacuccauaauuuuaggaaaaaguaaauccuuuuagcuacauuaaaaagaauacacuuucuaggaauaaugaauguaaaaaaaguuuccuuuuuuaaaaaaauauugcgcucucuaccauucuggcagacaaauuguugaccuuaauauguauaauucagugcaguauauugaucuuguuuauugugcuccaaauggacgcuggcagaaauuugaggaauuaaauaucaaccacaguguuuucuucaugcgauugcaaugguuuguuauggauuauuuuguucaguucaaauaaaugauguacguucagauucuuugcccaauuuuuuaauuggguuguuuaccuuacuuucuuaauuuuauuuuuauuuuuauuuuuauuuuuauuuuuggagacagagucccgcucugucacccgggcugaagugaagcggcaugaucucaguucacugcaaccuccgccuuacggauucaagcgauucucgugccucagccuccccaguaguugggauuacaggcacaugccaccacauccagcuaauuuuuguauuuuuaguagagacaggguuuuaccauguuucccaggcuggucucaaacuccugagcucaggcaaccugcccaccucggccuuccaaagugcuaggauuacaggcgugagccacugcacucggccugcuguuauuauugaguuguaagaauuuuuauauauucuggauacuauuaaauucuuaucaaauacauuauuuggaaauauuuuacccauucuguagguuguauuuucacuuccuuaauaggauccuuuugacacacaaaaauuuucaauuuagaagucuauuuuaucaguuuuuucuuuuguggcaguuacuaugguaugguaucuaggaaaccauuguccgaaacaagguuacaacgauuuauaccuguuaccuucuaagaguuuuguaguuuuagcucuuacaguuaaaucuuugauucauuuuaauuuucauauauggugugagguagagguuugacuuuauucuuuugcauauaaauauccagugucccagcaccauuuguugaaaaagacuauucuugccaggugcaguggcucaugccuguaauuccagcauuuugggaggccaaggugggcagaugacuugagcccagaaguucaagaccagaaugggaaacauggcaagaccacauuucuacaaaaaaauuauccaggcaugauaacaucuauuuguagucccagcuacucaggaggcuguggugggaggaucuccugagccugggguggcugaggcugcagugagccuugaucacgccaccugggcaauagagcaagacccugucucaaaaaaaggaagaaaaagacuauuauuucccccauugaauggucuuggcacuauuacacaaaaucaauuguccauagauaauauggguuuauuucuuaauucuuaguucuuuucuuugaucugugugccugugcuuacuguaguaccacacuguuuugauuauuguagcuuuguaguaaauuuugaaaucagcaagugugaguccguuaucuuuguucuucuuuuucaauauuacuuugaguauccggagucucuugcauuacaacaugaauuuuaagaucuuccucacccccugcccccacuaccauuucugcaaaaaaaaaaaaaaaaaaaaaagugcggauugcauuggaucuguagaucauuuuggggaauauuuauauauaauguuaaugagguuuuaaacaacacuuuuaucuacuagaacugauauuugccucgaaaugauuccaccuugagccccauucaggaacguuaguauuuuagaaguagcaagagaacugauuuagcaugcuaucaucuuuuacuccaaauuuuggugagauuccagagaaauuauuugugagcuuuuccuuaagccaugaugacugacaugucaguaguuuuugucuguuuuuaugccauucuuuuauuuuugugcaugugugggcaccucaaccaaauggauggagccugaggcauggucucccacgccaaagucugccguuucuuuugaugauccaaugcaguuccaaagcuauuuucucaacucaccagcucguuuguauggcccuguaauuugaaacaaaaucuaaaaagaaauccaaauuaaaaugauugggaagugaagucagaccacagugguggcuguggaacuacuuccuggcauggaacacuagagcagauguguccugcuuuuuuuguagagucuugggaacaaccaaugauuuuagacuggaacaagggcugguuauucuguuuuucacaagcaucugccuucaagguucauuuuuuaaaagaggaggggaaaaaaaucagugauguuugccacccugaguauggagaugaauccaaauugagauuaauuuugaaauauguuucccgaauuuugagauuaauuuugaaauauguuuccacaaacacuaacugggaaugacaugaguuuguuucaugugagacggaguuuggaagacauguuaauuugcuuguugguguucaacucagaaacaaauuuugcauguauuuucugaguaagugccauuauuaguuaacaguuuuccugccguaugcacuaugggcugcuuuagaaaguaaaucauagaagguuaguuauaauaucucaucaaaaauaguggauccaucuauuaaccgguuccaaguuaugagacguguccaaaggaauguugacuuggugugcaccuaaacacuauuugugaagaggcuuuggacuucgagcaugaaacggggucagagggucaaggccagggcguuacuuaauuucagcuccuguugauggauucauugacuucagauagugcguuuaaaaaagccuguuuaauguguuugucuuuugauaauuauuauguauuuacauaugcuccuaaaagcaugaguuaaaucuuauuucuuugaaacagugcuuggcaacaacuuguauugucuuguacaugccuuuugugucuuugcuuuugguugggggggggcauugaaauuugucugcccauccccugagggcagauacugagguguggaccuaugucuucagcuuccuguauagcauugaaguugcuauagcugcauguucucuaaaauuuuuauacaugcgauuuaauuguuaaagcuuaugauuuuuaaguauaguauucugauagcaaauagauuuugucaaauaaaaacuaacuuuaucaucaccacugagauaucacuagguauauggcuuaguucucagucaccacuuuuauuuguaaggaagucuuagaaguuuucacaaguguauaugugauagacugggcacaguggcucacgccuguaaucccagcacuuugggaggccgagucaggcaggaguucgagaccagccuggccaacauggcaaaacccugucucuacuaaaaauaaaaaaauuagccgggcaugguggcacaugccuguaaucccagcuacucgggaggcugagguuggagaauugaaccuaggaggcagaggcuguagugagcugagauccugccacuucacccuagccagggcaacagaacgagacuccaucucaaaagagaaaaaaaaaaaaaagcugggugcggugcucacgccuguaaucccagcacuuugggaggccgaggugggcagaucaccugaggucaggaguucgagaucagccucaacauggagaaaccccgucucuacuaaaaauacaaaauuauccaggcgugguggugcaugccuguaaucccagcuacuuaggaggcugaggcaggagaauugcuugaaccugggaggcagagguuguggugagcugagaucgcgccauugcaguccagccugggcaacaagagcgaaacuccaucucaaaaaaaaagaaguauauauaugaugcuugcuuuagcagcacauauacuaaaauuagaaugauuaaagagauuaaccuggccccugcacaaggaugacaugcaaauuuuguaaaguguuuuauauggaacuuuacuuacaugagguaccuaggguaguaaauucauagauacagaaaguagaaugcugauugccaggggcugagaggaugagggacuguggaguuaguguuuaaagggcacagagguucaauuuggcaauauugaaaauaguucaguggggaagauggauggccgugaugcaucguccaucacauugcacagcaucgugaaauauacuuaauacccugagcguuacacuuaaaaugguuaaaacaguaagauuuauguuauauauauuuaccaugauaggauauauauauguauauucauaucauucgccauugugaauagcaaggagauugaagaaauaaggacacaggaucuucaauaaauauguauuaaaugcuucccauguuccacauucuuugucauugccagacacgucacagguauaagggcccaaucuuuguuacucaaauaauuuagaauaauuuagaauuugcuuggggagacuuuggauaaacaguuaagaagcuguauccauuagguaaagggacauugcuugcugcgucucguagcauuugguagucucguuagacagccguucuuacuccuaucguuugcugaaauuuauuagcaaaggaaagaaucuuaguuuucagcucguucagccgcaugauuucauaggcucaggaaaaccauguaauaugcccaaggucagacgugaugaauaagacuaaagacugaaucuauuccagugucucuguguccagugauacuuacuuacugcuguugccaaguuaaacaaaacuggguuugcagagcuguuuauucaccuucagcaucuuuucauugaaaaugcgguagauagaagaaaugucccucuuuuagcauuuguaccucaguaauaagaugcuucccaagcucaaagacuccacacccuuaaauauguaagucaguguuaagauauuuaaagagaacaugaauaucagcuacauugugcauguugcaggaauuuuauauuauuuuguaucuucugcuuagaagucauaagccagcccaugaaccaugccaacaaacauaccuucuuccaugugauuauugcagccagauuuuucagugcaggacaagcaaaguuuucucugaaagcaugagauaauaauucucagccaggucuucgccauuugcaagggaucagacauaagaguuuuuagcucuguugauguuaauagcuagagccccuguuagcagauggcauguuaguggccuguugcugcuggcuauuaaaucauacacauuggccaggcacggucggucacaccaguaaucccagcacuuugggaggcugaggcgcacagaucacaaggucaggaguuugagagcagccugaccaacauggugaaaccccaucucuacuaaaaauaaaaaacuaggcaggcauggcggcacaugccuauaaucccagcuacucaggaggcugaagcaggagaaucacuugagcccgggaggcgaagguugcagugagccgagaucacgccacugcacuccagccugggcgacagagcgagacuccgucucaaaaauaaauaaauaaaaauauuaaaaguaaaugauacacaucaugagaucaucucccaaggcagcagagaauuuugcguauuuuuuucuuaguuuauauuguugcaacagaguaauucuucuugaucacagacuuugcuuuuuuuguuguuauuguuucuaaguuucacuugauccucaaaauaaccugagacagacaaaacagauagguuuucccauuaaucuccuucaugagucugacuuugccagccaggcugaucuuauauccauagcccuggaugcauuuauuuauguuauuccaucugccuauaaugcccauccccaaucuuggccuauuacaugugucuaacauuacuuugauguguacaugucagugaauuaccacuuaacugauuguuagcuuuuugagaguauguaucaaaucucaugugcauuuguguguccugaaacaaauuauuagguauaaaguauguauugcaaauaccaugcccagggaauauuucagagcugugguucuccaagugugguccuuagucuagcaacaucagcaucgccuggcaucaccugggaacuuguuggaaaagcacauuccaugaucccaccccugaccuccugaaucagcaaagcuagggauggggcugagcaaucuguauuuuaucaagcuguccaggugacauugauaaaugcuaaacuuugcgaauuacugauuuagagacuaaucaacucauuaaaaaguuaauaaauaggugagaauccauuguagcaccccagucaccuaugcuauuaucuucuaaauucacauuauacaaauuguaugccacaaaaauguuuaaggugaaaacccaaaggaauugaugcauuggauuaauucacaaaaauuuaacagcugcaauucauagaaaaaaaaugcaugcauaucugauaauuaguuguagauuaaaaggugaacaacuucuuauuauuaauacccaaugaaaauguaauuuuuuaaaaauuauggccaauugguaguuuuuuaaaaaucuguuaugccuugucaugauaaggauaggugaaaaggaacuuucauaaacuauugcuaaguauaugggugaaaccuuuuagacuauuugggucuaccuaauaaauuaaaauguucagucuuuucuaauuuuagcaccguauuucuacagauacacuggcauaucuguggagaggggcacuucugcuugucaccugauaucccuuacuacuacuaauauuuuuauaagcauuauuaccuuuaaaaucauguuaaaggguaaaugaugugcaacagacucaguuuccccuucucugacuccuguuuaguuuacaucucuuuucucucucucauuugggggcucaauacccuuaagauuauagagaaauugcaguagguaauguuggcuggaaaugcuaacuuguaagaaacuuggguggaaaugguuuaagccaucagccuaaacgaucagugaaaaugucagacauucuccgcuuucuucuuccaagauacuauacucuacuguggccuuagaguucuuaauuccuauauaauucugauuaaaaaggaaggagaugcuccuaauauaccuugcuguuguccccuccuguucauuaggguagcugaugucagucaaaauaaagucuagaaauucuugaguacuuuuuuuuuuuguaauauacugagaaugcuugaagcaaacuaaccaaauuuaaguguuuuaaggauauuaacaguaacaggagagccccucgauuuucugcuaagaaucaaccugaacaguuuccagacugcugguuggcaaugucaguaucaugagaaaaacugaaaaaauaagaaacuuuagagaaaaagaggaaucagugcaggcuaggggaaugaacuugguaauccaguagucuuucccugccagcauuuugauugauaagcuaagugucugcuuuuucucaucccuuauuuuuuggcaggaaaccaguauuuugauacuugaaugccuucuuucuaucuuaagggagaagccuucuuaaacuucaagugugaaguagauccuuuagguauaggaugaaaaauuaagugggacuauuugugaauuacuaaaucgcaaccauuaaagaaacuaaugcccuaauuagccugucuuuugacagacauggcauccauauguaagucuaauauuguaugcaaaugugagacagguuuugcuuucuagaucucuuugaugugaaaggaaaagcuggcuuccuggcuuccuucccauguucuguauggaccugccuucauccugcugccaacagcuccucaagggaacaugaaaguggaauuaaacccuccugguuuucagauucagaauccugggugauuaaguggcuugaucaaaaucagaaacugugaaagugcuaaaaauggucaaggcccaaggaguuccucauguguggucaaaagccuuucagaaaucaaagugugucuuuaaauaccuggggugcaaaaaucagauguuuuuuauuuaaagaaaaauagguauauuagagcagaacugggggcccucuguaggagccugagucuggguguuuacugucgucuaaggccuuguuaaugugggcuugaggcuucggaauccacgaacaggggaagcuagcgucucucgcugacuccaguccuagcucgagcuuuccauacugcccuacgugacuucugcacuuuugugccaucagccaguagacugagaaaaguaucugguauuugucggugucuucgguuuagcugcuuuaaguccuuggauggaaaaggcugauugucauccugaaaucauugucuccuaauguguaauuggggccaagugaagcacaguaauuuagaggaauucuaguuaaaaauacagauucuugggcucuaccucagaccuacagagaucugcauuuuucuuauucccccaggugauccuuuaaacauucagagguuuuuaaaacucaugcuuauaugcaauaacaaaaauauaaggauucuuagaaacuuguuauauuugucuugaacaugggaugacagacauugucauuuucauugaaaaaaaaaaugaagcagagacucagaauguauuuagagacaacucuaaauacauucuggcagagccuaacuacuggauugcagagauccucccugcuucccccaguccccaucuauaaacuggccaugugaauuucuagugguguucacuuccaaaguggugauuuuauaaaauauuacaaugaagcauuauuaaccucaagaaguucagaugcauagagaguuuauuuggguguggcagcauuaguggcuagguuuuauuuauccaagauaagacuucuuauuagcuaugaaaagggauuggcauaaacugcuuauuaauguccauuaacuguaucuaaagggaauaaacaguauaaaaggccaggcaugguggcucacaccuguaauccuagcccuaugggaggcugaggcaggaggaucauuugagcccaggaguuuaagaccagccugggcaacauggggagacccuguuucuacaaaaagucaaaaaaauaauaagcuggguuuagggguacacaccuguaaucccagcuagucaggaggcugugguuggaggaucacuugagcccaggaguuggagguugcagugaggccuggcggcaccacuacacuccaggcugggugacagagggacgaccuuaucucaaaacaaacaaaaacaaaaaacuguauaagcauaagaugggcuugagucacaaaauucugccuuucauaacuuucccccauuugcuguuugauuugcuguuucagaaauugugaaccuacuucucuacuuauagaacauuuaccucccucuuagauucuucccuuucuaucauugauacugacauucugcuuaaagaauuauccauuuaggcucucuucaaauccaaagugauauuauuuuauuuuaauaagagaugaaagggaaaauugacaaaaugugccuggaguugucagcauuguaaaugauggacuguaaaagcuucgucuuggaagauugucagagagccuagugccagcucaaaaaguguggucuuuuuagagaauugacagaaauguuacaaagaaaacaugugcugaauaccaacuccaggugcgaauccugagaagcaacucacucuauucugcaguaggagaugaauuuugcagguuauacagcagagcaauuuaaacucccuuguuucuuaaaguauauccuauagugacuugggauggaagucauauacuauccccuuuuuuguuccuucaaaguaaauacaccacagagcuggagaugucccagacacagggggaagcuguuuggauuuuucccacugccuguaaugaagcaagauagggaggaagaacuugggaacuugcguggcaaauggucaaguaaagaaaaagaaaagcuuuuucuuuacuugaccauuugucacaugugcuuucaaauccugaacugagucacaucugaaauaaaucacuuccuugucauuuccaugaaaggggcaguacaagaaauuccuugcacaucccuggugagccccuuguuacucucagauucagcuauugccuucaggaaaaaaagaaaaagaagccgaagaaagaaagaaaacagaauccucuagaaaaagcuauucugaccugugcucuuucuuuugucugagugugacuagauaaaugcauuagucugcuagggcugccauaacaaaauaccaaaauaccacagacugaauccuucaacaacagaaauuauuuuucucaugcuucuggaggcuggaaguccaagaucaagguaccagcaggucgguuucugaggaggccucucuuccuugauuuacaaauggccaccuacgcaucauguccucacauggucuuucucagagagaaagagaggugucucuuccucuucuucuuuuguuuuguugagacagaguuucgcucuuguugcccaggcuggagugcaauggcacgaucuuggcucacugcaaccuccaccuccuggguucaagcgauucucgugccucagccucccgaguagcugagauuacaggcaugccuggcuaauuuuguauuuuuaguagagacaggguuucuccauguuggucaggcuggucucgaacucucgaccucaggugauccaccugccuugcccucccaaaguucugggauuacaggcgugagccccgcacccggccuccuccuuuucuuauaaggacaccuguccuauuggaucagagucacacccccaugaccucauuuaaccuuaauuaucucuuuaaaggucugaucuccaaaggucccuugaggguuagggcuuugauacaugaauuuucaggggcacacaguucgauccauagcaguuggcuuauucauacuuuggguagauccucuucaucguuccucagcuacugucuauuuagugcacagcuucuuuauccuaaagcuagucaggggaggcauggaagguauuauuucuccuguuucugcaccuaaggcauuaaaacgagguuguggucuggcagccuaaacucggccuugaugaacuucaaauccuagaccuccuugguaugugaagugcauacacuuguauggagggauuugacagguuuuuuuuuuuuuuuuuuuuuugagacagagucucacucuguugcccaggcuggaaugcaguggcacgaucucggcucacuacagccuccgccucccgguuucaaaugauucuccugccucagccuccugaguagcugggauuauaggcgcgcaccaccacacccagcuaauuuuuguauuuuuaguagagacgggguuucaguauguugaucgggcuggucucgaauuccugaccuuguaauccacucgccucggccucgcaaaguguugggauuacaggugugagccaccgcgcccagcccagauuuuuuuaaauuaguuuuuaguguauccacacuguuaaagcagguggauacugcuggauaguauaacaaaguauagugugacaaacccauaaccaagcauuguuagcuauauuuucucaugucuugagccaaaaggucacaguuaaccuaauguugcuacuaaacacucauaccauaaaacauucuauuccagucuuccagauuuuacacaagaauaaaaugaaaacuuuuagacuacuggagauuuuuuuuuaaauacacaauuuguugaaugugaacgcuaaauugaaauugacaugcuaaguuuuauagauuacuucagcugcccugacuucaguaaauuuaguugugacacagguacaacagcugacuucuuucuggcauuagagguggugauguuucgucacucuggaguuaguaaaaccugaaacccgccaggcauuugacacacaguuugcugccagggacagcucagcuucuggcuuauuggagaggaaaugaccuaaccucuguguuuacaaaguguuugaaacugaggcccuuccacuuccuugcugaguguaaggguugaccuggcauccaaaauccccaugaucuucucaggauaagucaugcagccauugguggucaagaaaggauuuguucccuguggaagggcauuggaagaggaacagagcugaaacacacggguguucagagggaaaacaucucugcacuuaagagggcuagauuagacuauuagacuauuaucauagagcucgugauucaucuccuuuguuuaauuccagccuugaguaaaggacucacuaagaaaccacauucggccggguguuguggcucacgccuguaaucccaacacuuugggagaccgaggcagauggaucacaaggucaggaguucaagaccagccuggccaauauggugaaaccccgucucaacuaaaaauacaaaaauuagucggggaugguugcgggcgccuguagucucagcuacucgggaggcugaggcaggagaauugcuugaaccugggaggaagagguuacagugagccgagaucacgcuacugcauuccagccuggugacuggagcgagacuccaucucaaaaaaaaagaaaccacauucuauuccaguauauuuauuauaaccagaaauucuugucuuaucagcaaauagcuaauauucacuuacaugggcaguguauuagauuccuagggcugcuggaaccaguuaccacaaaccgcauggccgaaaccaacagaaauauacucucauuaucucauuauucuagagguuagaaguccuaaagcaagguguugccagggccacacugccucuuacagcucuaggggagaaucuguuucaugccuuucgcuugcucuagugcugcugccagcccuugauauuccuuugguugguacaugcaccccuccaaucuccaccucugucuucacaugguguuacuccccaugucucuguuucugugucuucucuaauaugauuaagggcccacccuucuccauugugaccucaaucuuauaucugcaaagacccuguuuccaaguaaggcuguauucuuagguguaggcauuaggacuucaacauauauuuugggggaaaauucaacccauaaugcgguuauguuuuuauuuuccuugacuuuuaagaaugugaacuauugucaaauuuuuucaaccacuaucaaauuuaaaucuaagaacuacaugucuuaaauuuaugaccucuucauuaaaaaaaaaauaauaacauuuaauugguaccaaaacgugaaagaguuuaaugcuuugcauuugcuugaggcugauuaaugaguaaaugugucaacuguggcuguuuuaauuagccaggguuaauuaauguuuaccacacuuggaagaugaaaaggcauguauaaaugcucuauaaugugaaucauuuuuuaauuuguuguugaagcuuauaguguagccaaguaaggauugcuuacaucauacuuacaaagggagguucauuaauggauacaaauacacaguuugauagaagaagcaagaccuaguauuuaauuaucagcaaggugacuaauuuacaguaaucuacuguauauuuaaaaauagcuaggagaaccuaauuugaaaguuucuagcguaaagaagacaggcugggcacgauggcuuacaccuauagucccagcacuugggaaggccgaggugggaaaaucacuugaccccagcaauucaagacuagccagggcaucauagugagaccccaucucuacaaaacaaauauuuaaaaauuagccaggugugauggugcaugccuguagacccagcugcucuggaggcugaggugagaagaucacuugagcccagcaguucaagguucaagugagcuaugaucacaucacugcacuccagccugagugacagagagagacccuuccucaaagcaaaaagaaaagaaaaacauuuaagugauggauaucccauuauacugauuugaucuuuccaaauuauaugaauauauuaaguuuucucauauaaucugaaaauaugcacaucuauuauguaucaauaaaaaauaaaauuuuaaaaauguaaaaaacgauguuggagcacuaugguacuuaacguagaggcucugacuuuugagguacauucauuaccuguuacugaaguugaguaugcuuuaauauuguauguuuagaaaagguaguuacauuuuuaaaucugauuguguaagaagaaaagaguagaaauguuuggggccaagucaauaauuauuuaguauaucauaauuugagaugaaauguguuuuuuuuuuucuuuuuuaguuucaaguugaaacauuuuaagaacagauaaggaaaggcuaacugugcugagaugaaaauaacauuuuuaaaguaacuaucuuaaagaaaauacauuucuagaauuuuguguaaauuuucaacaaagacucagaagccuggaugaggucuugugccaagacuggaaaguguggggauuagaaaaaguuugaagagauuguugugagauccucucguaugaggccugaagcuguacauccauggaaagcaguuaccccaggcgggaaaacagguuauccauucucgagugaguggccgggugggaaauaguccaucaugucgaauggaucguacuuuccagcaccaagauuugugguucucuaggugaauaagaugacaccccuucacuucacuucacuucaccauugucugcauggaguacguaucuaaaaacaaauuagcaaaaagguugggucuacuuuacuuuucaucuccuacacuauuuucuucuuuguucucggcaggaaaagaugaaguugcauuuuauuauuaucucauaggauucuuauucuaaaaugauuugauuuaaaacccauugcacuuuauuuggauaaaaaaugcuucacucucuaguucuuaacaauaacaccagccugauuuuauuacguuaagcacugcaauuagacaauacaaagaauuugcagcaacaacauguuauuuuaucauggguggaacuguucauugucuagcagaauuuauuaccagauaaaucccuuuuggggaaucuaauguggauguuuuuuucaaagcgccuguggaguucugcuaguauugggaacguuuccauuuucauucugaugcuucccugugggcuguuucagcauagaagugagcucucuggguccauguuuccauuggcuccacccaauauucugaaagauugcaacucaacauguguaaacagaaccuuucucccccauauuuucucuuuucguagauuaaacucaggucaagaauuagaaguuuauccuccaccccgauagcaucucgcccuaucccaaauaccgccaccaaaaugcccacuguuuuuccuugggccaguuccugaaauaucuuucuggcuguaucacucuugugugcauccuuaucggcuaugcuuuuggccauuuuuuacugcugacuuugucugguuagucuuuuauaaucuccaggcuucuccuccauccuuuuuuuacaguuuaccuguucaugaagcgcaggucacuugacccguagaauucccauaggcugggauuuugcuaauugcauacucaugguauaggucaguguauuccucugcccucuguaucccacaaacugaaagccucuuggcuaagcugcuucccuuuucacuucccuuguaccacagcagccagaagagucacagauccugggcagcuuguccucugugccucgguacaugcacuuguaucugcuaggacaaugaucucuuucccuggggccccacuguaauaucacuagucacaucccuaaagcccaggcuuguuucuuugucauucugucgguaucccuaccauaacacuuguaauaguaauuauuuuuaugcccaucuuuucuucugaaccaugagcccuucaagugaaaagaaauugaugaaguuauuucuagcacuccccuggaaaaaggaaggcaggcagggagggaggggcucacuaguuuaugauaaagugguuugauuuucuugguugcagauuauuucuuuuaaagugacucuuuucagcuucucucacuccugugcaucgugaaugcucuccugaagacagacgcuuuccauucauuuccaagccccccaugugaagugcuuucuguugccaggcuugguuuccccacacguuguuaaagaaguuaaagaagcuugugaauaagcuaaagcagaggagaaagaaccauugcuauaucuagaauuguucaccagaaagcaaguuuuguguuaaagaaaacacgaguaggccacugugcagaagugcuuacaggguuugugugcuuuuuaaaaucugcauaaauaaacauuucaaaugagcuaucauauauacaaggaugaugugcugucugugggaaaaggacccaauccuguguugugauuuuacauauauauauauauauaauuugugcuauuacacacuugccugauccccuuauaauuaucugcauaagucuuuuuaggcucuuugaaugaaauucacuauguauggauguugaaaaucauccuuucuaccaugagcucaucagacuugcuaaccaauucuuugcauccuuugaaguauaaaauuccaucaauucagcauguaucaacaugaaucaauuagaaugcacuuucuucacagcauggcggaguuuuugcuggcugccgggagcggcacuguuucccaauucauucauuugcuugggcccgccccaggauccuucuuaucccggucagauagacuucucucaugagcuugagagacggggcuggucacacaggacacggcuuuagggacacgacucacugaaacuacaaaaugagugcugcucuuagaguuguacccacagccugcacagcuguuauggcaaugcugugggcaagucuugcuacggcccauucuccucccucccuuguccuguuggaagguucagguuggagcugaaauucaguccagcacgcagcuggacaagccaugucuccuguaugugacucacuccccagagaaagcaucauguggacuaguaagggcuuggcuuuaucagaagcaaaggagagguuuacaucucuucuugcucucucuuaguggguucagagcuccagcagaaaaaaugggacacuguggauugaucuccagaaaaccccaaaaccagcacugaaggcuccaggagauuaugccuuuagauuguauacaggcaccagaaugacuuuugccuuuauaaaaaugcgugcaagagcaugaaaacuaauauuugaggaauuuuuuuuucucacuguacuuucugguccucacugaaagcauuggcaguuuuaaaaaaugaaaugugauacuguuauagacguagcaaaccucacguuucauuuuuuccaauucauucuauaucuaggaacuuacuuagaaggagaaacaaacuguacccagaaaaaggaaugaaacuggagaauucuuccucaugauuccucuguguccucaggccuaauuauccucauuccaaagacucuccauugccucaauaacuucgaaaaauuuacucuccuuaagcauagucauaaaaauugcauaguaaagugauaaagagacgaaaauaaugcuguaagaauaaaaccauuaaaaaaaaaccacuacucuugauuauuucugcuguuagaauuguaaaugaauucucauuccuuuuuucuacauuuuuggcaugaaauuuauguuacucuuauaauuaguaaaaacauuauauuuuauuaauaaaagaagacucacagugaagucauaacauaugcugcagagguuagacucuucaagucagauuugaagagagaauuucacguaacaaucaccuugaaaugucuucaggucagccaucaaaguacacaucucucaaccagccaggcagccaguuuuuccuccagcaugugaagagugaagagauagcuguuucuuggcuuaaagaccauaugaaauaauugacuuauguuuaaaagauaugagggaucaggccgggugcaguggcucaugccuguaaucccagcacuuugggaggccgaggcggguggaucacaagguuagaagaucgagaccaucccggccaacauggugaaacccugucucuacuaaaaauacaaaaacuagccgggcguagugaugcgcgccuguaaucccagcuacucaggaggccgagguugccaugagccgagauuacgccucugcaguccaaccuggugacagagcaagacucugucuccaguuaaaaaaaaaaaaaaggcaucaaaauuacauucacuucuauuuuuauuuuuguuuguagaagacaugcaguuuguaucacauuaaugggcauaugauguaauuucacuauaaaucgaaccagaggaagacauccaaauauguauaaauuaaagcugacaaugccuacaguacuaaacuuuuuguuuuaguauaauuggagacuuagaaaaguucuaaaaauauauuuaaaaauuuuuaaaggaaguugcagacauaauggcccuuuacaccuaaauacuucacuguacguuuccucaaaacaagaagauauguguguguguguuuguguguguguguuguaaucuuaauacagcaucuuucagagauuauuucuguaguauauaaacuugguuuuuuuguuuguuuguuuguuuguuuguuuguuuugagauggagucucgcucugucgcccaggcuggagugcaguggcacaaucuuggcucgcugcaagcuccgccucccagguucacaccauucuccugccucagccuccugaguagcugggacuacaggcgccugcaccaugcccggcuaauuuuuguauuuuuaguagagacgcgauuucaccucguuagccaggauggugucgaucuccugaccucgugaaccgcccaccucagccucccaaaaugcugggauuacaggcgugagccaccgcgccuggccauaaaguuguuuuuuagucucuacuuuaaguuccugacaacccaggcaggaccaagacucccuaauguaguuggaaaucagaucagcacauuggcacaaguucuacagguaaacgggaaaaaggagcccuacaaucugcuuuuagaugccagggagccuggcuggucuuuaucuugauuacugacugaugccacugguaggucuaaguucuuugaucuaugauguuugaaagccaaaaggaaauguguuuuaaaggaaaagggacuucuucuguacccucagucuaagccagacaagugauauuucaggaaaaugucccuagcaauaaggaauauuuucacaaaugaugugaagcuuuguuugugucccuuccagggcaguuuguuaccauaaggggacaaagcaugcuucauuuaaacauguguggccaggaaacuguuauuuuuaaacaaaaauaaaccccgauuuagacauguagucugaguuuuaacucugggagauuuucaagauugauaguguagcuaaaaauaacugaccuaauuuucuggaggucaagauaaaaacuggauuuaugguacagcauuuacuuugugauaauauguguauaaauucuuccccaaguuggaaaauguggccgcgucauacagggcuguaucucucuugaccauugaagugccuaggucgcuacacuacaauuugacuuagaguuggugaaacuucuggccauucacguagccaucguauucauccugagaaagggaaaccuaaagacuugggagaguguucugggaggaaagugcuauugagaaugggcuguccaagcaaagugacaggcaggccucacuuagcuagaagagggagcuuuucagcccugcuccaccaucaggaaucuccgugaccuuggacuacugcuuuaaucucuuuuauccuggcuucuaaaagauaccgucgaauucauucuuuuucaaaccuaucaaaaauuugaaauguaugaaaaagagggugcuugugaugauagauggguuuaugcuuccuuuuuuuuuuuuuuuuuuuuuuuuuugagacggagucucacucuguugcccagacuggagugcaguggcgcgaucucggcucacugcaagcuccgccuccgggguucacaccauucuccugccucagccucccgaguagcugggacuacagugccaccaccacaucuggcuaauuuuuuuuguauuuucaguaaagaugggguuucaccauguuagccaggaugcucucgaucuccugaccucaugauuccaaagugcugggauuacaggcgugauaugcuucuuuaauauuaguuucuaauccaaguaauauagccauguccucuauaaaauggaacuuuucauggaacagugagaagguugcauuaggaauugggauacuuggguucagauuucaguucugccacuugcuaguuuuaaguauacuucucaggauggaugucaguuuguucaacugucagugggaguagugaucccacuaaggaagauuauugugguuaucaaaucagcagauggguaugaaaaggccaugagugcaguucucaugguuaugaaggugucauaacuggcauagucccaucacaguauggcuuuggcaucgcagauggcuguagcauauaugcuaaucagaacaucccuaccguccuuaaagaucucauggguucucucccaaaucagcugcuccaccgaccuacaaguaaguccaugcuucuuuaguauauuuacucacuagugaaggcccgucugcuaaaagugucuucaguaggggagagcugcucuuuucugggaaacccagcaaugaaguuuguccugugaugcccucuacacuuacugaccuguuuccugagaacuucccguaacaaaugguccagggaagaaggaagucugugaccagucuuuccuuuccuguggcuuucugguucagaaaugugacccugaugauaagaaacuucaaggcaugacucugguguuuuggcaauauuccccuggcaguauuguuucuuggcucacacucaucucaugccuugcuuuguuugcuuuguuuuugagaauuguuuuuuuguuuguuguuuguuuuugguuuuggcuugugagacagagccuugcucuguugcccaggauggcgugcaguuggcacaaucucggcucacugcagccuccaccucccggguucaagcaauucuccugccucagccuccugaauaauggggauuacaggcacacaccaccgugccuggcuaauuuuuguauuuuuuuaguagagacggguuucaccauguuggccaggcuggucuugaacuccugaccucaagugaaccacccaccucggccucccaaagugcugggguuacaggcgugagccaccacgcccagccauuauguuuguuuuucuuucaugaagggauaaccgaggcuguugugugguggugucuugguacagcucguggcuguggucagugugguggaggguaggucuucucagaugguaacaugcaugagagucaccuggggaucacauuaacaugcagauucugauucccuggaucugggugggaccugagguucugcaugucuaacaaacucccagagaacacccauguagcaagaguacagacaaaaggauucaaagcgaagggacugcaagaaccauggaaccagccucccacgauuuugcggaugacgaacccgagccuuggggaguuucagaggccauggagagaugaaguauaauaaacagcauagcaguuguauguugagccaagaaucagacaugcacagaacugcugauuggaaaauuaaaucuguuucucauagcccugguguggcaaaaugccuagcuggaagugggugaccgcuugauuuacagugggccuccuggguagggaaaauuaguccaucccauuuacagcuacuuccaaugcagcugugucaggggagagagaagaaaggacauggaagagagcguagagguaugaucuucaguccuuucaggcaggcacauaaguaaauuuuuauuuaaaagauaagaauuggucauaugcgaaucuccuguuagauaagauuaaaaacaaauuuccauuuuguggagaaguugcagauaaauauuuuuccaugggauccaaaagaaucaaaaaggaaagaaaauaguaauagcaguggagguucgauccuagacagaagaaaauccagcaagccgagggacuucauauucucacugguguccaaaucagagcuuuuuuuuuuuuucuuuguuuacuuuaaguucugggauacaugugcugagcaugcagguuuguuacauagguauacaugugccuuggugguuugcugcacccaucaacccgucaucuagguuuuaacuccgcaugcauuagguauuuguccuaaugcucucccuccccuuucaccccaccccuggacaggcccugguguaugaugucccccucccuguguccauguguucucauuguucagcucccacuuaugagugagaacaugaguguuuggguuucugguccuauguuaguuugcugaggaugauggccuccagcuucauccauggcccugcaaaggacaugaacucaaccuuuuuuuuuuuccuuuuuuuuuuuuuuuuguauuugcaaauucaaaucuuuuuuuuuuuuuauuauacuuuaaguuuuaggguacaugugacauugugcagcuuaguuacauauguauacaugugccaugcuggcgcugcacccacuaacucgucaucuagcauuagguauaucucccaaugcuaucccuccccccuccccccaccccaccacaguccccagagugugauauuccccuuccuguguccaugugaucuccauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaauugcgacacugacuuccacaaugguugaacuaguuuacagucccaccaacaguguaaaaguguuccuauuucuccacauccucuccagcaccuguuguuuccugacuuuuuaaugaucgccauucuaacuggugugagaugauaucucauagugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuuguccauuuuggcuuuuguugccauugcuuuugguguuuuggacgugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuucgguuacuguagccuuguaguauaguuugaagucagguagugugaugccuccagcuucguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcaguugguuuguaguucuccuuuaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcguaucagcuuaaggagauuuugggcugagacaaugggguuuucuagauaaacaaucaugucgucugcaaacagggacaauuugacuuccucuuuuccuaauugaauaccuuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuaccuuuauugauuugcguauauugaaccaagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaaccaucugguccuggacucuuuuugguugguaaacuauugauuauugccacaauuucagcuccuguuauuggucuauucagagauucaacuucuuccugguuuagucuugggagaguguaugugucgaggaauguauccauuucuucuagauuuucuaguuuauuuguguagagguuuuuguaguauucucugaugguaguuuguauuucugugggaucgguggugauauccccuuuaucauuuuuuaucgugucuauuugauucuccucuuuuucuuuauuagucuugcuagcggucuaucaauuuuguugauccuuucaaaaaaccagcuccuggauucauugauuuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauuauuaauccugaguucuaguuugauugcacuguggucggagagauaguuuguuauaauuucuguucuuuuacauuugcugaggagaguuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauguuuaggauaguuagcuccucuuguugaauugaucccuuuaccauuauguaauggccuucuuugucucuuuugaucuuuguugguuuaacgucuguuuuaucagagacuaggauugcaaccccugccuuuuuuuguuuuccauuugcuugguagaucuuccuccauccuuuuauuuugagccugugugugucucugcacaugagauggguuuccugaauacagcacacugaugggucuugacucuuuauccaacuugccagucugugucuuuuaauugcagaauuuaguccauuuacauuuaaaguuaauacuguuaugugugaauuugauccugucauuaugauguuagcuggugauuuugcucauuaguugaugcaguuucuuccuagucuugauggucuuuacauuuuggcaugauuuugcagcggcugguaccgguuguuccuuugcauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuacgugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccgcaucacuuucagguacaccaaucagacguagauuuggucuuuucacauagucccauauuucuuggaggcuuugcucauuucuuuuuauucguuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguucuuuggaggaggagaggcacucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcugggggugccucccaguuaggcugcucgggggucaggggucagggaccacuugaggaggcagucugccguucucagaucuccagcugcgugcugggagaaccacugcucucuucaaagcugucagacagggacauuuaagucugcagagguuacugcugucuuuuuguuugucugugcccugcccccagagguggagccuacagaggcaagcaggccuccuugagcuguggugggcuccacccaguucgagcuucccggcugcuuuguuuaccuaagcaagccugggcaauggcgggcuccccucccccagccucgcugccgccuugcaguuugaucucagacugcugugcuagcaaucagcgcgauuccgugggcguaggacccuccgagccaggugugggauauagucucguggugcgccguuucuuaagccggucugaaaagcgcaauauucgggugggagugacccgauuuuccaggugcgucugucaccccuuucuuugacucagaaagggaacucccugaccccuugcgcuucccaggugaggcaaugccucgcccugcuucggcucgcgcacggugcacgcacccacuggccugcgcccacugucuggcacucccuagugagaugaacccgguaucucagauggaaaugcggaaaucacccgucuucugcgucgcucacgcugggagcuguagaccggagcuguuccuauucggccaucuuggcucccaccucccgaacucauccuuuuuuauggcugcauaguauuccaugguguauaugugccacauuuucuuuauccagucuaucguugauggacauuuugguugguuccaagucuuugcuauuguaaauagugcuacaguaaacauaugugugcaugugucuuuacaguagaaugauuuauaauccuuuggguauauucccaguaaugggauugcugggucaaaugguauuucuaguucuauauccuugcagaaucuccucacugucuuccacaacgguugaacuaacacucucaccaacaguguaaaagcgugccuauuucuccgcauccucgccagcaucuguuguugccagacuuuuuaaugaucaccaucccaacuggugugagaugguaucucauugugguuuugauuugcauuucucuaaugaccagugaugaugagcuuuuuuuuuuuuuuucauauguuuguuggccacauacaugucuuguuuugagaagugucuguucauauccuuugcccacuuuuugaugggguuguuuuucuuuuuuuucugguaaauuuguuuaaguuccuuguagauucuggauauuagaccuuugucagauggauagauucagaucagagcuuuaacagccagacuuuacagggaaaaggcugaguggcaccuccuuuauaugaagaaaauguucuucuccaacccacuuguguucaguggauggaagaagcuguucaguaauuauaacugacacuuguaacacauaacugauugauuuaaugcccauaaauuuuauuuucuuuaaucguaagaugugaccguuaaauucuuagaagacauuuggcuaguggauuaauaauuaaaagaauauuggaugaauucaucugcuuccuauucagcaguucuuuuauuuauaaggcuauuuuucucaaaaugaaugaucaugaauaucuaagaaaaaacaaaauauuuagcuguuugaagaugaaauuauuaucuuuugauguuguuuucuuuaaaguguuuacaaugauaacuaagugguagggcuucuucccucuguuacucuaaguaugccucguauacauccucaaagcauuuuuuuuuuuuuuuuuuuuggagacagagucuuacucgguugccuaggcuggagugcaguggcaugaucucagcucacugcaaccucugucucccagguuuaagcaauucucccgccuuagccucccaaguaggugggauuacaggcguccgccaccaugcacggcuaauuuuuguauuuuuaguagagacgggguuucaccaaguuagccaggcugcucuugaacuccugaccucgugauccacccaccucggccucccaaagugcuagauuacagacgugagccaccacgccuggccaccucgaagcauuuguaaaagagcaaggugaugggguucauuagguguuugguauuugaaauuaaauaccucuguuauugaugaagccauauuuuaaauauuaucaccacuaaacucaguuaaauauuuccacuguuaacuacaagguucaaaugcuuggauauuauagaagauauuugacuucaaagauaaacgcuacaauuuugggucauaacaaauagcuuuuagaaggggaaaaaauaagucuugggaggaaaauaagcagucucuuaguuuaauauagcgguuggcaaauauagaugcuuaaaaguucugaaaauccccauugcaggccaucagaguguuguaauuaaguauuaaauuaauucagauaaaaggauaauccaucagggccacuaauguaguggaagugugguuucggugugauuagucucaccauggaagucaaagaaagucccacucagaaugaacaaugaaagaaucauauuugucucuggguauuuugucauaggcucaauugcccagugccaguguguaagccacugguaaaauccugagcccuuagucaugucuacagguagcuggcugccuuagacauuuuaugaugacgaaauugaauuccacuucugauaaugguaauccaucaugucuaccucuuuuuuucucuuaaaacuacacugacggccaggcgcaguggcucccgccucaucccagcacuuugggaggccaaggcaggcagaucgccugaggucaggaguuugagaccagccuggccaacauggagaaacucugucucuacuaaaaacauaaaaacuauccggucaugguagugugugccuguaaucacaguacucgggacugaggcaggagaaucgcuugaacccaggaggcagagguucguuguucugaaugacauagccaggggugguuauuucuaaauuuucuguguugaauuaagauaggaauguggauuucuuccuauuuugaacaacgaccaaaaaaaaaaaacgaaggcuaaguguguuucacucugcuaaaaauguaccuuuucuugaaucugucacuuuuucacuuacauuuucugaaaaugaauauaauuaaccaccauggggcucagcaugcugguggccauuuggaggaacuuuucuaccaacaguguaacagagaaaagagaaaaggguacuacagcguaccucaaccuccccugacuguucugugaaguacaaguguaagauuucucacugugaucuuuugcuccucugccuuuuuacugccaagggcuaagaugggcacagggcccuuuccagcugccccugccugagaaaugcuuauuugaugaccaaaagcaauaaccauuccauaggacuaacggugauuaagucagcuuacaaauccacaaggguggaagagacugcuaaagauauuggaacagacaugcuuaauaaugccuaauuucuacagcuacuuuugugauaauacgagaggcugaaauagauaggggcugaacaugggaaggcugguguuaugaagcccaggacuuggauuucagcacuggugcuuacuggccauugggucuugaagagauugguuccuuucucccagccucagucuccuugucccaucagauuaauaaugccugccuugggagaggagagucauacaggagagggcauuugagcugggcucuaaagaguucaaauaacguagaugagcagagaugggcuuccaagauagcaggaauagaaaacaaaagugucagaauggguaugcauggucuuuugugggaauaccccaagcuauuuagccugagagagaggugugguguagacagcuggagcugugaguuccauggcuagaaauacggggugggcccagaccacagagggccuucagcaucuggcaaaggaguuggaauuaauucgguagaaaaugaagacccacugaaacaaagagggagccauucuugugugucaggaacuaagauuucaggaaccaaacguaaaauaaaaaccagcagggagaccauugucucagucgguuugugcuguuaucaugauaccagagacuggguaauuuauaaacaaacaauagaaauacuacaauucuggaggcugagaagcccaggaucaagccgggugcaguggcucacgccuguaaucccagcacuuugggaagccgaggcgggcggaucacgaagucaggagauggagaccauccuggcuaacacggugaaaccccgucucuacuaaaacuacaaaaaauuagccgggcgugguggcgggcgccuguagucccagcuacucgggaggcugaggcaggagaauggcgucaacccgggaggcggagcuugcagugagccgagauugcgccacugcacuccagccugggcgacagagcaagacuccgucucaaaaaaaaaaaaaaaaaaaaaaggcgccuuguggcugcauccuccagaggcagcaaaaacuguucucacauggcagaugcacauaaaggggccugugcugguuuccucuagcccuuuuagaaggcaguaguccauucgggggcacgggguggaacugucaugacuugauuuccagaagaccccaucucucacuacuaccacaguggagauuuaaguuucaacacaugacuuugggggacauucagaccauagcaagcagugaggagacuaucguaauuauccaggcgaaaaguaaucauauuccuaggggcggugagggugguguggaaaagcaagcaggaaauggcugagagaauucagaaauagaaugcaaaaggauuugucgguagugugaguacuggacacgaagaaauacagggaguccuggauggcucugaaggauucaagccugugacugggagggagaaugguucugccaugauuagaaaacaggaaagguggaagggaaagccagggaccuugaguacaguuguguaccuaccaagugcauggaucaggagggagcccuaaguugguaucuccagcaaacuguuggaaauauacaaauuugagugggagggagaagucaaagcuggggaaguacauuucagauucacccaaagguaggagaucuuuagaguuucaagagucgaugggauuuccaaaggggagaauuguagaaagagauggaaagagauacaagaagaaaaugacagggaugaagagaggagaaaaaaagaguaaaaagaguuauucagagaugucacagggaagaagauaaguacuguguaugcgaaacagugagaacauuuccaaauaaaggacaugguaagugauaguagauaccacagacccaagaacagcguagccccuggggaguucaagagcuuucucgcuggcaaagguuauuuccugucaagaugaauguguaugcaccaauaauuauuaguauuccagaauauccucucuuuagcauaguaagugcuuaacagucacaagcaaaagauuuauauaaaagaaaugcucauuuaauuuauuuaaucagacauuggcuaaguuauuagccgcuaccuauggcuuuguaaaacaugaaaaaguuggaggaaaucuaaugagggucuuuuaucuguaagggaaaggucaucaugggcaucaaguauugaauuuuagaaacggugccacagugaauagggauauauuauaacucagauuagacuucaaaaggacuaauuugcuugggacuuccaucauuuaaaaucacuugcaauaaaacugacuacaugaaaagauauuaaucacaagcuuuaaugcuauuccaucaaauuauuuuaauggguauauuugaacagaauuuuaauuuuucagauacauuuuuugucaauagaaaagagaauuugaaagaugauuguaaaauguuacaaaucaaauuuaaauccugaucuuauuuucauuuucucuagcaauaaaacuaaccagugaugugucugaaauauauacuacagcaaacucuugacacagcuaugauuggaaaaugagacauuuugguuaaucaaauauuauuguuaauagugcagugcugucugucggucucuaauuuguaaaaaucagagaaaaacauggugaaucuuuggugacauaagagaagacucacaaaucuucauauccuggggucaguuuuuaaagcaguaauuacacaugauacaagauuauauucuaagcucucuuuuuccaguaagaaaagauaagucaaugauguuccauaaagcugauucuuguuuaaucaauuuuuaaaguggggggguaggcggcacugacagcauucuuuggaaagggaagcaacagaggagaaaggcaggauauuuggugucugcucacauugggaaauacggggagccaggggugguuaaguccagagaaggcuggaugucugucugcagggcuacaucuggaagggcaagggaacaguuuccuuguugccucagagcauaggucaugcagcacaagaggagcauuuaggaaaugcagauuuuuuuucaaggcaagacagugaaaacuauucaagaagguagcaaacuacuggcccuuuaaugcuuuucuuauccuugcaagugugcaaggcaagacaggagauugucuguugucuuucagcuugaaugagauugugccucacuuacugccgccacaccaaagccuggcguuuauuccugugcgaucauuguauacuagggacgucuaacugugucaggaggaaauggcagcugagccccuguggccuuucaccucuagcagugccacgcugcagcacauuggccggcugccaugcuccugccugcaguccugccagcagcucuugugagcugcgacuuugcauaaguagcuugaaugccaugugccucaguuuucacaucuguaaaagggagaugauaaugguaccuaugucauggcucuaaacgcgaucaugcacgugaaagcaguugaagucuugccuggcagaaguaaaugguggcugcugcugcugcugcuguugugauuguuguuacucaccaaagagaugguuuuguuugguuuagaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaagguaagaguccccugagccagcaagggcguucugggagguauauauacacauacauaacgugugugcaagagagagaguuaucuuuuguauguucuugaguggugaauuuuuuuugauguagucauaaauauuuucauuauaauuuuacuuuaaaaaguaaauacuaggaguuacuaugucauuaaaauaauauaucuguguaaauuauucuuuauauuuuuuaugcugcaaagcauguaaacugccaauuguuggaaaagacaacaacuccauuguauagguggcaaaacaaaaugguaaugauuuacauaacauuugcagguaaagggccucuuguuucgcacauguccagguuugcauucuagggaauauuauccuucgagugaacacucccggacgaaggggagccacaguguauuauugaagaggcaguucuucacaaggaaaauguguggcaauaacauucuucuaauuuuuauuuuccaguuccucuucuuaauauaaaaugguacauuauauaacaaaaguggauacauaaagagcauguacuguauaucauauuauuauguuuaugacuuuuucaaaugaggaaauggaggcaccaggagacuaaguucuuaagugaugacuuuugguaggaauuuuuuagaaauguuuuuuaacugugagguauauuguucccucuggaauggaagcacaaaauucaacuuguguuuaugacguaaugaccuagaaugccaccuuccaaaaaagcagauagauagugaaauaaggaaaaauuacaguuuaccaacagagaggaguuuugagggccugcagagaugcagauuugacaggcaccaaaguagucuucacuggcuacuuauucuuacaugaaauuucagauugaauuaaauguuaaaggcaaagauagagaacuacauauaaauaaaauuuaauuuugcuuaagacuuaauuuguguuuagaaaauuaaauuuaaggcagcugccaaaauuaaggagcacauugcucuaaauguuuuuuccuuugguaccucagagaaguaagauucuucucuaucaacaaauuugagcaguagauggcauccuuuuucacagggauuucuuagcagaaacaccuguucaggcaagaauaucuuucagcuucuuuuaucuuuuucuacauguucagaaguauacaauuacacacaaacaccuugauuucuagauacaaauaacauguuuuuuaagaacacaacagcacuuuaccugauuuucuuuaucaaagcagcaaauguugauggagauuucauauuuauaauauaccuuauaggccaggcaucgugggucacgccuguaaucgcaggacuuagggaggcugaggugggcagaucgcaaggucaggagaucgagaccauccuggcuaacauggugaaaccccgucuguacuaaaaauacaaaaaaaaguuagccgggcgugguggcgggcaccuguagucccagcuacucgggaggcugaggcaggagaauggcaugaacccgggaggcggacguggccagugagcugagaucacaccacugcacuccagccugggugacagagcgagacuuuaaauuuaaaaaaaauaaauaaauaaaguaaaaaauauauauaccuuauaacaugcaauuaguacuaaaucuaaauauaauauuagaccuuaaguguacuggacaaguuuuuucuaaagaaccauugcagaaaauauauagacuauuuucacaaugugaaucaucaccccaaauuuguuuccuuaauuugaaaaagggcaccuuacaguaauagcaaacagcauguuacugacaauguaaaaauaauuaaaacuuuaccauuuaugaaaauaauucuuaaucacauagaagaaaacaauuuuagggacaguucauuaucaaagaccuggaaaacuguccuguuaaauguauugagugcagauuguuuuguuucuuuacagguagauagauuuuggucauugaagguccucuucauucagucucuaaugagaauuuuuagugaaaaauguccgaucucauuuuguaaauugaaugcacgcuaaauuugcucuuuuacuaacagcauaccuuguugcaucagccuuaggagaaaaucugcgugcacacgugugaauguacacacacacacauacacugugaacccuugguaauugccaggauguccauuugagcaaagcccuugauuaaguacuucuggauacuugacaaacacgcagcuauuacauugccuaggucucaugaaaagagcugauauucuuguuggaugauucuguuugaacaguagaaucugguauaacaauuuugggaggcaauagaacuugcagugucagagucuugaguugcaguacucuucauuaucagucccaacauugacauauauauauugauuauagcaaacaauuuaaaaagccacuuaagcaauuuuuuuuuuuuuuuuuuuuuuugagacggagucucgcucugucgcccaggcuggcuggagugcaguggcgcgaucucagcucacugcaaacucugccucccagguucaugccauuuucuugcuucagccucccgaguagcugggacuauagguacccgccaccacgcccggcuaauuuuuuguauuuuuacuagagauaggguuucaccguguuagccaggauggucucgaucuccugaccucgugauccgcccgccucagccucccaaagugcugggauuacaggcaugagccacggcgcccggccccaauugguuuuuaaauaaaauagacggccaucaucucauaggauauuaaauacuaccccauaccccugaacuccugaaugauacagacccgaguuuaaauuccagcccugcuaugugcuucugagcaaguuacuuagccucucuggcugcuuccucgucuguaaaauaagguugacaauaauuccuaacucagagguauaguaugagcauuaaauaagaaggcauaaaaaagcucuuagcaaaauuccuggaacguaguaaaugucagugguagcuuuuuuuuuuuuuaauggagccaggaucuuauuagagagacuuuaucagccugucucaagaugaaucaccuuauggccucaacaauguauccuuaaaauaaugaauauaauaagccauauaaugagauacaguccuaaagccgucucucuucuaacaccgucucccaccucuccccagaaacuuguuagucuuucuuuguacagacaugugcacacacacacacauacacccaacuacugaaaauaucuaaaauucucaaaggauuuccuuuuguucuucaugcaguccucauuaucauaguuucaaaugcuuaccaaaaauuuguuguuuuucuuaagaacaaucagugaaauccagaggagguucugaugcccauuuuuuaaauuuacauugaagaaaauaagcauaucagaguuuuccaaugugcugugauuugccuuaacaauuuuuuauucuuugguuuucacauccacaaaaccuaaaugaauggcuaggcugaaaugaagcuguuguuacagaauugugcucacagaucgugaaaugaucuggcuggaagcauuagcguugaugacauuuguguuuguucuacuuuuuccugacugccugagaagggcagccacaaagagcagcauagcaugcagugacugccagcaagucuuuguggccaacagucugccucuuuguagauaauaccuagauauaauauguagauaaaauaauauuuuuaaagagacaaagcaggucuuauaagacuuguauggauguauuugcaaaaugugaagcugccuucuaguauauuuuuaacuagcuuuauagaggcaaugaggaagccaauuuaaauguugaaauuuagauuaaauaaauauuucauuaaacuuacaaaccaguucuugucagccucuuaucuauauguaaaacugguguacugcugauuccucauuaccuuuggccugguagagaguuuguacaaggcagcacgguuaauaguugagguuuauuacaaagaauaccagaaguaacagacucaaaaaucccagaggucugaccauucuguuucucuccucuuacagcaaaggauuugauucaaagcuacugagagcaagagaauaacucauuucugcuuacauuuuauuuuaacucuauuaaaaguuaaagcuaagauaauguauuucuuguuuuuaaauuacuaaacagccaauguaagauguuuuuuagcacuucauugaugaaguuacugucugguuaaguaaaggucaauuggaaaaauuggaaaguauuugcaguggauugggaaauaacacacuacuuuguuuuguugguguguauucuuuuuuuucggcaaugauaucauaauugccuuuuaaaaaacuuuuaaugucugcucccugagcuacuuauuuuuugagcauuaauuuauacuaaaucagcuucaaucuuuuaaagcagauuaggguuuaugucacugaaacuaguuuuguuuaaucuuccuaaaaaauaggguuaggguuuuauuauuguuuuuaaauaauacaugccuauuuaaaaaaauagaagaagaagaagaagagcggggagaggcagagaaacuuauaggacaauaucauuuguaaguuucuuucacauaaguauacgcauuugaacccuggaaaaaccauuuacuuugugacacaacugaaguucagaaagaaugugauuagccccagaucacagagaaaguaaguggugacauuagcaguggcccgugggacuaccagcuccucagccugcauuuaaaccacagguacacuuaacuuacugccccgaguugcauauacauuuucuaauaacguaacuauugauguaugugcucaccaccacuucaagguacgcguuugcccucgugcauguggucuguuguguucuuaacugcaguugaagcacuauugggucccucaucaucaggaaauucucacaaaguacaaugaccuuucaacuaacugcauuuuacaaggaguaauacaguuacucauuacagguugcugcaaauaggaaaaaaaaugaaguauagaaaaaccaaaccucauugucgaaauguauuugggaguugcagaaggaagugaacuaugucuuccucuaaugcacuagugaaauacuagagaauagucacucucgcaucaguaguuacuauggaauauuuaaucauaggauauuuaaucagugcaguucuguaguaucugguagggucucaaacaggcuuuaaagguuacuuauuuguuccucaccauaauuagaagaugcagauguuaacauuucuguuuccauauggagaaacagccacagaaguggcgcaucccaaggccacagacauuguaaauguugggcccaggccugggauuagaugccucacccuccuuuugacuccaccaugcugccagucucuacaugagaaaggaccaaauuuuuauuucauccaaauauccuagugcucccggaaauauuuucuuauauuuuggagacuuggcuuacugccacuuuuuuucucccucacuguuucuauuaacauguggcauccaaaaucgauuuggacugagaaucccaccuuugaaugccuggccugugugcaucaguaagcuggaugguuuugcugaaauuguuagaagccauuucaucgagcacaccgugucuccuucagcaccugugcucacuuugucuuaccuuuuucccuuuacacuugccaccuuaccaaagcagcuucccccugcaccuaccuccguggcuucauuuacccuaugaccauuauuaauccuaaaaacuucacuuuuguccccauuccuuguuucuucaaacgccagcguaaaacaaggaaguauuuucugagcaucagaagugcuuuggaaaggucagaugauggugaggaauaucaugcuguccacacugcuuucuuugggucggacccagaacacauaaaaagggaaaauugugaacaauggcaaauauaaaaugaaauauccucauuucacacguuucagcuguaugucaucugucaaauggaagccagccuuuuugaaaaagugagaaaaagacugcgguuucccucuucugcccucauacuaaggacaaauuugauucacucacuaaauggcagauuauauaguaaaacuuugcucuccugauaaauucauauuugcacuuccccuggaaauuuaacagaguccuuuuguaguuaauuaacuguaaaauaagauaagauugggcaguuguaaaaggaaguaucuuuaagguuuucugcuaggcugggaauauuuuauuucuaaucaaaagccaagaaacuaucucuaaacuagcucagagggaaauccacccuccccaccccucuucuuugauguugcugcguauccuggugagggcuuuuauuagaaaacuaaggagcaggacuggcacaucaauagcgauaagccauuuaaaguggugccccuccugguccucgaugcucgggauuaacucacugugguucuuuucuggcugcuccuuuuuuguaacuuguuuauugcauaugcuuuuuucccugcucgacuauguuugggagccacgacuuaccaucuugauuugucuuguuugcuuucugugucccuugcuuccugugcccaguugagccuguugaugcccgcccugcugccgaccgaggacugaccacucgaccagguaucagaaccgcuugacuugugccucuccgcaucuugggccuaagcucgagcagacguugucuccuuucugcauuuuaagccucucucaauuguacuuacugcagaguagaauuugaagugaccuuagaaaccaaacuuuuaaaaauuccccuugacuauuccuuacucuucauuucccaaguuccgagugaaaugauuuuuuuuguuucugagcuuucccuuugaaaccuaaaagagagcccuuccaaauuuggguuuuuuuuuuucuuuuuucuuuaaaacaaacaaaacaaaacaaaaacagagacgauuauauacagccuguccuuaaaaacagaagcccagauagauguagacucucaggugaugacuuggauaccagugugaacaucucuccuuucuuguuugguguccagauggguaauuuucuaacugaacugggcucaaacuucaaucaguuacugaaguagacaugauuuccugaaaauaccagaauugguuucuuuccagagcccaaaauacaucuucuguuuuguggguuguauguacuuauucucaaugaguggcuaaaguaacacaacagauguggaugcauaauuuugcacauaagcccuuuuuuuauguauuacuuaaaaaucccauuaacacugaaauagacacuucuuuuuuuacaguuucacaaacauuaagaagaaacacauuuuuauuuuaugaauaaugucauagcacagcagaagcauauaugugccuggugucuacucuaugaacaaccucacccaacugauaguagccagugcuuucagugaaucaaaaagaggaagaaaguuauugaauugacaaauuuguguauuccagggagauuuuaaucccaaauaacacauacuuuuccauauuuauuuucuucuuuauccucauaauguccccaggcgauagucaaagaacagggaauuaacuuucuuugaagauauuaauacacagaggucaaccuuugcugccugguucagauacagucagcagcagaccaggagacccacccugucccucacacuuccaccacaggcucgagccaugacugccuccaagcacggucacugaugaagacugagagucugccuguggcaucuucaugccuuuaugcugugauuaacaguggcagcagagacaguagugugacacgucuugacagcuggucucguugauuuaugaauuucugucuguaggcuuuuaaggggaacuuaaauuauagugagucagagacaguuucaguucuucuaauguccuccuuauugucaaugucauguaagggaaucucaaggagccaggaguugacauuccuguucugcucagccaacuuguaaggccucgggcugagggucaguucaguucuaauugcaaccacagccagcucagguuggucauuugccuugggacuuuuuucauggugcuucucuuuaaaagacaugcucuucaucuacaagcauaaaauguaacuuagaaagcgcucauucgacucauucaauuuuaucaaauuucuacauugggccaggagagccuauauguuacuauugaaacauccaggaccaggugacacuaccagucaauguuuuuuucuuuuuuaaaaaaauuguuuuuugauuuuuuuuuuuuuuuuuugagauggagucucgcugugucccccaggcuggaguggaguggcacgaucucaacucacugcaaccucugccucggggguucaagcaauucuugugccccagccucucaaguagcugggacuacagaugcgccccaccaugcccagcuaauuuuuuuguauuuucaguagagacgggauuucaccauguuggccaggcuggucucgaacuacugaccucaggugauccacccaccucggcaucccaaagugcugggauuacaggcauaagcaccaugcccggccuauucuuuuaaaaaaaauuuuuuuuaaucuaaaucuaacaaaaaggacaccuccaaacgcugucaaacaaaaacaguguguuuuaaaggaagagcuagagaauaguuaaugguauuacacuggugggagaaaaccauccaaaaccuuucucauaacaguaagaauaugaugucacuuggggauuucacaaagaucaauccacuaaauucuuucuagguuugaaagaaauuaaacgguagggucccugcucucaggagcuugagguauaauagaaggaauuuugcauauuuggaaacaugagauggaauuuggaagacaaggaaauacaaagcaacauuaagugcuaacaagaauguucugugaugggaggagauggaguacuaacccaggggcauguuaaguagagaacuuacuggagaugggcuuccagagagguuaugaaagauuugaggcaccuggauuggcaaagaagaagggaacaauucuauucagaagagaggguggccuaagccaagcuuccuuucauacacagcguaggcuuggguugcccaguaagauggcuaaaguugagaaagaaugcucagauaugaagugaggaagauucuaguuaagguuugucuaugaauagcaguauuuacugcacauguauuaagccaugcguguguucuguuuuugugcuuguaguaaguuuaucaaacauuugggcuaauuuccccguguuuuguagcauagcuuugguucuucuucacauuuuagagaccacccacuugagucuaaugugccgaauuauaucuuuagccuuuccaaacuuagaaagccuucccaagauugucaugccguucaagugauggcauuguuuuugaauaaucacuguuguccucagaaacaaguuaaaaaaagguuuuuguuuuucccccacccagugcuuuauaaucaugacugaggaaaauggcuucuccuuaacucucauaucuaaaaaaacagaauaugguagcuuccagcaugcagugucaaguagggaccauuguaauaacaguggugauuugggggcauaguggccauuauagcuccuccuccuggcuuacuuccaaagaaaaaauagacucugaaggacuaauuauacaguuugaccagaauaaaaaagaaaaacacauuagcgagcucuucacauaggguagaaagcuacccuuucuguuacaauucaucaccacccuucugcaguccaaauaaagggaaaccagguccuugacccgagccaugcaagaggugucaugaaggacauaccucccuuagcccccacaugaacaaaaggcucuguccacucaucaugacuuacaggaagagagagcuggagucaccagggcuuagggugaaaucagcacaacucaagaaagaccucuaaguaagccugcaaaccaaggucccugccauuuauuugaaacuacucaucacauuuuauuacaugcauuaucaccuuauuaugaauauuucccuaugugccagcuuacugauuuugucuuuuaguaagauuugcuuaauguaaaaagucuucccuagaugacuauucaugcuaaacaaacaugaacuauuauagcaagagcucuucugccaagagcuucucaaacuauugagcuguaaacaugaauuuaucugucaugcugacuugauaauaugaauuuuuuuuuuuggaccaccaaaaguauucacaguaucauuucaaaaguagugugggcuuguaaaguuuuuaguggagagcucuugguuuuguuuuuuuuuuuuuuuuuuuuuuaaaacaggauuugucucuguuuccaggcuggagaacaguggcaugauaccagcucacugcaacccccauuuccugggcuaaagcuauccucccaccuaaguuucccaugcagcugggauuacagggaugugccaccacaccuggcucauuuuuguauuuuuaguagagacagaguuuugccauauuggcuaggcuggucucgaacuccugaguucaaacuguuugcccgccucagccucccaaaggcugggauuacaggcaugagucacugcaccuggccgagagcucauucuuuuuuuuuuuuuuuuugagauggagucucacucugucgcccaggcuggagugcaguggcacgaaucucggcucacugcaagcucugccuccuggguucacaccauucuccugccuaagccucuaguagcugggacuacaggugccugccaccacguccggcuaauuuuuuguauuuuuaguagagacgggguuucaccauggucuugaucucuugaccucgugauccucccgccucggccucccaaagugcugggauuacaggugugagccacugugcccggccagagcucauucuuuacuuuuauuuuucaguauaaauauuuggcuccaaaaucuaaaagggaagacucuucaaacuguucaagaaaguuuucuuaaaaaucucagaaauauaguucuaaccuauuguguugcuagaucuuuuauuuauuuauuuauuuuuggagacagagucucauucugucacccaggcuggagugcaguggcacaaucucagcucacugcaaccuccaccugccggguucaagcgauucuuaugccucagccuucuggaguagcugggauuacaggcacccgccaccacaccuggcuaauuuuuuuuuuuuuuuuuuuuuuuuuuuuuuuguauuuuuaguagagacaggguuucaccauguugaccaggcuggucucaaacuccugaccucaagugauccacccagcuuggccucccaaagugcugggauuacaggcgugagccaccgugcuuggcacguugccagaucuuaauaacagaaaaggagugagcucuaaagaaaucacugguuauauaaggaucucagauuuaaaagggcuauagaaagauuaaaauauacagccagugagaauuaagagaguuuuagcaucacuacccuauaaaaauaagugucagaaagguucguuucagcagaaugaguugaaacuuaaccaaaaaauacuuaacaauauuaaaguaagaaaauaaauaagaauagagaacucugugggucucguagcaagaaguuggggguugaggguuaggucauugagaggaccagaguuaaagaaugagaaagggaaacugucccacuuccauugugccuuuuaugucuauauuaaagagaaugaacuucugaugaaaggaaauuaaagcccgagauagaucaacaugagaaaagaaagcccuagcccauuaguuaccuauugcuacguagcaaauaacgcgagaauuuagcagcuuaaaacaacaagcauuaguuucuuacaguuuuuauaggucaggauuugggaugugguuuagcuggaugguucuggcacaguguccgucaugugguugcaguuaagacacugccugagcuaaagucaucugaagguuugauuggaccuggugggucuguuuccaacguggcucacucacgucacuguuacuaagagaccucaguaucuuaccaugugaacucuguaaugcugcuugagcgucccuacaacauggcaucucgcaccccugcaccaagagguccaggaaagagauuaaggaaguuuuagugccuuuuuuggcccagucucagaagucauacaccaucacuucuaucaugcucuguucacuagagcaagucacuacaucccgaccacauucgaaggaagggaaucaaguucucccucuugaaggaaggaguaucagcaaauuuguggauauauuuuaaacuaugacaucuugcuacccaaguccaaguucuuaugacccagaccaacugcaggcuaagagaacuugaaggggaaguagcaccauugccuguggucuuuguggaaagcugggaagguagggauaggaaaaugaaguucugaauagcaaaaaggagagaagauagcuucacaaucuguaagccagguauagagugacauugauugugggucucuuuucaaauagguuaucaaguggaagcuuuuugaacaauuggaugaggaaauggugcuaggucacaaccagcguggauuuccuagguuuugucagauuauccuuaccuucuccuuguauaggcugugcucuuagacuggcacaucauaugcuguggacauugugcuuuucagugucagcaagaugugucacaaguuucccagaaucucguagacaagauugaaagagugauuaggccaagagcaggaagugaauuccccugggagccaaaggaauugggaauguguagcccaaguaagacaagaaccagcaggaacaugccucuccuuagggucgugauaccuguucaagguuuuaauguggaagggaggauuaggcuugcucuguguugaaucaggcucaaaggauggaaguuacagggaagcugauucuggcuucauguaaaaaaaggacaguuugggcaggcaaaucuaucaaaaaauggagggaaauugauacauuccucuauguucaaacaggaacugacaaucugccccugggugggaacacgguagagaagaugacuucaaaagcccuuuucauccuaaaauucugauguuugauaauuaaauguuauagcauggacacugacauuuacauuuuuuacuuauguuuuugguuuuuaaaugacucugcauuuuguuuuaagcuucaaauuauuauuugaauaaugaaauucaucagaacaauuaguguuaagaaucauauagcaauuuauagaaaaggaagaguucguagguuauaaauucuguuaguugcuaagaagcauuuuuaaaauuauguacuauagcucuuuauucagcagacgaaccaauuacaaucuguguaacuagaacacuugacuaaaauuauauaauuuuuacaacgcuucacugcauagauacaugaacauaauuuauuuguaauuggaacaaagccccaaaguagcaguuuuguucuaccagguaauuaaugcucauuuuuaaagccuuuuauuauuauuucugaaguaaugagugcacauggaaaaagacacauaauaggcuaaacaauaagcccguaagccaagccaacauauuccaggaacaaauccuugccaaccucucaaccaggauuuaacuucugcuuuucccccauuuucaaaaauuauagcauguauuuaaaggcagcagaagccuuacuuucagguuucccuuacccuuucauuucuuuuuguucaaaauagguaguaauugaaguuuuaaauauaggguaucauuuuucuuuaagagucauuuaucaauuuucuucuaacuucaggccuagaaagaaguuuuggguaggcuuugucuuacaguguuauuauuuaugaguaaaacuaauugguuguccugcauacuuuaauuaugauguaauacagguucuggguugacaaauaucaagacggaggagaucucugaagugaagauggaugcagaauuccgacaugacucaggauaugaaguucaucaucaaaaauugguacguaaaauaauuuaccucuuuccacuacuguuugucuugccaaaugaccuauuaacucugguucauccugugcuagaaaucaaauuaaggaaaagauaaaaauacaaugcuugccuauaggauuaccaugaaaacaugaagaaaauaaauaggcuaggcugagcgcaguggcucaagccuguaaucccagcacuuugggaggccaaggcggguggaucacgaggucagaaauucgagaccagccuggccaauauggugaaaccccaucucuacuaaaaauacaaaaaagauuagcugggugugguggcaaacaccuguagucccagcugcuggggaggcugacgcaggagacuugcuugaacccaggagguggagguugcagugagcugagaucgugccuaggcgacagagcgagacuccaucccaaaaaaaaaaaagaaaagaaagaggcuguauguauaguucuuucagacuacaaggcagcaaaguucgugcaugacucgggacuuaaaguggaauuaauuucaauauagcagccacuuugacuuccacuguguuuucugggaaaauagguuuacaauagguuuauuugaaggaucaaacacaugcauacacugcuugguuuuacagaacacuuuauguggcuuaaauucacauccggaacugucuuccuuuacccauucauuucucccccagcucuuucuuuucauucccuccccuaccucccaugauuuaacuucucuugcaagaguaagaucauggagugagcaggaccccaugauguucccgauaguguuauucaucaaaagguuugugcaaagaagacagcagcuuccuuuucagaugaaaucacuuuuccccccuaauguuagaauuggaguaaaucaaaaagccacaucuccuuuguggucagcucuaguaguuauauaaaauccuuuaccaaaagcuuagaaauggagauaaaucaaaucguggauuauguuaggguuccaucuuaucaguaggugcaguaagaggguuaaauuaaugaagacgacaauuuuaucacauucagugguggacagaaaaaugguaagaaaauuuccauagcaauaauacuuaaaguuaucucaggcacuucuuuuguuuuguuuugugugugugugugugugaguguuacuuuuuuccaagcagaaaaugucuuuucaauauucauaaaguugauaaauccuaguauuaaucucuaaaagaaacaccuccaaauuauuauuuaugccuuacuugacuccaaauaauuguagcaaauaaaaaacugacuugggauuuggauuugcauucuuaacucccauaguucuuuuuuuguagaaagacauuuagcuuuuugaagcaugguuuucauuggcaagauaaucuaguaucaguuguuauaagaucaggguuucucuugaugaggcuguugcugaagagguuaauaaaaacuggggaaccacuaaagaguugaagaguuggugggguagaaagcugacgauuaauguacagauuugcauuugucggggccuggggccugugucauauaagcccauccccacaauuacacuaacgccuauaaugcgacagugacuaauggcagcggcagcaauuaggagaaucagcucccucuacuggacuaguuaagauaauguauuauaauuagugcaaugaauauuacaaaauuacaguauuuucuuaaaggcacaggcauauguccagacuuguauuuauuccugauuaccucacacuaguauauuagcuaauuaaugauuugcuuuucauaaaaauguugagcuagcauauuuguuuaguaaagggaauaauuaugaacaauuucucauuuuguuauaaaccacgaguaaaacacuuuuagaaguugcuucauuugcuauauuuuauauugccuuuccagauugcuaguauguuaguuucagcuuagaaaaaucagucauuugacuaccuugaggcuaaauugaaagaauuuuuuagggagguacaggcauaccuuggaaauuucagaacaccacaauaaaacaaauuuugcaacaaaaugucacacaaauuuuuuggcuucccaguacauauaaaaguuauguuggccaggcacgguggcucaugccuguaaucccagcacuuugggaggccaaggcagguggaucacaaggucaggaggucgagagcauccuggccaacauggugaaaugccaucucuacuaaaaauacaaaaauuagcugcauaugguggcaugugccuguagucccagcuacucgggaggcugaggcaagagaaucucuugaucccaggaggcagagguugcagugagccgagaucgcacuccagccugggcaacaagagcaagacucugucucaaaaaaaaaaaaaaguuuguauuuacacuauacucuagucuguuacaugugcaauagcauuaugucuaaaaaaaaaaaaagccauguauauacuuuacuuuuauuaguaaaauauuuuauuacuaaaaaugcuaaugaucaucugagucuucagcaaguccuaaucuuuuugcucguggagaaucuugccuugauguucacugcugcaggcuaauccaggugguggcugcugagguuugugguggcuguggcaauuuccuaaaauaagacaauaaugaaguuugcugcaucgauugacucuuccuuucacaaaaagaugucucuguagcaugugaugcuguuugauagcauuuugcucacaguagaacagcuuucaaaauuggagucagucuucgcaaaucuagccacugcuucaucgaguuuaugugauauccuaaauccuuuguugucauuucaacaguguucauagcaucuucaccaagaguagauuccauugcaagaaaccacuuucuuugcucauccauaagagguaacuccucauccauucaaguuugaucaugagaugguagcaguucagucaugucuuuaggcuccacuucuaauucuaguucucuuguuauuuccaccacaucugcugugacauccuuuacugaagucuugaacuccucaaagucacccaugagaguuggaaucauugucuuccaaacucccguuauugcugauguuuugaucucccauggaucacagauguucuuaauggcaucuggaauggugaauccuuuuuagaagguuugcaguuuacuuugcccagauccauuagaggaaucgcuaucuauggcagugaauagcccuacaaaauauauuugaaauauauuuugaaauaauaagaggcugaaauaauaagacuugaaaguugauccacaggcugcagaauggauguuguguuagcaggcaugaaaacaacaguaaucucccuguaccuguccuucagagcucuugggugacuaggugcuuuguuagugagcaguaauauuuugaaaugagucuuuucugagcaguaggucucaacaguggguuuaaaauauucaguaaaccaugcuguuaagagaugugcugucaucccaguuuuguuccauuuauagagcaugggcacaguagauuuagaauaauucuuaagcgcccuaggacuuuuacaauggucagucuuggcuucaaaaacaaagucgccagcugcauuagccccuaacaagagagucagcuuguucuuugaagcuuugaaggcaggacuucucucuagugaugaaaguccuagauggcauuuucuuccaaauaagucuguuucaucuccacugaaaaucuguuauuuaguguagccaccuucaucaggagucuuaucuagaucuucuggauaacuuauugcagcuucuacaucagcacuugcugcuucaccuugcacuucuguguuauggagauggcuucuucccuuaaaccucaugaaaucaaccucucccaacuuuuuuuucuucugcagcuucuucaccucucucauccuucauagaauugaagacaguugugggccuuguucuugauuaggcuuuggccuaagagaauguugugguugguuugaucuuccauccagacaacuaaaaguuuucuccguaucagcaauaaggcuguuuugcuuuaucauuugugugcucacuggaguagcacuuuuaaucuccuucaagagcuuuucuuugcauucacaacuuggcuaacuggcacaagaaucuuggcuuucaauaugccuugcccacuaagcuuaauuauuucuagcuuuugcuuuaaagugagagaccugugacucuuccuuucacuugaauacuuaagaggccacuguaggguuauuuacuggcccacuuucaauauuguugucucucaagggauagggagccugggaguugaggggguggaguggccaguuuggggggcagacagaacacacacaacauuuauugauuuaguuugcugucuuuaugggcauguuucaugacacuccaaaacaauuaaaauaguaacaucaaaggccacugaucacagaucaccaaacagauauaauaauuuuuaauguuugaauauuuaaauaauuaccaaaaugugacacagacaugaagugaaccuguguucacuguuggaaaaauggcaccaauagacuuguucgaugcaggguuaccagaaaccuuuuuguuuuuuuuuuuuaaauacuaucuguaagcacuacuguacaauaaagcuauguaugccuguauuuucauuaaguugcagagcaaacgugguaauauuuagcuuuaguuuuacuucaucuggcauaagaucaacuccuuauauaacaagaugauaaaaguuguggugugcuucuauaauuucauucaaguagauaaaguugaaaaauaaugacuugcuuuuauaaacaguaugaagcaauguagugcaguaaaugaaauuuuauuccuucuuuacaauguucucaaaauuauuuuuauguuuaauccaaauaaagagcaagaauaaagcaacauuucagauuuugguuucuggagacaauaguuagaaagcaugaguuaugagugacuuaaaauucuuguugccuguacuucacuuugaaauaacauuaugcuuuaaaaagcauuacacugcuaaagguuaauuagaauucugcagaauuacuauagcuaaaaguagguaacaagauaucuuuuuuucuauuguuuaacuccuuuguuucagaaugccuauuccugugcauuaaaagugucccuccaaggaaauuaggacaucugcagaguugaaaaacaccuaagucucagucacuuagagucacacaucagggcucagagugcuaugacuaggaaaaugcugaccuccuuucauuaguaugaucgugccuuuccagcuuuugauagauccaagcgcuaucuucccaccacucaccaaauguuccaccugucaaaggguuucaggucccugcagacuucgguuuugaccuguggggaaaguagacuuccucgaacuggggaagccacauguuguacauccuucuauaaacuaugauuaucauucuuaguaggaaaauaugugauuucuuuuuuuuuuuuuuuuuuuaaaguaagcaucaaauauuugaccaaccaguugggcagagaauauacugaaacuuuuuauauaaccucauccaaauguccccugcauuuaagaaaugaaauucuucuaauugcguuuauaaauuguaaauuauauugcauuuagaaauuaaaauucuuuuucuuaauuuguuuucaagguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguagguaaacuugacugcauguuuccaagugggaauuaagacuaugagagaauuaggcuuagcuuuuugcuaagaacuagcuaaguaucucuuuuaaaaaacgaaucagugugcuuccaugaugcuuggguuacaguuguucuuucuuguuuugguuuucauucauugcaacuuaccgugaauauucugcucaagguauugagaguguguguuguuaucucaacuuacaauuuguguugaaguuaucaaaauaauacaaaugauaaugcaugacuuuaaaaaagcaugauuacucuuagacuuuuuuuuuucaaacacaagcaacaaaaaccaguacaagaaguuaaaaauaaaaauagaaguaggaaguugcuuuuuccaaaaaaacuaaacauguuuauucuuggauuucuuuugucuuaaauagucuggccucucaauacaaccagguaauaguaaauaaugugacuuuucagugcagacucuuaccuuuaaaguuucucaggaaaucacacuauaccaaauggcccaccaaaacauacaugauuguuauuugagaguucugcaaccuauuacccugcacuuccaccugaaauaucuuaguuucaaggugcuauacuaaaacaagaaagagagaaagaaaauuuacgaauaaguuauuuuuaugcauuugaaaugccauuuggaugggggaaaaaguguuaaaaucucacaguauaugcaacuuuuuaggaaacugucuugcagagaguauaguguaaacauaacuuuuauaugcacagggaaacugaaaaauuugugugacauuuaauugcgauauuuuaagaguuauggaauuuuuagagcugaaagauuuauugaugaugaccaaucaaauugaucuucucaucuuguagaugagggaacugaggccgagacagaaggguucaaauuaugcaaggucaagcucagaguccagauuuccccucauauuccccauugcuuuuuuuuuuuuuuuuugagacagucucgcgcuguugcccaggcuggaucuuggcucacugcaaccucugccuccuggguucaagcaauucucuugucucagcuuccugaguagcugggacuaugggcacacgccaccaugcccggcuaauuuuuguuuuuaguagagacaggguuucaccauauuggucaggcuggucucgaacuccugaccucaggugauccacccgccuuggcuucccaaagugcugggauuacaggcgugagccaccgcgucuggcccccauugcuuuuuccaucagagaaaaguccagguguuucuagggaguugaagauuccacuauccccaaggaaaugggcucuaaaccauucuugauuagaagaggacaggcagaguuuaaauaaaugaaauuuguggugaagccagaaauuucauuuugcucagcaauuaaaaccucugcagacuacaacagaagcugcugauggaaauugggguggagccucauuuccccauucauacugacguggaugagcagugugaggaaggaaaccaagagaacagcaggcagcaggguggaaaggaacggacugacccauagaucagagugugagcacauaaaagcaaugaccccacugucauguuuggccauugcaccuuuugugauaguaucuaagcuuaugucccucaaaacaguguaagauagguuuucauuaguaucagcuuauuucauuucugcucaaauuaauuuuuaaaaaaauuuaauuccauauuugagcaaauaaagaugucuucauacuugaguaauucaagaccccuuuuuugcugcuguuguuguuuugguuuuuuucaugguuuuguuguuuucuuuuguuguuguuguuucuuuguuuuuugagauggagucuugcucuuucacccaggcuggagugcaguggcaugaucuccgcucacugcaaccuccaccucccagguucaagcgauucuccuaccucacucucagccuccugaguaacugggauuacaggggcauaccaccacgccuggcuaauuuuuguauuuuuaguagagacaggguuuugccauguuggccaggcuggucuugaauuccuggccucaagugauccgcccuccccaaccucccaaggugcugggauuacaggcaugagccaccaugccuggccuucaagagcacuuuuuaguuuauuuaauauaauucucuuuguugccggucuguccguugaaguugccuucuuugaugccagaggccaaagacuuggcuuccucgggcuuccauaacaaaguaacacagauggguggauuaagcaacagaaauuuacccucucacauuucuggaguguaagaucaagguaucagccagguugguuccuccccaggcaucucuccuugguuugcagaugccugucugcucccuguaucuucacaugaccuucacucuguuuuucugcuguguccuaaccucuuccuacaaggacaccagucauaguggauuaggaucaacccugaugaccuuguuuaacuuuaauaaccucuucgacccuaucugcaaauacagucacagguggagguacuggcagcuuaggacuucaacauaugaauucuagggggacacguuuuagcccguaacagaccccagugaugcugagcauaaaagcaaggccuccaccuggagcuccuuccccuggcugugcgugagaccagguccuaccucagaccuaaggaaaaagaauccccaaauaggaggcugcgaaucugaguguugaaaauuuccccaaaugaaugagaugugcagucggauuugagaaucccugacacaucauuuuaacacuccuuccuuuuaguucuccgcgcaagccucagggaguggaaaaugguaucucucaccucccagauaaccgguugccuuuuaagugcucuuccagcugccugaauuaaaacgcucuuuuuuuagucaguuuaccaagcagugucucauuggacuuaaaaugucagaggagaaguugacacuuugacccagauucugacauuaauuuuuaagccaggagguauccuugcaggagcaaaaucgggaaggauggcuguucagcucuucucuccucauuuugcugucuacuggagagcaacuggaagccuuucuagaugaggggcuccaccucauucguguuuguuuuguuuauuuccucucagcuccuuccccucaagaccuuugugacuguccuuccugaaagcagcccucugugcagccccauagugugucuguacagcaauguugaaauagaccacauuccgcuuuucuguccucaaaaaagauguaguuuagcugggaugguagaaccugaacacagggaguugcaacccagccuagggauguucccaggugagagagcacggugggcuuucagagcaccauuuuucuuagcauuccagcgucugcacccacagaagugaugcuucugcaacauccucuuccuaccuuaacaggcacucucacccucaaguacauggaaauaccuuuauuuccggcucuggcuaaccuucauuaaucaguaacccuacuucaguaagaacaaaaaugaguacaucaauauuuccaguuggacucaccucagucacucaggacagaauaccauuguacuuacauaccaucgugccugaagaagucaugaugaaagcuuugguuuccaggagauuuuuuguuuuuagagugaaaaaugcccgcagaagaucacagagauaggaacccuaggaaaaaaacuccugagaacaaauguauaaaugaaacaagccuagaacagucacauaccacuucacacuggagagaacguucugagaaauguggcauggggcgguuugaucgcugugcaaacaucauaaaguacauguacauaaaucuagaugguauagccugcuacacaccugggcuacacaccuacaacuauugcuccuaggcuccacaccugugcagcauauugcugcacugaauacuauagacaguuguaacacacuggcagggauuugcguaucuaaacaaacuagaaaagguacaguaaaaaauacgguauuauggggccaccaucauauguuuggucugucguggacuaaaaugucauuauguggcccauaacuguauuuuuauugguagaguuguuagcauuuggaaaugagcacuugcuaguuguuguuuuuuuuuuuuuuuuuuuuuuucaaauaagcaggaaauauugacuuacugaauuuacuuagccauaaggccagagagucacucugugagccauuggccacgcuuucccaaggagguaacugugccuuauuggugcuucaagcagugaagcaauagcccuuuauuauuaccacuccccaaaugugcccuccaugucagaauagcccucugguggcuggaaaucucagcacuagcugaauuaaccaccuugcuccuguuuuaggacguuccugcaaagcccacuaaucccaggaucuguuuaguagcaagcgguacuuuucuacauucacauacauagacacuggauauuuaaaaauacguauuguagcucuuucugcuacucuccccagacaugucaccuuuaauaaggagaaguugggggcacagcuucucuuuauuauaggaugugaaaaaguuuuccucucacagaucugaucacuugaacaccagaagucuccccgcccccaccuccugguuaucucauuaaugaucuaaauaagaagagaguuccuuuuauuuggcuuuuauggagguauggcauaugacuuuuucuaaguaauaugcugucacacuggugacuguauaaaaagauguccuuagagguccuuucuucccggccagaagcugacccaccaggauacagacgcacugacguuggcauuguagaguaguuggagagaguggucagguugaauggaaagccacgauaaggaaaagugagggggggugcagaaccuaggaguggcuuacagugagcagcaggaagagaaauuggaagaucaaaggaaagcaucaaaaaugaucacaggccaggcgugguggcucacaccuguaaucccagcauuuggggaggccaaggcagguggaucacuugaggcuaggaguucgaguccagccuggccaacauggugagacccugucucuaauaaaaauacaaaaaauuagccaggcgugguggcaugcgccuguagucgcagcuacucaggaggcugaggcaggagaaucgcuugaacccaggagauggaggcugcagugagccaaaaucacgccacugcacuccagccugggugacagagcaagacugucuuaaaaaaaaaaaaaauuaugaagggauagcaaaggaguuccugaaccugccugaagaauugcuugauguuggccauaaacauagucaacugccuucuaguuauauauaacuauagagagauggcaucaaaauuaggaaaacaagcaucuauacaacuagguagcaggcaguuacugggagguuacgagggauaagucacuagcuugaaaacuuccuauuuucuuugcuuuuauuuuuuuuuuccgcagacuuguggcuccuuugaugugucacacuauuguuguauuguucgccuuaguucccuuacccuccuuuacucgucugguccaucucaaugacaggauucugucguuuggccugacucagucccuuguauaaaaggacaucuauuaauccacauccugcugguuacuguacauaauaaaauguaaacgugguguuuccugccucuccuccaagcucacacacccgcauguaaauacucuaggggcaauaggaggagaccuagaaacuaaggucacccaaauagaaucuugucccugcaggcggauagcugagcucuaaauuacucuggauacagugaaggacuaaaugguuccaaugaaucaaguucagggagaaaagggucaggggguauggagguuagccaaagagugucaaacguucuccucaaagcuauuuuagaacaaggcuggucaggcuauuugggcucagcucuuuucagcgugugucauaggcagcagccaguugaagccaugccaccaugcagugcagggguccaggucucaggaaggugcagcguaccgagagucacaugaagaccucagaucauuuccugcugcuguguaauccaggcagucugggaagagaaugaauauucagugguuguauguaugugugucuucaucccagcaagugacagauguuccugcccaguuggaaaauggaaauucugacuucauugucuuaucauuccuuccagaacaagcaccaugggcucaaacccucccuggcucugcuuuaagggaaauaauauugugucugugcagaggcccugucugcacagggucgugguagggcuggccuucacaugguggcccaugccacugcuguagcuuagccaugaggaagagauuggugagccugcuggagaggaaggcuacccuuacuuggugcuccuccuuuauccauagacaugaguacucagauuuucgcaucuagcuuucaaggggcuggagauuaaagauccaauccauacuccuuggaugcccuuuugucaagauaaucccuucuucuguagcuccuaagcccucuaaggucugagggccaagcugccccauggcaggaauggcaaaauguagcuguccucucaguggcaaaagguaauaggauuaucaaguagcaaaacagaagccaagaaaagacaggagaguuagaggucuggauugugcaccagccuuggagccucgcaucucuagcagggcacucuuaagcguuaggcuuuggaguuugaagaggagauaaaccuaucaaauugccagguguuccccugcccuugaugcaugcaaaugauuguugacagccagugugaugguagaugugccuccuggaagaaauaaaaguauaauauuccaacaaucaagcagcauuguggcuuuuuucuacaaucagaaacauagcagcuuugugcuugaucuccuaagcaagauaauuuuuuuuaaccugggcauucuuugaguucucaguuucgaggugauggggagcaaaaaugaugcccaaguucaaauggcguacugcugcagauaggcugucuccuggcacacagauuuacagagugaaugaaaucucucauucauuggugcuaaucuuuaaccaugguuuuuaacuuacaaguuggaggcuaauuacacaguuaccaguuaaagccaggugaccucauuuguugacaacagugcacagcaaaggaaagaggagaggauaaggaaaauaucugugauuugcucccagaaggacagugaagcugagcauccauuugagcagaguccucugaguacuggccuuggucagagcuuguuggugggagugugcuaaggggagaugccuaggucugucauuggaguaagcugaggguuuggaugcaggggaacucaggcagcucugagccacagggugguagaugggagggauucacaguggcgcacagucucuuccauaaauggaaacguaagaaucggggcacauggccauggcggcucaugccuguaguccuagugcuacuuuaggaggccgagguaggcggaucaccugaggucaguuugagaccagcauggccaacauggugaaaccccaucucuacuaaaaauacaaaaauuagccaggcguaguggcgggugccuguaaucccagcuacucgggaggcugaggcaggagaaucacuugaaccugggaggcagagguugcagugagccgagauugccugggcaacaagagcaagacuccaacucaaaaaaaaugggcacauaauggauggaacauucugucccaagggaugagggagcuguauaucuaccuauuccagcugccuugggauuagccacugguagucauuccaccucacucccagacugaaaagagucaaucacuucaugaaguggggcuauccgaagggaccacaggggaccugauuauacugacagauuuauuuuuauuuauuuacuuuuuuugagacagagucucccucuguugcccaggccggagugcaguggcacgaucuuggcucacugcagccucagccuccuggguucaagcaguucuucugccucagccucuggaguagcugggacuacaggcacgugcuacugugccuggcuaaauuuuuuuguauuuuuguuaaagaugggguuucacuauguuggccaggcgugucucaaacucccgaccucgugauccacccgccuuggccucccaaaagggcugggauuuugagccaccucaccuggccuuuuuuuucuuggagauggagucucacucugucucccaggcuggagugcaguggcacaaucuuggcucacugcaaacuccaccccccaaguucaagccauucuccugccuccgccuguggagcagcugggauuacaggcgugcaccaccacgccuggcuaauuuuuguauuuuuaguagagacaagguuucaccauguuggccaggcuggucucaaacuccugaccucaagugacgcacccaccucaggcucccaaagugcugggauuacaggagugagccacugcacccggccauauugacagaucuuuuagucugaauuguuaucagccaguguggucuagucaugacauaucuagcuccaucucgagaccucaugucuuacugcugacacuacauccucgcugguacuuuuucuuccuuggcuucaggggcauugcuguguaggcucagauccaugccagaugggguguguagggggaaaagcugcauaagggaggaaugucacuuggcaacacucaacaagggggaaugggccugcaguauucucccagagaugaaugagcagcccauucuaggaaauaucccuuugaaggaauaucuucucuaugguacauccaaacuuuucucuggaaaacaugccucuucauucugaugacuuucuauuuauucucuucaucuuaccaugguuuuacaaaagaggaauuuuaacauacucauucagcagaguuaaggaccuccucucuucugcgaacggggagagguauaacaaauauaguaaaacaagaacagccacugcccacguuguagggguaaguacccugcccaaccugcagacaguaaaugccacacacagcucuaacagugacagggggagaaaaacgucuucaguuacuggccugaccuuagagguaaagcaacauauuaacagagagggucugauuuuaaacuuugagcugaacauacuucuauaguaucuuaauucucaguuuuuaaaaaauuacaucaucuagaauggcgucguccuugcucuuccuuuuuucuugugccaaauaauagcccccuuugguauauguuauuguuuuaauugauucucaaaccucuccuuaacauuuuaacaaacauaaaauuugauagaaaugggcuagacuaaauucagcaguccaggaaaucgaguauuuuucuacacagauuugagugucacccaagauacaguauacuuugcugaaucucccuccaugauacucuugugguuuuaucuauuuuaccaaaacacuuccacguaaaacaggcuuccguugacucuguuuguccuuuauggacccaacaggggaggaaaaaauaccauugcacuggguuuauccacuuacuguggaguuggggaaccagaaacaaccacuggacacguugcaagcgcgucaagguuuccaccgccaccugguggcuagauggagcacagcaucuguguaacuggugggcaaaggcguucugcuccaagaugucaaagugggggagaaaauuauggguguucugcaaucuuggcaaaagaagaguacuguacuccuuaucuuuuuacugcuucuccauguucacccuuaaaagauugauuuuuauuuuuuacucagcucuccucuuguuuuucagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgg

SEQ ID NO: 21546 - RNA, 47339 nt, Homo sapiens
ugaccccagugcacagacauagaggcacagauugcagucagacagcucuuuuauugacuuugucugcuuggugcggggguugggggggugucgaggcucuagaagcggccaugcccacagaagugguacacagaagcaggcacagccagcuccgagggccuugaggcugccugggccauacagcacacucgcgcgugcgcgcgcgcacacacacacacacacagucaccuuccuccacccugggagccagcccccaggaggagucuuuuccucuaaccacccugggguccucugacaugccuaguccugcuacuugcccagaccugaugccagcaggccugggcgcugcucucuugcuaccuggccuggggcaagggaggaugacaaggccucuggggugaugagagugccuggcagacagcugugcccccagcaccggcccaaggccaagcucgcauccaagcagcagccgggcugccauaacgccaccacaccuaccaagcgcagcagguguugggggaggccagcucugggcgcaggccccucagcccuagugaaaauagugacauacaaaaauauacacauuuuaacaccauauaaauuacugacacgagacacacagugagacggugcagggaguacgguaggaacuggagagguaauaacuuaggggcaggguggcggcggugcaggcuaacccucccugaagccagcagccuuagcagugggggacaucugcccaggggguggggccgggcacagcccgcuguaccugaggacucggggaaauaaauuagcaucucagaggcuagaaaccguccaauacugcuguguccuucccaagggagcuggggaggggacccuggguccugguuggccacacagccucuuuaaagugcugaagcccacagacagacagaugccccugccugcucucuggggaaccuacgugcagccauucugccuggcccucggccuugacagcggcagaaaguaauacugagcgguguccacuccgacuccacggcccacccccgccaggaaggaggacuaagugcugcugggguggaccuuguucuuggcccgaagggguguccugcuggggccaguggccagguccacaccccgacuggcccgggcaaggcggcugggcagugcuggccgcaggcccggggaugggccacgggaagauccggcgggcgcccggcugcuccugcggccuugcaggcugugcagcugcugcuccagcugguagacguccucuguggccugguugagucggucaaacugggugagcagggccucgaacacggcuuggaggcgggagggcucaggcucacaccuuguccccagccggcccaggcucacgcucagcccauccagcuggcuggaggagguggaggggugcgaggcaucggagccagcgcugggugggggcacauccggggauaccuuggagccccuggaggagcgagagggcagcggcuccaucccuucaaagcggacuuuguggcggaacugggggcggcacaggggcucagucaguccggcugcacccugggcagagcccagggcgugucccucucccccccacugggccguacccaccuccuugaccuugcugaggcccauccagaggcgcagccugcgcaggaacaacuccaccaucucguaguccuggggcucccaggccggccgguacagcucuccacgcaaggcgugguagcgccagcggagaauaacagcccccagccguagggcgccccacagccgcagugcccagagccccacacacagcaggggugacaggugccaggacucggcaggacacaggguagagagcccagucccagggcacagcaccaacagggccugggccacgcuccagagggaguccacacaggaagacacgagcugcggggaaggcgacaccagugagggcguacagcugagcugagcugagcuaagacgcccuccccggccgcgcagucaccuaccaggauggccagcugggcguaggcuaccccgagcaccaccaggcccaaggugacccccaggagcucuggcagagcucggcauaaugucuugccaaagacggaccacuggcgcacgaagcguagcugcugggcagccugcggacgagaaaucugucugcuugcagcccuggggugugcgcccagccccgcgcccaccggcccagcccucaccuugaccaaaagcaggaagagcagcgaggccgccaggccacgggcugcggagcucagcugcgccaccuggucgaagcuagugaagcggcgcgggcggccgcgcacgaaacggguccacuggcggucagcggcacccagcugggcgaggcguaccagugccguggccgccgucagcgccaccagcagccaccgcgcccaggcuccgagccgcagcacgcgccagcgcccuucccugugccaaguacgggccucggccacggcgaagugcacggcgaacagcagcaggcacaccuguggggggcgcggucaggagggcgggagggacgcugccggggcggggcccugcgagggggcgggacgcugccggggcggggcccuacgagggggcgggacgcugccggggcggggcccugcgagggggcgggacgcugcgagggggcggggcgcugcgaggggugagacgcugccggggcggggccccgcgagggggcgggacgcugccggugggaggcgcggggucuggccggggacgggcguaccgaggugagcagaggcagcgagaggcccgcgcugaggcggcgcagcgcaaaggggcggacgcugagggcggccagggcgcggccggccgccgggaacucgaggcgcagcgugacggcggcgugcagccccacggccgggcuguagcgcgugagcuccaggaacacagcgcggcuccugcgcagagggugcgggucaguaggagcggguggcagggcgggagcugcggggaccgcgcagugcaggcguggcugaggggcuguggaagccgccuaggccagcgggggccggaggagugagggugggcuccuggcuggugacugcggccaccccggagagggcaggggagggagcucccaccuguuguccagccaguugugcagcugcaggaagcgcagccggucgcggcucuccuccaggcucaggcccagcuccugcacguagcccccgcugucauacacggcacaggagccccaggaccaugcccugccggagagggguggcgugggugccgcaccccagcccuuccggcaccccggagccaggcuggucaggaggccgcggcacuccuggagaacuacucccuuguccuuggcguagacgcccggggcccucgcucugcucaccccagcagauccggcgcugaauaggcccacguccccgagccauugugaggacucucccagccaacgucguaaucgcuggugcugaagccuccugcggccgagcacguguggacccuggggccgggagggucuggguagagugcugaaacacacagagccccaggccggggccagggccucaucaaaacccaacaggaguguuuccugcuggccagcucgccugagcucugguucggcgccaccccagggaacccucccagcagccaucaauuagacaacguuaccaucucucauauacagagaaggaaacggcgguguuaagagggcaaaggucacacagcuagggagcagggcugaugccagagcuccgcuaaaggcugcucucucaacaagaggaacgauuuaagucuuggggcacgcccugccagcucaccuuccugcagccgcaccugccgcagccgugggggccccagcucugggcuggacugguucccguggacguagggcagcagcacgugggccauccauggccagagcuccucagaccugccacagcaucagucacacgcuccagccccuacugccccaugcccgccucgagugagcggccaccagagacccagggaacauggcucccacugcccugcuggccacggcuagaccugggcuucucagccuuauccuggggauguucuggggcagacaguugucugucaugggcccguccugugcacugcaagacacggaccugugucccuccccucugccuacugaugccagcagcaccuaccuccaguucuagcagccacaaagguaucuacacauguccacauguccccuagggucuggcuggacuaaaggcaaaacuaaagcccagaagacagaccagugcaccggaugcccguaccgcgugauggccaggaaggcccggcugugcagcuccugcuugauggcgcuuugcagacgguaggcgugcccauggcaugaggcauccccauagcuggccagcagggucaccagcagaaaaagcauguacaccaggaggcucugguggacgggggggcccuguggucagccuggccccagcccacagugacagcagggcuuuggcaacggcuggagccauggcugcggcagguguggcugcaggaaggugagcuggcagggggcgccccaagacucuaccuggccaggguaauggcagcacacacccugcccggaaccccaccugggggcagacacacaggccacugcaguggugcuuaggggccuucagggccaggcaggagugggcauuggagcugggcccuggcagggacuggggcagcaaguggggggcgugggguaggagggagaccgggcaaaggcugcagagcauugaaccccuaagggccuucugaggugaggaaagggggacaggaguguccugcgugcaugggugggaggugggagacaagagacggagguggcaggggcacaggccgcacccaggcucacccgcagcaugccauguagccucuugaccuugcgggcuucuuccuuggccaggaagagugcaaagccgugggguggccguacgcggggcacacgugcgcucacaggcgucacagccgggcucucuaccagggugucaucuucauccgggugcagccgcuuggccaccagugagaaguacagggcuuccagcaagaccuggggaggggguggcuucagaggggucccccgugauggaggccuguagccuaccccuggcagcccccucaccuucaguggcucccagccgaggaaugaggccaggaagcuggcgcugcuggacaggagccacgcaacacucacgcccggggggaagcucgcacccacccacccugagacagccacagccacagccaccaggagcaggcugagcccgugggccagggaggcacaccaggccggcagcaggcgcuuccgcagacccuccaccaguccuggggaagcagagacagaccugugagaggcagcucacagggaggggcuaggggcaucccggggcuacgcaagcacaccuguccuggacagccucgcugccuggggcuguucccaguucaggccugggcuggguggccccagcucccccagccucugcagcgccagcgucucugucuucuccccaggagugcuggaccugagggacaugguaggcugugaauucaucccggccuccaggaggcaguugcagccaagcccauguuaaccugggcgggcaguuucuugagccucuugggucacaggguccccccgacaaaaagccggaagacccuaccccaaacgagagugggaguggugcugggagccagggaaccaagagccacuccaggcaccgaagucaggcguccgccugcgucccucucccgcccgcuugcugcugauaaacccaucgcccacagccugaccagcugcccuuacagcagugcacagucucucagggugcaaugagccccccuucaacccugcaaacuaugauugggucucaaccauccaacaagcaucucuacaaucuagagacgccagugugucugucccaugcagguuuauggccuaaaauuaacuucuggacaaggaaacauaugaaugccuuucaaaucccaacaguguguagggcucccugaggccagagaucugcuugugucuccaggagccagugaccaccgaggcugugccacugcaucgggccaccaugcugauaugcccggucccagagcugcuagagaagagguacagaggcagcgaagacacguugagggggaggacgagaccaacugcgagacgccgagucccgggcucucaggacgcucucccguaccugcgcccucgucagcccaucaccgaaagaacggccugacccagggucacacugcacugaaugcuuccuguuuugcugucucucggaggauaaaagacacucuuggcugggcgcagugucucaagccuguaaucccagcacuucaggaggcugaggcaggaggaucacuugagcucaggaguuggagacagugagacccugucuuuacaaaaaauuaaaaaaugaccuagccucaacuuggucaggcgugguggcucacgccuguaaucucagcauuuugggaggcugagauggguggaucacgaggucaggaguucaagaccagccuggcuaagauggugaaaccuccucucuacuaaaacacacacacaaaaaauuagccggcuguggcggcgggcgccuguaaucuuagcuacuugggaggcugaggcagauaacugcuugaacgugggaggcagacuuugcagugagccgagaucaugcgacugcacuccagucugggcaacagagacuccaucucaaaaaaauaaauaaaaauaaaaaauaacccagccucaacuauuccuuuauagcaacacaaaugacucagggucugacucagggagcaggcucucgcuggcagagacggagaauggccaauagggaggcauggaguggcagggaaugccagggcagaggcgccgccaggacggagggugcaggcucaggcgcagggaaggccgugcucugcguugggaaaggagccacgggacgcgcuggaggcugcagugaggaaggacgcagagggguccaggacaaacccaagccuccgaccuggucagcccgaagcacuguccgagcaagggacggccaaggguugaggaagccgggagggugagggccacgcgcucuguguggaugcggagucugagcugccgucagaaauccccgcggaagcacugaaucuggauuucacagagcuuugggccggagauaccuggggcuggucagcauguagugacuaccccuggauuuccccauacucuguauuuuuaaaaccaaccagcaauuuauucauaaagaugcccucaugugaugguuaucugccuuuuguaaaucaggaaguuuuccuuuuuguuugaguccaggggcaguucauaccucuuuaguucuugguugcuuaacaaugagaagcacucaaaggaauaacacacaaaucaaacuagauguggaugcaaaagcagcagucacgcaccacuuagugccagggauguguucugagaaaugcgucauuagguaauucuguugcugugcaaaugucacagggcguaguuacccaaacccagacaccgcagccccugugcaugcaggcccugugguguggccuguggcuccggggcaccgcaccugcacugcaugccacugcacugaauccugcaggcagcugcagugcaacggcagggccguguggaccucagcacaccugagcauaggagggcauggcagagcccggggucacacgcgugggaacacgccgugggugcgcuccgccgccggcugccaugugcgugacuaugugcgugacuacauacaagguaaccucuauaugaccauuuguugauaaguuacaaaacaaccaagaaauugaggaauuuuuuuguuuuugagacggaguuucgcucuuguugcccaggcuggagugcaguggcgcgaucucggcucacuacaaccuucaccuaccagguucaaucgauucuccuaccucagucucccgaguaacugggacuacaggcgccugccagcaugcccggcuaauuuuuuguauuuuuaguagagacgggguuucgccauguuggccaggcuggucucgaacugcugaccucaggucaucugcccaccucggccucccaaagugcugggauuacacgugugagccaccgcgcccggccaaaaaugggguauuuaaaaacccgcccauaauuucucacugcucugagaccaagauaaaaacguggccccggccagccucacacaggagccuuucugcuccuacaaagccccaugagccugcucccucccuagagggaagguucuggggcccuggggaucccaugaggcucuuuccacagacaacagagguucagagaagugaaguggugcagccacagcccugcccuggcaccccaccccacccuaccccaggcgggaaccacggcugccuggccugagucccggccccuccucuggcaauccccccucccccgagagccggacacucacaggcugcugagcagguccguuuccaugugggugucuuggguaggggcugggcugcugacccccucggcaaggaccugcuggaucaggucuucaucuagagguacaggaggcauagggugggcccagcugcaagggugagcuucagagcccccuccucucaccccagcucaccugaugcugagaaggauuuggcaggcgaguaggggcuggccagggagaagccguccuccucugggcccagcccauggcccgccuggccccgugccagcugccgcagauugcuacccacaauggacgggucacugagcagguccggccaacugagcguucccucgccggagggccagcacaccagacugcagguggcgcgggucagcaagguaccaggggaugugucacacacacagcccacccccguccagucacgcacggacacccugggcuuccgagcaaaccugcucccggguggugugaccacauggagccacagacacccagcaaggacacgcagcccgcacacccccggcaccccagacacagugaccugcaccagggcucgagguuucucuagggaacccaccucuuagaaucauccagaaacaagucacucuucaucuguccaacaaaggccugcugagaggugcacagugucuugaguccaagcugcgccaaggcggcaggacccccagcccagcccaggacccccaguagaguccucaccucagcguggaggccugagaacgugaggaaggagcuguccagcacggacgaguccaggcagcugucgauguccagcaccugcugcccggcagguguggggcucgggcucccagccaccugcaggacgagggcaguggucagcgggcggcagcucagaccugcucaggacagggaugagaagccaccuccucagcagacaggacagagcccggugccaucugacagaauguccuagaaugcuggauauaugggacaucugcaccguccgugauggcagccccucgcgacgugugccacugaacacuugacagcagacuggugcagcuaaggaacagaguuuuaaauuucauauuuucuuuuuuagauggagucucgcugucacccaggcuggagugcaauggcgcaaucucagcucacugcaaccuccaccucccgcguucaggcgauuguccuggcucagccuccugaguagcugggauuacaggugccugccaccaugcccagcuaauuuuuuguauuuuuaguagagacgggguuucacuguguuggccaggcuggucuuggaacuccugaccucaagugaucugcccgccuccgccucccaaagugcugggauuacaggugugagccaccacacccggccaucguuccauuuuaauuaacuuaaauacgagcagccacauguggccucugguuccugccacggacucgggagcaaccccuccuggucgcggcuuaugcgccuucucugugugcugcugggguuaguuugcauguaaccucuugaggaccccacgugugcauuccuaaggggugcggccucccguuuccguaugaaugggaagcguucccaccugcuguauucuuggaaagagucugugaaggauugguguuaauucuuccuuaacugcuuagaaaaauucuaucgugaaggcucugagccugagcuuuucuuugugggauuuuuuuuuuuuuuuuuuggagauggagucuugcuccguugcccaggauggagugcaguggcgcaaucucggcucacugcaagcuccgccuccuggguucaugccauucuccugccucagccucucgaguagcugggacuacaggcgcccgccaccaugcccagcuaaguuuuuguauuuguaguagagucgggguuucauuguguuggccaggcuggucucgaacuccugaccucaagugaucugcccgccucggccucccaaagugcugggauuacaggcgugagccaccgcgccuggcccuuuuuaauguuuuauauagauggggucuugcuauguugcccaggcuggucucaaacuccuggacucagauccgcccaccucggccaccugaaguguugggauuacaggcgugagccaccacacccggcccggccacugggacguuucuaagggacuaacucagccucuucacuuccuauagauguacugagauuuucuucuggagugcauuucggaagcgugcacagccgcgugcuugcuucuucugaguuaucuggcgugcugcugugcagucguccguggcgucugcuuagcaaagugcccucguucuuucaccauucuggcuucugagucuucucucuuucucccuggucagucuagcuaaggcugcucaaguguguugacccuucccgagcagccuuugguggacgccuuucccucuggcugcagcacuggaaaguggcggcccuaggcauggugccgaggcccaggcuccauucccaguacucccggguccccagccccagcccaccuugcuccgggacauccggaagagaaaaaggauggccagguagacgggauagacaaccacgcuggacaccaggccaacagcgacugugucgacgcucagcgggcucagccuggacacaugccccgugcuguguggaggagaggaggccacacaggugaggcugaggggcaggaagggcugggcaggaagaggcugccccgaccccuacggcacccaccuguaggcagagucgccaacagccccguaccacacggcguuggcgcccaggaagaggcagaugaggagaacgcagcagguggcccucuggaugcgagugaaacggcuacgaggcggccggucccauauggagagccagaugugcuugucaaagaagccacgcugcagcucagccaccagcaggcgccggaagcgcaaaagggcugcgucgccuagaaggcagggagggccgcacugcaggaggccacggggcaggaccacccugcccaaccucccacggagugggaacauggaacgaggccuuacucgcggccagcaccuccuucuccaccaggcccccguuggccuccgucuccaccgaaagccagucauugaccaggaagaaggcgcugcgugccgucugcaggucccugacgaugacgugcugcaggaaccaggcagggcugagcccugcagaggcgcaggagggaggucaggcucgcagggcgccccaaugcgggggcagaggggcagagcuuggcaggguccgcacaaaccuuuguugucgugccacacucggaucuuccacacgcuacccaggcugugcgggguggcgauccggaagauguccaggcuguugcgguggaaggcucugucgccguccaggugccgguggccgcuccggcuguccaccccauacagcaugaugcccacgugggccgugguaccugggaggcaagagggaggggugggaggcucggucugcugcccaacacguguggcaucccaggcaagucaucucagcuuuggccugugcgcacucaaggagccacacaggcagucccggcuuugcacggcucugccauacacaaggagcugcgguuacugcaauuuguccaauuaacagcaggaccucaaggacaugauuaaguuacauggaaagaacuguaacuugugacaugcaaacauggcugcacacgccucaguccacaccacaaccagugacccgcacugcacaccuguccacgccucagucaugccacaaccggugacccgcaccacacacccgucccucaguucaugcacagacugcaaagcgugaagcugugucaccuccucucccagugacagacccaggugacaguauuuuuuuucuuuuuuuuuugagauggagucuugcugugucacccaggcuggagugcaguggcgcaaucucagcucacugcaagcuccgccucccggguucacgccauucuccugccucagucucccaaggagcugggacuacaggcgccugccacuacgccgggcuaauuuuuuuguacuuuuuauuagagacaggguuucaccguuagccaggauggucucgaucuccugaccccgugauuugccugccuggccucccaaagugcucggauuacaggugugagccaccgcgcccggccgacaguuuuuaaaaguagguaaucaaaagaaagaacugggcaaugaagaggaaagcagcacagagauaaaaaaugggaacacagccaggugugguggcucacaccugucaucccagcacucuggcaggccgaggcaggcggaucaccugaggucaggaguucgccuggcugacauggugaaaaauuaacugggugugguggugugcaccuguacucccagcuacucaggagaaucgcuuaaggggaauggcuuaaacccgggagcuggaaguugcugugagccaagaucaugccauugcacuccagccugggcaacagagugagacuccgucucuaaaaaaagaaaaacgaaaacaaaaagggaaugccagaagggcaauuccaaugaaaggaaaauggagguacugaagaaacagccacggggagggugcuggcgccuccgucugagagacgagcuaugcagucaggaucgcggguggaugcacagucucccacagugguagcgaugcucacgucacuuguggggccacgcuacugugcagaacgugggcugcccacccugacugacuggcaccuacuuccagcuaggagcuguccuaguccucagggacagugagugcucacgaggucauucccaggaugaacacacgagcccuucacacagcacugcaaaaacugccuuguucugacgccugcgacgagacucacucccagagggugcaaccagcacagccagugagagcaggggaggcccugccaccccgcugcgccccucaccugagccccggccccagccugucuugacgaggaucucguacuugaagcggccccgcugcccacagaaagggauggcgcggccccggcuggcauccaacugguccagcuugugcaggauggcggccaugaccauguaggucaccaggcacacagcacaugucagcaugacgauguaguuuacauccgcugucggcuccugugaggacacagccgccgggcccaggaggucacgugcaagcugugccuucucaggauagagccgagcccacccaggcccuccucgacucugcagaggcucccaggagcacagggucacucacaggaaacacaaagcggacauggcuugggggcacgaagaggcuggcgccgaaggcggugagguggcgggugaggcagacggccuggcggggcgaggucuccuccaggggcagcagccccucuguccgccacaccauguccuccucgcugaaguacuggcacagggacguguacaggcccacggacaccugcagcgccgaccagcggaaguggcuggagagguucagaugguaacuccccgcugggucucugcuccugggcagggaagggguagcggacgugagcccaggcuccgccagguuggaugucgcagucucagagcccauacccgguccaguccccucgcugccugccguccccauggggccaguaacccaggcaaugcugacccaugaugcccugcccugcccugccaggcuggcccgcagagcucaccccggggaaaugaagaagguguagggccgguggucagcacccuggagugacucugggcggauccuccugcuagccgagcaguugugcucauugggccggggcuccgaguguagguagacugccagguagggcucagguuccucagacagguaguggccuggggcagaacgcgcaggucacacgccugccgggaagcucaaccacccgggggacacccacgauggcccuccugagcccacccucugccacgggccugaaaggccauaggagccucugcaccagagcuggcaccugcuucuccguggcccccagcuccucucuggccaggcccccagcagcccaugaaacagaaagcaaauuucaccagagacacccauggaagcccuacgagaaacgccuuccccccaagaacaaggccagggggccgcgugugccccacccgcugcacgcaccguccagcagcguauaguugagcugcagaugcagcccggccgcaggguugcugcuguccagggugaccacagcaccgacggaggccuggggcuggaccacaacggaguuggcggaguuggcggagcugcgguggccccgggcagcccaguccgaguuguugggcaccuucacggugauggcgcgcucugaggccagccgcucgauggggaucugggcgccggccugugucuggaaugccaucgaggccaccuugguggagacgguguaguugcugauauagccaaagggaaagggauuggaguccaccagaaagaugagcugcaccacgucacugagguuggccagggccccgcugaaagccucggggauggagaaguggcagccaggcccuggggcgccgccauagcacagcaggcuccgcggguccgagcgcuugcccugggccacgaucuccucgcccgccagcgucaggggcuccucguugagcacgcgggagcgcaugaggaugcgcaugagggcagaggucagguuguaggccugggacgccaccauccgagauggugacucggcucccagcucugagggcuguggugcccgcacguccgagcuggccagguggaugaggucuccugcagacaugcgugaggucagugcagagacagggagguagagggagggugggggcaggcaaaaagggggagccggagggugggggcugggagaaagggggaaccugagggggcagagagcgaggugcaggcagaaggaagggggaagcuggagagagagugguggaggggggagggggaaggugauggggaugaggacgaagaugagggggaugauggggagagggaggaaaaaggaaggaaaaggguagagaaaagagaagggagaagaagaggagcagggggaaagggaggggaagggggauaagggaggggaagggggaugagggggaugaggaagaugaggggaauggacaaaaggacggggaggacggggggggaaauggagaaaaggggagagagauggagaaaagggaugguaauagggaagggggagggggaggagaaugggaauugggggagggggaugaggaugggaauuggggggaggggagggggacgaagaugggauggggcaaaggcgacgcgguuggggggaggagggaggcagaggaaagggccgcacggggcgggcggguggcauggggcacgggccgcggcaccugugauguugaggaugcugucuccgauggcggugggcgucacggugcccgcgguggucucugccugcaggaugagcaucauggccuccagcuugugcagcgucugcuucaggcacgagcggcauacgagcucccugcugggccccuguguggagccagcaguguccagccccgcuccuggccccacuccuugcacacgcccuccucucuacacggguccucaccuggcucccacccccagcccugcagcuggagagcccacuugacuggacccccacagccuccucacuaagcauuuucuguggcucugcaugacccagggccuccaccuggggaccacgugaugcagcccaccgaccacacaaggcaccucuucacaugagagcggaggaggaggggagagaggagaggggaguggagaaaaaggggaggggaggaggggaagggcugggggggaagaagggaaagggcuaggggaggggaggaggggaagggcuaggggaggggaggaggggaggggcuaggggagggaagggggaggggaggggaggggagaguggagggcacagagcagcaucuucuuagucccuccccacaucugggccccucuuuacacccugggucccccgagaggcacccugcguucacacaggacagaacggcugaggcuacugaagcaggucagagaccgaggaacgccauggcaggaaggagcccaggcuggaggcucagcuccucggccaagcugcccgucugcccuggggggcugaacccagugcccuggcaggcaugcggggcagggugagcagguggggccauccuaccaugcacugggccagcgcagcagcgaucugcuggaugucauccacaguguggacccucagggacaccagagucuccgugauguucuugcguaucugggcucggugcugccgcucgugcuugggcucugccgccacguccagggcccgcucguacuggggcaggcagggggcacagcaagcugucagcagcgcaggaggccggcaggaggccagcagaugcccacgacucccggggugcaguuacgugcuagacgcugugugaugcgggcacugacccacaacacugagcuguuucuucaugggcaaaacaggguaagcacaugggcccuccugggcgggggcugcauuguggaaagcagacgccggagagggcccgguggguguggcugcugggagcggaaggucggggugcugcuucagggucacugggauuuaucucuggggcccgggaugagcccucugcaaagcuccaggcagggguacaggucuuggucccaagcacgcaugcagcagaugugacguccccucccaggcugcacucaccucguucagcacggugaccagggccaacgaguacucgaugacgugcuggggaucggccugccgcagcagcccugggagcacacuagcggugagcccgugcagccagacugugagccccguugcgcugccguugggcucugggagggugauggccaaagaccuacgagcagagggggguggugagcagguggcagucucgggggcgcccucccacggccuggcucaccuguugagggcgaccacagcggcucccagcugguccugcaccaccacggccaggcccaccucgaaguguggccugaaacccgggggcagcacggcuccguagcuggagaggcugcccuuguagacacagaacuccucgcaguggcccuggcgacagcgccgcagcagcagggcguacaccagcggggcgccagcauccuccgcgucaugccagccugagggacgguccccacggcaucacgggagggcuccgugacgucacagagucgggggaucccgcugcuccccccacgcaggccugcacucacccgugcauucgaagugcaccuugguggugagggcgugcacagcgcccagugggaagaggcggcaagagccccccagcggcgggcgguugggggacaggcggauggaggcgcagcccuccuccucgccagagcggcccagcaccgugagcgugaagguguaucccucgccgucccgcagcacgccccgccgcagcaccagucgcaugccugcacugcccguggaugugguggucucauccagcaccagcgucuuguugcugaacguacgugcagcccaccgcugcaggcagaagggguggugagggggcgcaacccucugcccugucagccccacuucugccugcaggccccguccccucggccaugggacccauccccagcccgcccacaccccgcucaacacucaccccucgcuuggagccgcugcugcaauugaggcagcggcccuccaaguacacguaggagcugcggcucacuucguacacggccugugccuugcaggacacacacuccaaggacacaaugggcacccggccacuccggaucagcaccuggcgugggagugggguuaccuccaacacaggucuauuuggccugcuggaaggacugggggacccauggaggaugcugcucccaaacuccagguuucccaggggccuggccacugccggugagcucacucccucccaggauacucauccgguuugccaccuuccaacuuggacggcggaagggcauacacagggcagaggacacuggagugugcguucugguguacuggacccagcuggacccuagcaggaggcaggcaaugcucacugagggccccuggggggaugcgugugagaagagacguaugugugggugugaggaccgcagcugccacguaggccugacucacagacuccugcagcccuuagccagggccugggucaggaggcugagcugggauggaaccugcucccacacccuccccucagacgaccccucugggaagacccccaaucaggccagcugaggaaagcagggacuggggaacagacgcccacucuggggcaccagcaggccccgccugacagcagcaggagcagccaccacgggcucagggucaccaagccuccuggccgguccagagaggggagcgugagggugagaaccggcccaccacauccagcaacagggacaugggcuggggacaguggcuaccucuggggugggaaggggcucuuccucacuguugguauugcuaggggacuguguagcuuuugccacuagagcauauguggcuugaagacuguacguggaacuguggcagguuuggaaggaagcaaagcugaagcaggcugucguguuacauagaauuugcaucagaaacagagaggggagagcgugcggccuccaccagcacuaaaacacggaaaacaguagaugaccagggaggcugggcuguccaaggcaaguggccgaggggcgggcggcacccaccgucugguugguggccuccuccuugcggccggccuuccacacggucaggcugaagguguacuccacgccagccgccagccgcucccguggaauggugaccgugcugcucccgcggggcccaaaguucagcgcacacccgccagccucccucugcaggccgagaacaaggggcgacguggccugagagccccauccaguuuuaaagcagagcccggcccaggagacagcgcgggagacccccuccccaugcugggacggggcccaccaggcacugaggacgggccagcccugguggcaagcuggguguucucugggcucauggguguggacgggugaggggcauggaggacggcccugccacgcacugaccugugucgaagccacacaggcccaguggaaacugagcggcgucuggucgccguccuccagguuggggucguaggacucgcucccauccagcaccaggucccgugugucugaccacacgcgguaugagccacccucaaugaugggcaccaggcgcucgggggccaccgucacauuggccuggaugcucugugucaguggcguguccccaaaugacacgacaaacacaaagcaguagugccccacaggcagcgccagccgcggcagcaccagccgaggccggcucacguccacgccgggcagggccacacgcgcugggcgccccggccgcuggcagcuggcggugcgauacaccucccagcgguacucagucugguaggugacgcagucgcgcaggucaacgugggccuccaaguaguugcgcugugaucgccgcaucagcaccugcaggggcaggaccacguccaccuccggcucccggcaggccagcaccuggacggucaccguggccugcgccacgaagaagcucaccagguuggaggcguucaccugcacgcgguaguccccaggccucagguaggagugcucggcccugggcucaucuguguccugcccuggcgacccauccccaaagucccagugguaggccacacgccgggggcuggggcugguggcggccucaaacugcgccgagcgguuggugaagcaggggccgcucugcagggccacauacuggacggcguccugaaccuccagcaccagcgugcgguucucacugcccagggcguugaaggcgcgcaccuggaucuccaacagccccgcggccacgggcguguaggugacgucgcggcccgacaggaugaccagcgagucgcccuggaccuucugcagcgagaaguaccaggcguaggcgacccgagagccgcgcugcacgcgggcugugaaguuccucucagugcccguggcgaugccaggcucgcagcaguugggcaccugcagcccacucacggccuccagcaccacgaugcgcaccugcgccugggcccagcucacgugguuuuugccccgcacgcucaccacguggucuccgacgcgggggaagcugugggagaaacggggcccggggagcaccucgggguuggccccgccgaccugcaggcggaaggugacagcugagccggcagccagcaggaucugaaaauggaccagcugcccgggcgccaccaccuugcugcuggcccacagcaccaggcccacgaugggcuccuccgccgugagguuguacguggcugagacccagcugacugcguuggaggcauugagccggauggagaaggugccagcauccgggaagaccauggugacaugagggccacgcuugcugcugccgccgggcacagcccagcaccagcucacauuggugcccguggccagcugcccccaaaagggcacagaggacccggccgccacgaagcugccuccgggcucgcuggcccugaugcugaggccacucacaggcaccugcacauccacuuccacgguggcguuggcugagcccagcggguucccugccgucauggugaccaagugcaggccggguguggggaagcuaugggugguaaauggcucggaggucucccagcucagccccuccuccaaggaccaaguguauacgacaccacugccaccagccagcucggcacugagggugacgcuuguguugacggcagcuggguucggggaggcggccaccaucagccaccccacaggcuccacgaaguccauggugcagucggcccaggcgcugcccagcauguugguggcccgcagcugcacaugguaggugccggccucgagcacggugagcgagaagccuuugccgcugccggccagggccgggccccugucccuccaggcaguccagcuguaggagacguuggugccaucccuaaccacggccugcagcuguaccgugugguugguggggaaguagcggccaccgcccaccaccugcagccccucuaugagcugcaggacauagacgaagaugcuguccugggcggagcccaccucguucucagccgugacgaugauauugaaggugcccacggagcggaagguguaagagaugguaggacccccagggaugggcgugcagcggucacagagcacccaggaauagcgcacaucacugccggccuccagcgacgugcugaagcucacgcucccauucaggggcaccaccgugcggcuugcauugacgacgagcccccgcacgcgccgcuucaccgucacauugagccaggccucgcugcggcucaccucauuccagccggccacccuaacggugaagucaccugugcuguuguaagcgugggugaccuccggacccucgagccacccaccgucccccagaucccacagguagcuggcggggcgcccacggcccacagcagagaacagguacggcugcugcagcuccagcccaagggagccauugaccuugaugcuggugaccagcacgggcuccugcaccuccaccagggcugagucauuggcagcagagauguuguuggacgcggugacugucacaagauaggagccugggucucgguagaugaacgucaccucagggccccuggcacgggugggggcggcuuccucggugccaaagucccagguguagcgguaggggaacgggggccaggcacaugccaccagccaggccucguccccgagcugcacaaacugccucucuggcugcagggugacguugcccaccucuggcuccacgcagaugcuggugaaguaaugcgcccuguucacgcggcuggacagcaccagcgccagggggaacgugccgcuccgcgugaaguugugugucaccgucgggcacccccgcacggucguguuggaggagccauccccgaagguccagucgaagagguagugggccggguucccggugacguaggccgugagccgcgcgucaggcugcguggggaugcaggcggcggguucaacgcgcagcaccuccaggacgaagaccagcacgugcaggcuccgggccagguggccggcggggcuggccgcacccacggucacugugcaguucugugcccgcagguacacaugcuccacuguugccuccgggcccgacagcacggugccgucccccaugucgaagguccacgugauguugucgcccgucugcaccgcggcgcugaccaccacgggggcgcccugcuccacggccaggcucauguccacgcugaguccgcggagcuccucaaagacgcgcacauccgccugggccgccgcaccgcucaccguguuguugaccuccaggcgcacgugguaggugccccucgaggcauaggugugguuggcagccggcuggcucugggucaggacaggggagccguccccgaagucccacguguaaagaacacccccaggcgagggcagcgggugcggguagaaggugacgggccggccggccaccaggacgccgucacucacacccacagccacggagggcagggaggcgcgcacgcucacaggcaccugcugcgucagguucucgaaggcauuagaugccagcacggucaggagguacucaccuguggggacaggcccgaguggggcagccgcggcacccccaccugcuccccacccgcucggcagaagccccccgccugaggagcccggggugaacggcugcaccugcggcccagccuuaagggucccaggcucccaagccacgugcgggacggagcacagguguagcagcacugagggcugccuggcgaggacggcaccgccuccaagugcagcugcacucggggcagcagagcagcaagagccaggcccggggagggcggggggcgcaguucaggggcccagcuucccuguccacuccccccacgccuggccccucccucaccccaguaggggccuaagccaucagcccaggugaggucacagugagggcuguuggggaggaaggggggcagcuugacuggggagcuggggggaccccgugcucagagccugaaaggcaguggcccccucacccccucaucccucaccuggggcagcguaggugugcaugacauugugcuccaccagcaccugggccaccgaggggucuggaaccgggaaggacucguuguacggaggcuggaacugguggagggccugcuccccauccccaaagguccaccugccggggcggugggacgcagugagugaaccgggacaggggugggcgguggcggggcagggggugcuugggacccagccgaggcuccacucugcagucacgccccgggccuccauucagggcccacccggcugugcugaggccucucccggcucccgugcagccucagggcuccugugcacccaguuaccucccaacagacagggaaaccgaggcucagaaaagcaaccccgugaugugggggucccucggcugaggcuggggcugggacaagagccuggugcccaccccaaaccggcccccgagucacucacaggaaggccaccuccacggccgaguccaccagcacgcccgccgucagugcuagcguggcauugggggacagcacggccggcacuguggagaccugcagacccugcauccuguucauccgcuccacgguuacguuguaguucacggugacguugcucacgugguuggaggccgucagcugcagggacaggcgucagugagcccagguggcaggugagaggccuggcccugauuggcgucccucccuccacucacccacagccauggcagcguccucgggcagcaugaagcagagcagaaggcagaggugaagguggagcccgcccccgcccugccccgccccauccccuccccuccccacccccgcccaccuacugagagcuugaagaccgccgcgcucugauaaaugacauugaagaccacguucuggaaggucagggacugcuugucguugaugguccaccggaagaccauguccgagccggccuccaccacggggcuguaccucugcggggggaauggugucagccugggcucuguggaggacucugcccuuagccugucgccuccuggacacaccucccgucgggcuggagagucccacgcggggcacagaggagaggaggugcccggggcucugcaugccaugggagccaagcccgggcugggacacucacuguccggcucuccagccagccauguaguacuacuaaugccucaaccucucugugccucaguuuccccaucuguaaagcaaaccuaguaccagcuacaaagaguccaccucucucugagucuucucagacccucccggcgcucuugccccagcuccucacccagagagcucggagcagugaggggaggcaccuacacuggcuuacagaacccaggacaggcugcacaggucacgccauuucugauggccccucccaaggccccuggugaagaggcagguacccgcaagauggagacagcccugucccccauguacccagcaugguggcaccgcgggcagcccgcaguuucccaucagggguucagacuccaccucaaaagccacucgcuuuagccaggcgagaacacagcagagggcgugagagacucacgggggcucgugugaggucagggagcagaguuuuaaauucauuuugugaaaugagacaguggaaugaguuagcggagccacugucagagccgugacuuuccaggaauuuaaagcccaccagguagcccgaggagccagccagcaggaccugcccggggccgacguccccaguaacugggcugcugcccucacugggaagccaggccucacgcccugugugagcacccugucugcaggcaccugccugggggcuggugguggagccucggccauacucaccacuaggacucccugcaguacacgggccucggggcugggcguggcgcggaggccacagaugggcuccuccgccgucacccgcaggcugagguuggcccggcuggcgcuguuuuccaccaccacguccaccacgugcucccccucacugagccacggcagugcuaccacugagaacaggguaucguuggucucccaggggcagccgggcacgaagguggccaccagggcagggcagacauucucaaagcgggcgcugacacugcccccaggccagcgagccguggccguggcguuggcaccagaguccaccuggagcaccaaggcugagccguuggugggcacguagaggcggccgucgcggggggcaggguagaugacccgcagcccagccacuggggagaccacgucaaagcugcaggagagguugugccuggacacgccauugcccaccucugcccggaccucauagcgcccaggcagccgcaguccaggguugggccucaagcccagcagcacggugagcuguuccguggcugcaagcagccgcagggcacaggcagggcaggcccaagugcccuccagcugggcuggcaaguggggcagccaugacgaggcguuggcggagagguacggggcccggggaccaggguggccgggagccggcgagcagugcaggagggcgccagggccagcgucgugcugcaagccaacgaggucaccagggagcaugaggacauccuggccguggagggugaccuguggagagggaggcagggcugcaucacguccucacggucauggcccguggacccccgcacgacggaugaggguggacacgcagggcuccccgcuucgucagccacaccucaaggagccuccccacagugcucgugacaaggacaggcaggacaguugcagaccgggggacacacggggagaggacacaggccaagaccuggcagacaggaaggagcagcugugcugggagagaggaagaggaggcacagcucgugccaagggcccaggcgagagcuucucccacugggagagggccgagggcacugcagaggucggaggucagagguggcaaggacgugggaggggccugcaggcugggugugucuggugcacagacccagacccugggcagcagacaggaagguggccugaggagaugcagggaacagacccaggucagggccacacaccgaguacugcgcggggggccccgcgggaacggagaagaggaacucucuccauagcgcauagggggccccggguagcccuggcccugacgugcagccauuggcgcaggccuggggguggcaggaggcguccagcggcaagcagauguuggcuccagggcaccagcgucccccuggcaugcacgcgggggccagcuggguccuguuguccggggaccugcucucaggcucgcugccguucuccggggucccugugaggaggggaggguguuggggcccugauuugcccacaggccaccgucagagaugcccaacugccugcaccagcaauccuggccuugcugugaggacaggucuccccaccugggcagcacucccagcccagugcugcguccgucuccggccagccgacugacccaggccggcccccaggcaggccccacccaauccacccccaggacaccuggaaugagcuggugucucuggaaccccugcucuguccaccuaagacugggaaccacucugguggccacaggaccagcagacgugaaagcucagagaggccaccccgaguccugcggcgcccaccacccaccacccaccacccagagucccaccugcugugcugaggagccgguacaccugcagccgcagcugggcgggccgccggagcuccugggucccaaauucggccguggugaggaaggcuucacggcucagacgcaggcccgggaauaccaugaccuggugggcagggggccgccucagcuccacagaccccaucccagccugaagcccagacucccccuacccgaacuucccaggaagaggggagggaaggagagcgagccaucagacccccacaggccuggcuccugucgcucgagaggaagacuccgguggaaacuguccauggggggcaggaccccugaccugccuuucaggaauaacucacacacgcucagagaaaaggccuggagguaaugugaguaaacgcuuuccucucugcacucuggauuuucccaaccaucuucacugggcacaagcaacauuaaggcccccaaguuuuuuggcgagacccacagugggcagggcaggcaaggccuccaggggcaggcaggagggcagguuguagaacguggggggccgacuaccuccacgggcucgugcggggcugagaggccguccugcugugccagaggcgucaggggucccugcagguccccacugggcgcucccacgaggagguucucggcauccugcacugggccugggguggcgagugcacagugaggcgccgggccagggcccaggacaccaggacgaacagacuggggaccgagccgcccgaaaacccccccaccagccccuccuccucagcccaggcuccaccgcgggcgcucggcaggccccuaaccacagccagcgucucaggccccugccuggccccccgcacaccuccgggcugcagcucgcagacguagcugugcggcgcugagcacaggucgguguuacaccacccggugggcccgagccggacgcagugcucggcuguggcuggguguggcuccccgggcagccaguucuggcagcucuccaggcugaaggccucgcccugcggcgcugggcccaccuccacccccugcacagucgagaagccgauccacacgucuaggcuccugggggcgggugugggauggcagggggcucagggcacuccuccauccucccacccucacagcagcccgcugggagccccaucacugucccccuuuccagauggggaaacugaggcucagagcccggagaccagggcccaccagcccaggcucacagcagcacccacccacggggccuguggguaccggcagggauccccgugcaggccaccucccguauggcgugcccaggaguguccggaggcugcccccagcucauguccaccucugcaucugcagagcugacaggaacggccccaccggccggcgccaccugcucaccagggccggcccagcucccaccuccuuccuccugagacuccccagccgcaggcucugccccagugcuucagagaucucccaaccuauggccccucggggggugggggcaggcaccuggugacccgggagaccaggaagcgcugcacggcgggacuguccaccauugccagggcggccccggcccaggccugacacugcuccugcgccugcagccaggccgccuucuccaccaccaggcgguagcagugcccguugccagggaagaucuccguguccgaggggcagagcgggugcaccgcuggagaccggugggaacgagggugucaacggucagugugggcccaagacggggguaccaggcucugccccaucuggauggcccuggggaggaaggggagugggcagcagacacucaccucgggccggcuccucgcccagggccacgaugcuguaggcggccuccaggccugaaccaccgcgguucuggaugcugaggucgaggcucucgucacucugcaccgaggacgggcacacgagcuccagggcggcaggugccgcuuccaccugcacgucuguccccagcagggcugagccggcccccagggccagcacggccgucacgugauagcgcccaggcagcacauagcgaugcgaggcagccggcccagcggcauccaccucggcggagccgucuccgaagucccagcguguggcagugacagggagcggggcagcgauguggaaggcugcuagcuggccagaggccagagguccguggggccccaccaggguggccccuggggaggcagggaagacgugcuggaggaggguggggccccuacaggugggggcaggagguggcggggggccggagcagagggacaggcaggcaaaggaggcacuggagggcugggccgccccacacaggcaccagcccugcuccgagagggcugcgaggcccuggccgguggagaagcagaaggcgcugcaggccucuggcugaagcaggccuucgugggcagcugaaaaggacacugcugccacggugccugagcuguugucagggaggcaggcgacauacuccucaccuagaagaggcagccacuggaccccggguucugcuccuccuggcuccaccccacgcccccacauccgcccgccgcacucacaggcucccaugcuguucccuuggcccggaggccccccccagagaggccuuccugagcccugcccagugucugcagggcccaggucccaccuggcugggaaggacagagcuggccccacccaccggcacucaccacagccacuguccagcaaggggaugccaagcagaggcuggccagccagggagccaggcccagcacacguggcugccucgggcugcaccacccgcaccugcugcuccuccgcccaucgcggcagccacgccaggccacagucacacucaaacggguucccacucagguuucugcagggcaggggcagguguuggggaccaggucuggugggaagggucuaugccagccccccacuggcaaccaggcccuggagccacccugacagcaccgccuccccugccccaaccaagccggcacuggggggcuccaagcaggcagugaacugcccccaggaucuggucucaagccuggaaggggacacggaccaacugggagggcagaagggauauugggggccugggguccagccaggaccccacccaaagaaccacaacuuacauuucacuuaaauuaaauaaauuagcaaauauuccuucuucuaacguagaaaucuuguuguugcuuauaucccuggaagagacgggggauucggcaaagcugauggaagcccccacagcugagcagcaagaggcggugccgccagcccacccggagugagccccgcaugcuggcacgacugggggacacucacagcucugccagcgccgagagguucgccaggagcccaacguccagcgcccggagcagguugugggagacgucucugaggagugaguggccgugggucagggccagagccccuaguaggccagaggccaucccugggcccaucccacacauugccagcauccccaagcuauggccucccacccuugagcuccccacucccagaggucaggaggggacuuucugauggaagacccaaaugaacacucaucuggggaaaccaagccaggagaggccugggggccucagcccucugcacccaucucagcccuaugccgagugccacauggaccuguccacccagggccaggaagggcacggacccccaacccaucccacgcagggccaaggccccccauccccuguccacagucccccacagagccaaggucucccaacccuguccacagcccccacacagacucgaggggcccccaucuccuguucugaacccaacaggguggucccacugugggaccacaaccagguaugacugugugagaagcaggcucacuaccaggcuaccagggagcacaggggagcaggcgccaccucgaggcauaaacccagagaaacaagaccuccaagacggccaggcacuggggcacacgccgguaacacagcaccgugggagcugagacggaaggaucgccugggcccaggauuuugaaaccacccugggcaacacagugagaccccguaucuacaaaaaauacacauuagccaggcauggcggcaugcgccuggggucccaaguacucgggagguagaggagagaaaaaucacuugagcccagagaggucaaggcuacagggagcugagaucgcaucacuguacuccagccugggugaaacggcgagacucuaccucaaaaauaaauaaauacauacauaauuaauaaauaaaacaucaaagaccagccgaccuaacuccaucuaaaauacacaacuucuacgcaaaauauaaauaaaauuagaaaacaaacuacaaucucagaaaagcacuagcaacuuacacgacauacuaaaggccaaaaauacccuccugacacacagcuaauaaagaaaacgucaacuauuccaguuaaaaagaagaaaaggaaacugggugugguggcuuaugccuguaaacccagugcuuugggaaggccaggaguuugagaccaggauggacagcauagcaagaccccaucucuacaaggaaaaaaagaaucagccaggcaugguaguguguaacuguaguuccagcuacucggggggcugaggaggaaggaucgcuugagccagggaagucgaggcugcagugagcuaugauugugccacugcaguccagccugggcgacagagcaagacccggucucgaaagaaaacaaagagaaagcaaggaaagaaagauggccgggcacgguggcucacuccuguaaugccagaacuuugggaggccaagguggguggaucaugagaucaagagaucgagaccauccuggccaacagggugaaacccugucucuacuaaaaaugcaaaaauuagccgggcauggcggcgggagccuguagugccagccacucaggaggcugaggcaggagaaucacgugaacccgggaggcgaagguugcagugagccaagaucacgccacugcaauccagccuggugacagagcgagacuccaucucaaaagaaaaaaaaaagaaaagaaaagaaagaaagggaggagagagagaagaaaaggagaaggggaaagagccgggugcaauggcuccugccuguaaucccagcacuuugggaggcugaggcgggcgcaucaccugaggucaggaguucaagaccagaccgaccaacacggagacacccugucucuaccaaaacuacagaauuagucgggcgugguggcaagcaccuguaauuccagcuacucaggaggcuuaggcaggagaaucacuugaacccgcgaggcagagguugcagugagcugagaucgcaccccugcacuccagcaccccauccugcaagagugaagcuccaucucaaaaaauaaaaauaaaaaaaaaaaggauggagggugagagggagggaggaaagaaagagaaaacuccaaaaacaaaaaaagaaaaaccaggcaauuagaagaagcacaauuggucacagccguaggaaaaacaucccaugucaguagucagugaagaaaaagcaacagaaaccacagggcggcagcaugucucucuuuucagagcugcccgaguuacaaaccagguccuggagcuggugaugcggaggugaguagacagagagcuggggcaaaccgagaacuccaccuccccucggccucaagcaccucgggggucacucugccgcccacccugggcaccccuccuggucccacgcacucccaguagugcuccuggcacaggacuauggcuccgcaggucugcacaccaccccccugcuccccaggaccccgaggccucaccuccugccacgggccucuacuuccccaggugucacccuccccacgagugacccagcaggugccuccgccuagacuugcucuucccagcaaugaccacccggcagccagccccaagccggggcggccuccaucccugaacacccgcccagccccugccagccuccagcccugcuccucccaccggagcuccgcucccacaggagccuacccggcgcaggagagacgcacacacaggcugcccgguggggcccggggccagggcaagagcuugagaagggaaccaacaaagaaggggaccagaggccaccccagcugaggggacagagcagccgaggccuucuccgugccaggaagcagcaccagccacggacgguggagccaggcccucaccugggcugggugcccagacagaugagacgcugggcacuggcucccggagcuucucguuccaucugcggauggagggcacgguugggggugcaguucccuucccccaggggcugugggacacucagagagccuaugccugugcccugggcuccgggaggggagaggaucugggggccaggcacacagggaacggccccuccggcagggccaccacuuccccccuaacugaacccugcuucucugccguccccuccucuacaccaagguagggacacgggcugaggugcuccccacugcccauaaggaugggugggcccacagccgcgcugcuaggcauccacaccauccccgccguggggugggacagggugguggcugggagaccagcaagaggccauucucgagacagggugaggcagcuggacucacacccacugcccaagcaccaugcccgagggggaacacugugccgugaggaacugcaguuagaccugaggagggacuuuccagcggcugcggcggcagcagaaccaaugcuuuagggagaaaugaggcaccgggacccgaggcgcaggagcccuaaggggcgagaggugcugcagaggccacggugaacacaggcaggcccccuggaagggacacagcugugaaacugccccagggaggggcacaggcucucgcaccugcccccaggcauggggagcagcucccacccaggccacgggagaaaggaaagaaggaaaagccugaagauguuuggccacaccucauuuucuggaaaauccaucaagaguggcugcugcugggagcugacaagccagggcaggggugggggcaggucagccgaggaccccagagccccccggcuccccgcccaucccacugugaaccaggccugggggugccauggacacuucuuccacgccagcaggcagcccugccugucaccgguucuggccaugcacucccugcgugccaggcuccaggcuggcuccuucucccggcccucaccccagcccaaggcccagaaaugcagcaaggucuuggggaccccgcucggccgagcucccagggcccagggcaguggaaugaagcuggggcccagacaggagccaggugcagucccccagcccccaggguguggaagcgucugcccuggguaggacucaggugcccccuggguguggaagcaucugcccugggcaggacucaggugugggcuucagggacagggaacagcacagggguccccguggaguccucaccucgcuugcucccguacuuuuucacgucuccaucugcuuuugccaucgccguucugggggaacgccaaggccuagccaggcagccucgcgccagcccccccaccccgccccucgggcuuccucugcacccgccaggugacaucaucgccgcugucugaugcccugcccccacguucugguucccugcaaggaugggggacacagcagggcccaggcaucuggcagcaggaccaccgagcggcccuaagcccaggcaagagcacagagcagagugcaggguccucuggggucccaggcccuugcugccccacgcacuccucaccccaguuccugcuaugagcuggaagggugggagccaggugcacagggacagccugaugggugcccgagggccaggaugugcucccagggaagcugaagccaagcuugucgggaggaguacacccccauggggggcaggacggugccccagccccgggacacaagggguccccagcgccgagcguccgaucuggaaggcgggaggaguuaggaccauccuagcgugggacccagcgggcuccuuagcggcugcuggggcaccacuggguggagaaggaagucccagguguguggccacaguacgggucuucaccccuucccagcacccuugccaauccuggagcaggagcagcaacagcagaggguguggccaggccuggaggcugccccuccacacccgucacagguggggccacgucccagggcugugggcagcagggccagccugccggcccgagguagcugacacgugucucaugcugcagcgggucugcccgccacccgggcgugugaaccccaggucgggcccccucgcccuggagccucggccccucagggguguucccagccaggcgcuggcucuccugcccucccccugggcucugcccacaguuggcgcgagggugggugaagccugaggcuggcagggccgggaagucuuggggcugggccuucugccccacaggcgcuccugggccgggggagccggggucggggaaugcaacagugggacugaggagaacuucccuggguguggggcagcucccggggcccucccaauccacagcagagggaauggccccagacaaaccagaccugccucagagucucacacucagagcugagugccccaggcgcccacuccccagaccagaugcugaguggggucugggggccggacggagcccccaaagaaacaucugcacauuccagacacguguggucagcagcgggugugcgccaggcccggcacccccgcccgcgcuggccgccucacuggaaacugggcuggggggaccggcucggaggggccgccugcggagcuuauguaaccgcuccucccucggcaggggcaggacaggacgccagacccagggaggccccaugcccccugccaggccccguccucuccuggaggagcugguuccccuccgcccagcaagaggacccccaggcccgucccucccgagagcaggcccagggugaggaaaugggcugcagugugggcgcuggagaggacaggggacaggcggcagugccacccccacugcggccccuuccucgcugggccagccgagccaugaccucaucuguuucccucugcgcugugcuccuuucuauuuaaggagagugaggcggcuuccagggccggaaaugauccuguuuaaauuaacgggcugcaguuugggacggugcucauuugaaaaaaaacagugcagccccgggcugggcagauggcugcuggcuccgccuaccacuuccauggggagggccagggaggccggccacaacccuggccccacgagggguggggguggcagccucugauacaggacgaggcugccaggccccaagcaacagagcccugcacgagggucucugggucccagacacggggugugagacuagcuggggagccccaggcucagcggcauucuguccuuacagaucccucccacggcugaacuguccccaggaugagaugccgggggugacaugggcagccucagguccucccgggacccacaggcaggcacagggauggagacuccggccucggaggcugaacgagggagaugagaaaggggagucugcgauguccuugccuacacagauggaaaaacacagccagcucaaaaagggccgucuggagacgagcccaccugugggguguaggaaggagagcgcuucauacguaugcuaccugccgcuggggucggggccacccuuccaguucaaggggagaaugagggccggcuccuggugccccugcacgcagcugacauggagccaggcguugugacccccuugcaucccucuccacucccacccuucacagccugugugggcaggugcugcacugaccuuacgcuccugaugggcacacugaggcucaaggggcccuccuccucccccaacaccaucccccaaacaccuccccgggcagccagcaggguccagugugucaauggaggaagccaagguaggaagaggauggugggggggggggcaagcaaacuggccaucugcgcccggcugugcgggcacagcagugcccuggagagggcagcagcacagauccagcggggcagccggaaucccaucacccacucggcugugggcacagccaaugaugguacgagccauccugaggccagggccacgaugcacaguggacgggcucagaacccggagccccuguacucccacagcugugacguucccugggcaugggcuugccccagcgcuggccucauuccugccucaaccagaaggaagagcuggcuuccgccucugccugggcacaaagcccuuucugagguggccucacagaagccagccugucuucagaucauggcgcugcuaaggucaggaaugccaggcugggccagggcugggccucgggagcugcagggagaaaaggacccagcccgccucagccccagauguagcccuucuccugccaccagugccugggcacccuggccccuaggcaaggacagcugccaagccaugaagagcgagguguucugggaaagggcgugagcugcauuuuccagcugcgcucacucugcagggagacuguggcgcccccgcugcugugcccgcagacgugcccggccucagccagcuggagcgcaggcagcagagugcaggccaggcccagacagcagcgggauguuuucauuccagggugcuuggcgggcugggcugccguggccacugcagagcuccagaaaagaacaugugugucucccuccaaaguauauuccuugcuggaaagcagaucccaggcagggucucccccacgagcagggggagaggcaccccaaggugggggagcgagggcaguggcagaaccaccccauacccuaggggacccagggaggggcuugcagaugcgggacccacauuuggcagcggugcccggccacugucaccagaugguggccagcgcaucacccacucaugggccaggauggcagaggagauccacagagacggcuccagcaggaggcccucauagagaugcccuggccucagaagagccaacagaaagccgggaagggggacgucgaggcucaggcuuggcacaaccuccccaaagcucccaaagacucucggugcccaccagcgacagcgcacaccgccaccaccuaacagcaagaaugcagcgggguccgcacaucagggcgggcacugagcggaacucaggcagugccacucgccagcuuacgucaaaagaacaaaaggagugaggacgguacucgcggcucugccaacacuucccagccccgcacgucucacacacaccagaacgcgucaaaaggcaccaaugggcaaacacccagauguaggcacaagcaggagugggccgggucuugugagcccccacagccacgcggcccugcgcugaaggcaccgaggcugggugcugagggguccauaggaguccacccgcccaggcugcacuggcucccgucguccagugucuggucuaagcacaggcacagugucuggcucucacccucaggcuguuacacucugcucuguggcagggcaggucucacagugcauggaggacaggggaaugggcccccggaaccccugagggaaccgacagagcuacuuuaacaagguaugauuguuggggcugccaguggcugagccaggucacugcuacacugcccugcagggugcaucuaaucauggagcccacuuuacaggugaggaaacugaggcugagagacuggaccaaggucacaccagagguggaggcgcugggacgugaacccaggucugacuccagggcgcaaauucccuacaucuggguucccagccuccuuccugaaacugaacaggaaacuagagagaagggacacagcagggaugagccagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagggagggagaggugggaggggcuggcagcacccaagcagcugcaccugggcgcagggccccucagccccucggggagugcaagcacaucgcagcccgacucggaagcgccacugccaccucugucugucuauaaaccagggcacuagugugggccccaggcacccugugcggcugcaggggucugccccagagcaugcugaugaaaucaucaccacggcuucucaaagagccucaauuuccugguguguaaaaugagaccaggaguggcugcaacccugcggugccgugaugagguauggagagacaagaacacagagggcucagcgcggagcccggcguggccaccgcggggagagggugcggacucuuccuagaccuuuucuuuuugagacagaguuucacucugucucccaggcuggagugcaauggugcaaucuugccucacugcgaccucugccucccagguucaagcgauucuccugccucagcccccaaaguagcugagacuacaggcaugcgccaccacgcucagcauuuuuuuuuuuugagacagagucucgcucuguugaccaggcuagagugcaguggugugauauuggcucacugcaaccuccgccucccggguucaagugauucuccugccucagccuccuaauuagcugggauuacaggcgcccacgaccacaccucgcuaauuuuuguauuuuuaguagaacgggguuucaccauguuggucaggcuggucacaaacuccugaccuugugauccccccaccuuggccucccaaagugcugagauuacaggcgugaaccaccgcgcccacccuguuuuuuuuuuuuuuuuuuaaagaccguuuccuagucgcccaggcuggagugcaguggcaccaucacagcuaacugcagucucaaccucauagacucagggaauccuccccccucagccucccaacuagcugggacuacaggcgccaccacuaauaucuauuuauuggucucgcuauguugcccaggcuggccucaaacuccuggccucaagccaucugcucuccuaaagugcugggauuacaggcgugaggcaccgcgcccggcuggacagugguuuugauuuacguuucccucaugacuaaugaggccgaccaucuucucacacgcuguuggccaucugugcgucuucuuuggagaaaucucuguucagauccugugauuuuuuuuuuuuuuuuuuuuuuuuuuugagacagggucuugcucugugacccagccuggagugcaguggugugaucacagcucacugcagccuugaccuccucggcucaagugaugucccaccucagucuccugaauagcugggaccacagaugcauaccaccacgcccggccaauguucuuuuauuuuuuagagaccggggucucacccuguugcccaggcuggugucaaacuccugggcucaagcgauccacccacccuggccucccaaacugcugggauuccaggcgugagugaccccuuguccauguuuaaacggggucccugucuguuguugaaucauaguguucccuguaugaucuggaugcaagccgauacugcauggaugaccugcaggugcucucugucuccacagucgccucugcagugggagcucgggugccccacauucccaacugcugcagacacaaccaaagccuccccaucccuucccccaccccugccggcaaucgcguacaggagugagcgugugacuucuuguccacauuuuuguccacaaguuuggcgaguuugcauccgcgucuaauaaagaaacuaccguuucucacgcaggcacguucugaacgcccgagugcgggagccacguaagacccggcucagggaccccgggugaggccagcuggacaugcaggaugcagguccucaccacugccuccgcucggcugccagggcucuuccuagaagacacaggccucuccuaggcucuccugacagaggcccuaccccugcccccgagucaccuugccccuuggggacucucucugggcagcucccugugggagcuuugaaaccuggcuucaaugucaccugcacuggggguccuuccaggccagcccccuccccaucauccaucucuguccuuggagaaucaucugcguguugguugaacgcgggcuccagugauaacggagcccucgaggguggcccuccuucugcugagggcucauggaggccuuggugacaaucccuaguccucgcucucaggauccagggaccagaaaugggagccaggggccccuccguggccuggccagccccccaaggaagcugugucucuggcaguugcgcucuaaggcaucaggccuaggggucgcuccagaaugccugucuuccccgacgccaaucccaggcaggggccccggggucugcgccugcugucccuacacucucccacacucuccugucauucagggaugcaggugggaaagggcaaggccccgggugcuccuauauuuuacaucagugaaccaagcaccuaccaagucccucgaugugcccaguccuggaccccagcauuugcgagacagcagcagacccaggugacccccagccagggugaguggcaaccagcaccagaaguggccuuuagagcagggggcccugagcugaugacaucuacaccuaggccagugccagccaggacaaccucugggacaaugggaugucggcuccaacgaccaauuuacaagaaacacaaagcacacacucacagcaccacggaggugacaccauggagguggcacccccaagacacagcgagaaauccaggcugcaggagccaguuucuucaacaaauugcacaaggaaaaagagaggaagggaagcuccuagacaucaucggacauuuaaaagacaggcgguggcucaagccuguaaucccagcacuuugggaggcugaggcgggaggaucacgaggucaggagauccagaccauccuggcuaacacggugaaaccccgucucuacuaaaaauacaaaaaauuagcugggcaugguggcgggcaccaguccaggcuacucaggaggcugaggcaggagaauggcgugaacccaggaggcggagcuugcagugagcugagauggcacugcugcacuccagccugggcaacagagugagacuccaucucaaauaauaaaaauaaauaaauaaauaaauaaauaaaauacaucacucacaccuguaaucccagcacuuugggaggccgaggcaagcagaucaccuaaggccaagaguucaagaccagccugaccaacauggugaaaccccaucucuacuaaaaauauuuuuaaaaauuagccgggcgugguggcgcgcgccucuaaucccagcuacucaggaggcugaggcaggagaaucgcuugaacccgggagauggaggcugcagugagccgagaucacaccauuguccuccagccugggugacagagccagacuccgucucaaacaaaacaaaacaaaagacaucagcuagcugguccaagcacagugguguucacaacgaauugaucacagccagguagaauucuucauucuuucuccaguccuacugcuuugcuugaccagccuuaaagacacacauauauuuuugucugggcgcguuggcucacaccuguaaucccaacacuuugggaggccaaggcaggcggaucaccugaggucaggaguuugagaccagccugaccaacguggagaaaccccgucucuccuaaaaauacaaaauuagccaggcaugguggcacaugccuguaaucccagcuacuggagaggcugaggcaggagaaucacuugaacccgggaggcggagguugccgugaggugagaucgcgccacugcacuccagccugggcaacaagagcgaaacuccgucucaaaaaaaaaaaaaaaguauauauuuuuaaaagacauuggccgggugcgguggcucacgccuguaaucccagcacuuugggaggccgaggugggcagaucacgaggucaggagaucgagaccauccuggccaacacaguaaaaccccgucucuacuaaaaauacaaaaauuagcugggcacgguggugcaugccuguaaacccagcuaccagguacucgggaggcugaggcaggagaaucgcuugaaccagggagucggagguugcggugagcugagaucaugccacugcacugcggccuggagacaagagcaagacuccgucucaaaaaaaaaaaaaaaaagaaaaaaaaaaagacaucaacuaauugcaguguguggaccuuauuuggcucuuaauucaaacuauuaaaccaaaaaugugaacacaccaggccuucgguggcaugaaggaacugucuguuguguuaggugggucugcaguauugcgaugcccuccaaaaugcuugcagauaaaaggguggcuggaauuugguucaaaacaugggucagggcugggcgugguggcucaugccuguaaucccagcacuuugggaggccgaggcgggcggaucaucugaggucaggaguucaagaccagccugaccaauauggagaaacccugucucuacuaaaaauacaaaauuagccaggcaugguggugcacgccuguaaucccagcuacucgggaggcugaggcaggaaaaagcgcuugaacccaggaggcggagguugccaugagccgagaucgugccauugcacuccagccuuggcaacaagagugaacucugucucaaaaaaaaaaaaaaaaaaaaaaaacacaugggucaggagggagaagggucggggcagggagggcagggcaggcucugggguggggggucugugagucagccacggcucugcccacgucuccccacgaagcuucgagccacgcagagcagcacguuuugcaguacgccaucuuuuccaaaagccaccaccucucggcagcaucauuaacccaaggcaggcuguggccucagaagccccggcuguccuccaccuggaacuggacacagcugucccugcugagcuucagcagccagggagccacaaguggagaggcaccugcgugagccccccaggaaggcuacuggugacacccagacagcaacgcucuuggacccuugaacaccugccagcagcugugaucuguguccuucaccucucccagcuugaccccucuucccuggggaaaacccagccgucuccccgaggaggaguuugcaggguagacagcaaaauggcugggcugccccacagcacagaggguggccuggggggccagccagggccuucacauccuuccuaaggcccuaguuugccauggguccccucaccccaccuuccagaacucucccagcggcggccccagguguguacagaacagcacccaccugcccacaugaggucacccugugcccuguugcacacuuggggggccuggcauucggaaucuugccagcucaggcugggacaggccaccaacucccagggucccccuccuccaaaccccaggaccagagccuaagaggacaacacaaggcaggggcgggggcuccacugcugugccaagggccuggagaacacgggccuugcucuccgcucagcagccaccagcgcccuucucucccggacagcuccugaggggcugcucucauggacaccaucaggugcugggaagcaggaaccaccaggcccuggacagaguccccagugaccggccuggcagacagaggagcccucagcuacagcaucacaaacaacgggugggguaggucugaugcaauucugugggugcuguugccaggcaggaggaggccaucuccacagagacagccgcgagacacacgcguccgcagucagggagcgcaggagcaauguggccccgaggggcacgggcuccauugguccaggagaacccauucuucucccacccucgagaccacccagcaaagccccaaggacacacggcuccccuaaggaaggguggccacaggcgggagugacccagaaacguuacaaaaccaaaugccagaacccacccaauguuuagcaagccuggggaugugccacgucccccagggauccagcacgcacccaaggagacacugucccggcgaggagccuggagccugggaaauacaaggcaucagacuggucccaagacucuccccagcgcuggggacaacugucugcuuaucuuaguccccuccgcccuuuucaauccaacccuggguccugggcaccucauaguuccaaaccccugcuaugcacaucccggcugugaugccugggacaggucgugucaccucuccaaaccuguuuccucaucugugaaaugcaaaucuccacggucccuaugccucggauggucagagucaggauuccgcaugacgacccccaacaggagccuggcacagaccuggcucugggcagcgucuccauaaaggccaccuguuguuuuuaucucccgaaagcgaacaugacaaggcuuuaaccccccacggcaauccccccucaccccuguucucaggauagccuuggaacccaauagcagagcgccugaggcccuucaugaccccagcccacccgcgagcccaccucccacccugccccuaccccucacaccucccguggccagccuccagccucacggucuuugcucacaccguucaccccccuucuucuggacccaccucaucgccccuuccuaagcaucagcccaauucuugcacauccaucaaauccuuuuccagacaccuccuggaacucuucccugccgcccccuacagccauccccaccucuccggguaccccgcagccccaggccgcaucccaauuccucuccaauuagcgacuguuuguccucccagcugagcgcggccuccgcgccccgcccccgcuggcgucugcagagcccccgggugggacgucugucuccagacccgggguuuuucggcuccccggggccgugccaaccgcggcuccaggcguuccuuauuuagcagggccgccgugccgcgccggagccucgcccugggagcguccuggcccgcguccugcuucccgucccgggccagggaacgcgcccacgcccgcccgucccgcggccucucccgggugccgcugggcccgcuacucacagcgcuguggcguccgcggggaugcgcagcgcgggaccgagcguccgcagcccgcggcccgagcaguugacgcggcaggcggcgccgggcgcugggccgcagaggcaggggggcucgcagggcccgcagccgcgcccggggccccccgccagcgccccgagccacaggcccaggcccagggccagcgccaggcgggcgggcgcggcgggcggcaucguuagggcagcgcgcgcauggccccgccguccccaggcccgcccgcgcgcggaggccgcagcucaggcggggcccgcggacggcauggcgggcgcggggcuggauggggcugcggccgcgaccugcugcugagcgacgcccgcucggggcucggggccaggccgcuccgggagcucggccgcccgcucggacgcuggcgcugcagugcgggccccgccgcggcuccuccuccuccuccccgcgcggcgcggggcggacggggcgagggggggcggggcgggugcaggcuccgcccccuucgccacagcgcgaccgggccagcgau

SEQ ID NO: 21547 - RNA, 7694 nt, Homo sapiens
ggagccgggugccgcuggcaccucuaugaucacuggagucucgcgggucccucgggcugcacagggacaaguaaaggcuacauccagaugccgggaaugcacugacgcccauuccuggaaacugggcucccacucagccccugggagcagcagccgccagccccucgggaccuccaucuccacccugcugagccacccggguugggccaggaucccggcagguaagcuggaagggucuuguccauccucccagaucucagcagccccagccccaggguggggcagggagccugccgggagccggguggggaaggggaagcucaaggcuucccugggcaggucugccgccccggcuggggaccugauccugccaugccugccucuggcugccccucacagcuuccccucuuggcccagcccuggaugccggagaacuguaagaacuggguccuuuaacagucugggagaugggaguggaggucagagccaaggucaagggcagagagagaacuuucucagcgcuugcugcugcccaacaucccuagacuggguccagggccuggccaggcauguaucccugggcaacauucaucggggcccagcaagcccaggaagucggggguggcuccccucaccgggaauuuaggccacuuggaugggggaggcagagcuaggccugagucagcauagguugcuggccuugguggguguucugaggcucuaccugcuccccucggaagccugggguguugguagagggaguuggaggugcagucagcauccuccagcccuacuguccugggggugccggguccuggagacuggggaagaaggaaggccaucuuauguaaggagcuacggggggugggaggcaagcaaaacucuuuuuuuuuguuuuuugaaauggagucucgcucuguugcccaggcuggagugcaguggcgcaaucucggcugaccgcaaccuccgccuccaagguucaagcgauucuccugccucagccucccgaguagcugggacuacaggcgcacgccaccaugcccagcuaauuuuuguauuuuuaguagagaugggguuucauuauguuggccaagcuggucuugaacuucugaccucgugggccacuaugcccggcugcaaaguucuguuuuaacaaggccuugccccuagagguggaggagaggaaggucugccuucacccugucccuguccggcagaucgaggaggaguggggagcugggugagggcacaggugguccagcccuccuccaccccuucuugagagcucuuggggcacuuucgaaaacacucccaggccuagcggaaggagggugggcgaagguccccaggcccugggcgguggggguggggcugugugcuuggcccaggguggggcugcacacccccucccucugggauaggaggagggcgcucuccuucugagggcuggaggcugccuggggaaauggggcucugggaggggugcaaacugaaagugaaacagcugacauccaggaaacacucgcccugaugaggggucacagcagguuggggcugcggucaggaccaggcaaagaggaaaauuggggccggggacagaagaccagguguguggugggaguacgaggcagguuauggggcuucaaagaaggcccugauccugagggcucccuccggucacugcaaggcagcaguggggaaggcacagacaggagguaaauagggaaaguugcccugagaaagaacacacucugagguccacaaacuggaaaagaaaucuugcaugcguguugaguacauggacucacggagauucagacaaacaaccugacuuuccgugacuaacgaugugaccucgggcacucaacucuuugugccucacuuuuccugccuguaaaguggguaugauggcgcucacccugcuggguucaugugaguuuccaguguucaccacccacagagugcuccuaagugggagaguauaucuuaggcucucaggaaauguuugcggcuaacagcccagaguuaaaaaacagguguguucuggccagccagagggaaguagggccucugaggacagccuucaugggccauuggcugggcaguggcucgcuugcaauaagcaugugcugggugggcugcaggaggccccaggaacagcuaaaaaccccccaggcucuugccccaggaguggcaugaacuugagagccagcgggcacugcugcagccacacccuccucgauggugcagauaccucagucugcccuuggcugccucaccuucuuacccugucucccucaaagagggaguguucaguaaguuguuuccucccagcagacuucacugggacccaugcuggaguaagaauaaaaagucccagaggaggccaggcacgguggcucacaccuguaaucccagcacuguggauggccgaggcagacucacgaggucaggaguuugagaccggccuggccaaagucccagaggacuaagggccuuucugggaaugggggauccucucuccuauguggacauggcaaccuguaugggguccccagucacaggucugugcucacccccaucucugcuuuuucucgcccuuccccgcaggcugaucccguccuccacugagaccugaaaaauggcuucggggcaaggcccagguccucccaggcaggagugcggagagccugcccugcccucugcuucugguaagggucuuccugcccccucacccaucccauaaccaugagugcugucgugaggauggaaggagcaggacucaggcaggcuccuucgccucgguucacccacuguggguggggaauacucuuccccacccacgggcucagaggcuggagcugcugucaagguuaagcccaggagggggaggagucuggacuggggagggccuggagguugggagaggccaggaagugaguguaagguaggcacagugccaccggggcagagggcugggucacgggcgagggaggcaggaauuagaguggggccuggcugcuguaucccuccagcgggagaaauaaggaaguaagcuggccaaucacccagucaggucugcucaacagggaacgcaauuauugugacuuggggaggaaguaagauggcugcccuccuucccucuucccaggggauagccagggaagccccagcucacaccucacggcgggcuguucccuggacuugggaaucaggucccaggucugucacuaucucccugugugacuuuucugggccgcagcuacaaauucagauuuuguuucccacauuucccugcacgcaaagggcugcggagcugagauguacuaauguagacucaggaccccaaaugcccgggacugucccgguuccccggcuuguucuggcuguaugaccuugcacacguuacucagacacccugugccauuuucccccugccagcuggggauugccugcucccagggcuacugugaggacucaaugcaagugccggaacaacucuccacacagcauaagcucuaggggcggcuaaggugcugaaguagggauauuucuuuucuuuuuuuuuuuuuuguuuuuuuuguuguuguuguuuuguuuuguuuuguuuuuugagauggagucucgcucuauugcccaggcuggagugcaguggcgugaucuaggcucacugcaagcuccaacucccggguucacgccauucuccugccucagccucccgaguagcugggacuacaggcgccucccaccacgccuggcuaauuuuuuguauuuuguuuaguagagacgggguuucaccauguuagccaggauggucucaaucuccugaccucgugauccgcccgccuuggccucccaaagugcugggauuacaggcaugagccaccacacccggccauuuuuuuuuuuuuuuugagacagaguuucgcucuuguugccuaggcuggagugcaguggcacgaucuccgcucaccgcaaccuccgccucccggggucaaguaauucuccugccucagccucuucuugaguaggugggauuacaggcaugugccaccacacccggcuaauuuuguauuuuuaguagagacagaguuucuccauguuggucaggcuggucuugaacucccgaccucaggugaucugcccaccucggccucccaaagugcugggauuauaggcgugagccaccgcaccugguugggauauuucuuuccaugggugaggacagcuauggccuuaggaagagugaauccccuauaaggcauggggcugccaggguucggcccucucucccugacucccagcuuugauccucagaggagcagguagcccaggacacagaggagguuuuccgcagcuacguuuuuuaccgccaucagcaggaacaggaggcugaagggguggcugccccugccgacccagagauggucaccuuaccucugcaaccuagcaggugagcuacaaccgcugggcccacaaggacaucuucagggaggcaguagcucgcaugggucucugugcagguccugggagcuggggaggccucgggggucuugcccuucucucaugguugcuccucuuuuauguugggcucccacccccauccaggaccuuguauccuuuuuagcccaugccugccccuucuccuggagcccagcacucaugucuuagaacacugucagggaccuccaagaagggaugcacagggccauggacagcucaggcagaaccccucugccaugagccagggccuggucccgacugccugguuacuggcucaccugcaugccuccugcuccuacagcaccauggggcaggugggacggcagcucgccaucaucggggacgacaucaaccgacgcuaugacucagaguuccagaccauguugcagcaccugcagcccacggcagagaaugccuaugaguacuucaccaagauugccaccagguaccccagccaccucccugccagcuccagucacuccucugucaugucacaaccauaccauacccugccugcaugaugcucuccuggcauggggagaagccuucugucaguguccaaugucugcugugaacucacauguggucucggcccccuauuuuucucuuucggggucccagacuuguauuuugggcauuagcucacagcucuuuugagcucugacuccaaggucuugacugguuagaucaggacucuagagggggccugagguggggacgucccccacagcuccccagcccagcugggacauagcuguccuucauaguuccaauuugaaaccacauaucacacugaagauggugagggugcuaaccucugccagguccuagaaauggcuccuacuugcuauaaucuggcauccaagugguuaaagacaccgaauauuugggugcaaauccaagcuuugccacuuacugccuucgugaagcuuccuagcccuuagucuccugguuuguaaaauagggaaaauaugcuuagauuaguguccaccuuacaaaguguuagccauugcuaccaccagaguuagggaagucagugucggaguagauuugaaacuggaggugaagguaggaguaagugauagauuuuagaauuagugcucagagcugaaauauccaguccgugaacuuagaggccagccuucauaccacugugaugacaggaacuacccuaaucuuuucuguccuuuucucucugcugucccucgggcugccaggccagcagcaacacccacagguaaucuccccgcugacuccauccacuugcucugcccucugcccucucugugccccguugcaccugagcguacaccccagcaguggcauccagcucaucugccccugagcuuucuccuuucgcagagacccagguuguucccaaauacaggccagguuggggcagccucugcggccuuaauucacagcuaagcuauuuagcuuccagcugggagaggggugggagaggccaggcaggcugaagggcuuccugggggcucuccaccaaugcuaugggaugcucugcccacagccuguuugagaguggcaucaauuggggccgugugguggcucuucugggcuucggcuaccgucuggcccuacacgucuaccagcauggccugacuggcuuccuaggccaggugacccgcuucguggucgacuucaugcugcaucacugcauugcccgguggauugcacagagggguggcugggugaguauccaaggacugcaauguccucccugcuguuggggcugccccucucccaggccccaccccuuccucggguuccuauaucuucugcuagccucucugugaccaccuuguuucucccggcagguggcagcccugaacuugggcaauggucccauccugaacgugcuggugguucugggugugguucuguugggccaguuugugguacgaagauucuucaaaucaugacucccaagggugcccuuuggggucccgguucagaccccugccuggacuuaagcgaagucuuugccuucucuguucccuugcagggguccccccucaagaguacagaagcuuuagcaagugugcacuccagcuucggagggccccugcgugggggccagucaggcugcagaggcaccucaacauugcauggugcuagugggcccucucucugggcccaggggcuguggccgucuccucccucagcucucugggaccuccuuagcccugucugcuaggcgcuggggagacugauaacuuggggaggcaagagacugggagccacuucuccccagaaaguguuuaacgguuuuagcuuuuuauaauacccuugugagagcccauucccaccauucuaccugaggccaggacgucugggguguggggauuggugggucuauguuccccaggauucagcuauucuggaagaucagcacccuaagagaugggacuaggaccugagccugguccuggccgucccuaagcaugugucccaggagcaggaccuacuaggagaggggggccaagguccugcucaacucuaccccugcucccauuccucccuccggccauacugccuuugcaguuggacucucagggauucugggcuugggguguggggugggguggagucgcagaccagagcugucugaacucacgugucagaagccuccaagccugccucccaagguccucucaguucucucccuuccucucuccuuauagacacuugcucccaacccauucacuacaggugaaggcucucacccccaucccugggggccuugggugaguggccugcuaaggcuccuccuugcccagacuacagggcuuaggacuugguuuguuauaucagggaaaaggaguagggaguucaucuggaggguucuaagugggagaaggacuaucaacaccacuaggaaucccagaggugggauccucccucauggcucuggcacaguguaauccagggguguagaugggggaacugugaauacuugaacucuguucccccacccuccaugcuccucaccugucuaggucuccucaggguggggggugacagugccuucucuauugggcacagccuagggucuugggggucaggggggagaaguucuugauucagccaaaugcagggaggggaggcagauggagcccauaggccacccccuauccucugaguguuuggaaauaaacugugcaauccccuca

SEQ ID NO: 21548 - RNA, 10822 nt, Homo sapiens
agucacuaagaaucauuuauugagcaccugcuguauauucagcauugugggaggagcugugaaagacacagaacaguacaggguguggucccugcccucgagagguuuacagucuagguggagaaacgggaaccaggacacauggggagccgagagaaaacaguccaggccaguauguuacaggagcuggaagguguuuggggucagaccccaauacuccaaguacacuaagcacuucagugccuccaggggcucaacguuagugccaggaaagacaacuacucccagccccauaugagcccacguggcaugcccuguccauagccucuacugccaccaucuuaaaaugucugacuccuuguuccgcugcuaaucaaagugcaaugaacuggggagggaugggguggaugaggaaggucgcuggacgauuugaggggccagugucucccuccuagaaagaucuacucccccaucauauaccccuaacacagagauaaccccacucaagggggccugugccaccacaugggacccucacccccacagcuagaggagggggcggucgcugcuugagcugccugagguagaacuagggugcccuucuucuugugugucccuuccccuuccaguccauugagcugggggugggggugggacaggcaccucagagccaccuggagcugagaggguacugaagggaaaggacaagggggagggacagcagcagaggggaauugcagagcccagcuggagaaaaaggguagcuggggcuccucaaaagguacaggggagccaaagagggaaaaggcucaacacugagacgggcuccccagugcaggucagaggggccaugagggcaggcgggguggucugcuccaggaccccaccuucccccugccuucacaagacagagggggguaucaagagccaggaggguaccagguccccagcucagcccuaggcugugcucacuucagggucacccugcccaaccuuagaggaggugaggggacuccaaaguuuuugaugaugcccccacucggugaggccccuucaaagugccaucuguuuacuucucaaaugaaaaagaauucaggucugaguguccaggaaagggggugaauuucauaaccgccugugacagcgaugggaaggagccacaccccuccagaggguaccacccagcggacaaguggggaggaggaaguagcuggcaugaagccggcccacccaaccuccgggagagaggaaaaggagaacacgggaugaggaggcuuuaaauaguauuucauaaaauaaaaaugcccagcacucuuaggaaccucucauucaaccgccuaguuuuuguuuaaauaauucuaaugccagaggcuggggggcagggggcggccaggguauguacaugaggagguguuuaaauuaaaacacaaauaauaauuaagacacacaaacugagacuaaggcagaagauguagagcgggccuuugaggcccucgcgcuuccaggacugcaggcuuccugugggcggauuagggcuuccucuuggagaagaucagccggcguuuggagugguagaaaucugaggagagacagcagaagucagccaggccaagaagaagaggacgcggcggagcugcccaacugaggaagacaguggggggccaggacacccuucccuggggccaauggggccgacugcugagaacaggaagaacucggggaacguccacucugucucuugagggguauuauggagugucccaccaugcuucacagaugugauuuuauccaucaccgcacccgcacccaugggucugcucuaagucaagcugcccagcagaggaaccacuacuagcucugugugcuuguuuaaacagacuacaaucaaauaaaaugaacaauucaguuccucagucacaugagcugugugucaaaugcacaacagccguauguggcucguggccccuguaccggacacucccaucccugcagaguuacuggacagugcugaucuagggauucuguuacaaaauccaugaaaguguucagcacaaugccgggcccauauaaacgucaguaguuguuguuauuauaauuagucuugacccaacggcaaauucacuuugagaccuuagauaaaucacucuaccucucugagccugguuuccuugcccuaaaaggauggcaaggggcugggcaugguggcucacgccuguaaucacaacacuuugggaggcugaggcaggaggacugcuugagcucaggaguucaagaccagcccgggcaacauggugagaccuugucucuacaaaaacucaaaaaauuaaccgggcguagugguguacaacuauagucccagcuucccagcuacccaggaggcugagguaggaagaucgcuugagcccaggaguuugaagcugcagugagccaugaucguaucacugcacuccagucuggccaacagaguuaagacaccugucucaaaaagaaaggcgggcagggugacaagaaugucuuauguuauaacauugcuauaaggacuaaauaaaucuaccuuagaagcuuggcaaagggccuggcauaaugaacauucccaauaaauguuagcuaguuggucuuugcugccuacuugcugugugaccucagggagguugcuuccccucucugggccuguuuccuucuaccuggagcaugcuggaccaggaccagacaggucagcccuuggaccauggauucugagaauccuggucccuuacaaaguccuuccgugcacauguccgcaccugucaugcuggucugccgccguuuucgacccugagagucuccagguccaccuggggacccuucagccugcuccccugagcgaggcacaaggguacaagacagugacagguccacauggucuuccucugcuguccccugcagcagagcaggugaggugccaggccgccugccuccucccaacucaucccggccucgccggggccccgugggaagguagagcuugggcaggccaaggccccgcacacgcucccaggcgaagucacccuccaguggugucucggugacaaagucgaaguuccaucgcucacgggccuccuggaugcagcccgccauuagcgcaucacagucgcggcucagcugcucgcuguccacugggccgaagaggcggcggcaggccuugcugccgcauggguucugacggacauccccagccgguucugacauggcgccugcagcagagauacaaggaaggcccuggucacggcggagauuagacacuauguuaccuggccgggcuuugcugugucaccucaggugacgucuuccuaccagagggucucucucacuccuuccagcuggucuuccugcuuccuucccacaggaggccugacccccaccagcagagcucagccagccuggcacaccaaggucacugggagagcaggcaacugaagggcaagcuaaugucaacaaaggcaagucuauugcaagagcaaggaccaggguccuguuugccaccagguauuaucagcuaaaaucaauuuguuuuccccccagaggugucccucaugggugugaaugccccccaaauaugugugaauugccagaguccagcaguuuccuaaucgcagcccuggccagaaggucaauucccaaaagaagaaacagucugacaguuccuccagccuccuaagucccccgacccagauccccaaguaggguaacccugcucugccaaguaaaaguacccgggacuuuggggcaaaaagcacccggguugugguccuagcucugccaguuacuacguaagcuuuaaaaagccacuuaaugucucuaggucucaguuuccucauccauaaauggggccauguacaaguuuaaagagcauggcuacagacacauacucaagaaauugaucacagaguccaugcagcaaggcagacagaacagagcugaaugaaaggcuguauccuggugguuaagcaggagggcucuggagccagaucaccugggcuggaguccagguuuuacuaggugacccugggcaagcaacuuaacuugucugagcucuaguuuccucaucuauaaaauggggauaguaauagugacugucucagaggauagacaugagaauuaacugaguuaauguagguaacgugccagcagcacuucguauagagaagugcauugaaaacagaaguaugauuauuccucucugccuucaguuuuacugagccuccccccuaucacuucccccugccaacuaccuccuucagacagcagcugacaggugcuguaggcugagggccuuucccaaggaugucgucaggcggguggccuagggguaaggaggggccgggcggggcagcgcaagggaugauuucucccaggcugagccacauccugccaggcacaucaggugaucugaagucuagacaccuggcagccccugccucguguugccuguguccaaggaaaccguuuugcaggcaaaaagaaaauuaaagguggcuggucuaccuggcuccucuccucccccuucaggagagggaaaacggagagugaguuugcccaugagggagcccuggcaccuaccugccugcucuggcuugacuccagggcugagugacugcacgaccuuggcagcaacuggauuuuccuagggacaagucccaacuugcaguuucugggggugaaagcucugcugaguccucaugaggcaggaagcccgggacacaugccacaucugcuccaccccaccucaccccacugcuugugaucaguggagcccacaguuucacgucccagcugguugggagaggaggcucuugguaacuucacaccaaguuuaaagggcaggagauggaagagauaugagacuugccccugagucauacagcuaaaaaggccaaaggccacugccccauaaaggggucacccaguacaguggacagagcccucaaauaaccucuauccacccucugcuaggcaugaguugggauuuauuuauauauuuuuauguuugggggcuguucuaagcaguuuaaaaauaucaauccuccuaaaaaguggauaucuauuagcucccuuuuuacagaagaggcaaccaaggcucagauaaguuaaguaacuugccuaacaucacacaguucauaaguggcacagccaggaucugaacccaggccuguuugcccugaguccugugcuguaguauugaaccccacucccucucuaauuuugagguuucuuaaccagagaggcccaucacaaucacuuggggaggccaggggcaguggcuuaugccuguaauccuaauacucugggaggcagaggugggagaaucauuugagcccaaggguccaagacuagccugggcaacuagcugagacccugucucuacuaaaaauaaaaauaaauaaaaauuagcugggugguugggugcagugucucacaccuguaaucccagcacuuugggaggccgaggagggcggagcacgaggucaggagauugagaccauccuggcuaacacggugaaaccccgucucuacuaaaaauacaaaaaaaaauuagccgggcaugauggcagcaccuguagucccagcuacucgggaggcugaggcaggagaauggcgugaacccgggaggcggagcuugcagugagccgagaucacgccacugcacuccagccugggugacagagcgagaccgcaucucaaaaaaaaaaaaaaaaaaaaaaaaaucugggcaugggggcggggggaucacgccuguggucccgguuacuugggaggcugaaacaggaggacuacuugaguccaggauggugccauugcacuccagccugggugacagagugcaacucugucgaaagaaaagaaagaaagagagaaagagaaagaaagagagaaagagaaaggaagaaagaaagaaagaaagaaagaaagaaagaaagaaagaaagaaaagaaagaaaaagaaagaaagaaagaaaaagaaagaaagaaagaaagaaagaaagaaagaaagaaagaaagaaagaaagaaaaaaagaaagaaagaaaagcaccuagggaguuuuuucaaaauauagauugcugaggcccugccucccgagaccaacuuaauccagauugaagauucaagcaaguguuuggcacaauuccucagaugggcacucuuggguugccagccaagcggagacacacugguauguuugaaauggacauucugggucucaauacaucauaggcacaaggaggaggcgcccgccuagggcuucaucaaggugcuggauauucccuggcucucgggaguucaagacaggacuaggaucuaggcaggcacccucuccucuucuaccaccccuccuucucuuauggcucucauaggccucuccucccccaucaaaaucugcucucaugcucauaauaacuuucagcccaaagaaaacucagaaacgcaaacccuuguuuuagaaacaauuaaaaauagccuccuuuauuggccuuccugccuuagacuucagccauauuuuaauuuccaguaagagcucagugaauacuguugaaccuaaggagugcuccuuugaaggggugguaauggcauagggguugaucucggaugagcccaggaguagccgcggcgguucgcgccggccagccccacuccgcgggaaagccugugugcuauucccgccagggccgggagggggcgccggccuccaggaaaucacgcgcggagugggaggugcgugggcagagccucggaccgcuggagggaguagugaugagucaguuuccugcaaggcgcugcucgcccgccaaaacugcuuccacuccggcugcgcgucacccugggguggggagggggagaaugggaggggaccggggggccgcgaacacgucacgcugagccggccaggcuuccgaaacucccgccgcuguugggaaaccgcgcgcucuugugccgucucugacacagacacacacacacacacacacacacacacacacacacacgcccgcgcagacacgcacgcgcgcgcgcgccgggagccggccccuccaccuuaucuccacgcccaaagcacgggaugagucagaucccuggaaaauaaaaauagacgggagcaacgaaaacaaaaccgcucgcaaguccucccagaaacgcgacguggagggaggcaaggagaggggaagcugccugggcgccccaaguuccuaacccagcuccaagaugcuuuuccucacgaagagggcgcaagugucccccagggguuugggacggagaggacgcgcugugguccgcgccaggcggcggcgccccagggggcgacucgccccccugcuccgcucagcccuguagcuuucggagagggaaucugggcuaggucgggaagcccugagcccccgaggcagcugauagaggcccugagcagcgucgugccccccagaccccccaccccucaaagacaugaacccuccccgccucccauccaggcgugggcuccgcucccgccccggaguccagcgccccgacccgaggacaggcugggccgcgauucucccggccgcggugggaaagagguagaggagacccuugcccuuccccgacugacaggcugguuagagcccgcccagagcagggccgugacuccccgaccccuacagcgcgccgcggagcggggacccgacgcggugucccggaccuccagugcccggcuuccuugggaacaaacuguuccagccaaauaggucacugugccgaugggaggacggagaccgcgaaggggcaggggagagggcuucuggagucccgcuguaccccaucccgggcgggguucugaccucauacaguccguucccuggggucuccuugucacagugagucaccuccucgcuaguccuuaggggacggguccuggcacauucccaagggccaggaaacagcccgcgcugaccucagcgcucagccaggugguggacacaguggcguaaaggaccugaaccugggaccugggccagggcggcgcagauuggaucccagagccacccgggaccgauccuagacgaacuuacuccacuccgcuuuccucgcccuuccugggccccuccagggacacggacuucauccccacgccgcgagcaaacugcgccuggggccuggagccaaccgcagccaaaggcgagcucccagaacggucccguccacgcccucccucgccccagcuggguuuccaggggcggggagcgugaccagggauuccuguacuuguaaucccgcucuccgccccggggucuccggcacaucccgacucucgucacccgcgcacuuagagacaccgugugcgcaagccgagcgcgcaccgacccacgcccgucauucaccugccgcagaaacaccugugaacgcagcacacacccgcgaacacgcauccucgcggacacgcagggacacacgcgggcacgcuuggcucggcucugggccgccggcccgggguccccuguugucugccgccgcucucucaccuccucugagugccucggugccucggcgaauccgcgcccagcuccggcuccacaaggaacugacuucggcagcugcucacaccucagcuggcgcagcucagcgcggcccugauauacaaccgccccgcccgggcccgccucaaggaggcgggacccgcgcucggcccaccgcgccgcccgggaccgcccuccccggggcccaggcuccuggcugcccagcgccgagccagcugagccuggccgaguuccagcaggccagccggucccggaaccucgcgugcugcaggagggcacuucccuccucccccagucccucgccugcguuggugcgcuggacacauuuccccacgaagugagccacaaaucuggcuuuuuuuacuuggagaaugaguuggcacucuccaggaggacacagcacuguuagaaugagcccccuuucuggcucaccgcugacccacucuggcaggcaaggauuuacccaaugcagcugaaaagaucaggaggaugacauuaauacauaaaaauucauaaauuauaaaaacgaugcaccucucugcaauuuccagaaaagccccacaauaucaccucuauucccacugaucccucacuaggucaccucucccagaagcaccuggagcaccuagacaccccaacaaagcaucuugaggccagaaugauuuuucagucccguuuauuucacagaugaggaaauugagguccacugaacuuaaguauacaaaguuguugauugucacaugcuuccgggaaggagggaauuggagagacuaccaaaaaagggcaaccugaucuccagggaaacagaagaauuggacauugaaccaaucucccuacacccuacacucaccugaacagaagaaaucccugugguugcagcagcuuuguuggccaggaaggggaggauuugacgagugaguugucugucuccugaauacuccccacauagcccguauacacugcuggggaaacuggggcucagagaagucuggugaccuaacucagaucaugcagcaaagaaaugacuauaguuggaacacaggacuuuugccuccugcccggggcucucugcuugucauccuuuauuucuguggcuccaaaaugacaaaaaugccaaauaacccucauuugcagaugguuuauggagaugacauaaauaaaggacaauucuggaagugucuacugguucuucugacagacacagaaaugagugaugugucuauccgcucccaucuaccucacaccccugaccuccccuggacuucaccuuugccuccuuucugugccugaaacauuugcaguuuugcuuuuaaaaaauugcagaggauggauuguucaucugaacagaaaucccacuaaaaaacagaacccaggcuuggagcagcuacaauuacugacaucucaggcugcucagagucuggaaaucucugcccagacaugcccagucuucuuccucuaacgcagcugaccucggggaggacaggcuucuuucuccucugcuguggggaugggagcccagguaggggugggaggacacaguagcagacccccuuggccugccucgcccuggagucaggccaggauuguggcuaaaccccagaaaggccacggcacagccucaggaccccacucuaagccccacugcugucugcaccuucgcuccuauacauccaaaccauccaaagggcugguugucaaauguccagcagaggacaggcaccuucucccacugccuugaagccccucugcuuucaggcauuucaaauagacuagacauugucugucuguuuacuuuggggagaaaauuuuuuuuaauaaaggcuuguaaugaauuauuuaaauuuuugugguacugagcuucacaaugaaauaauucuuuuuguuguuguuuuugggaaagaauuuuuuuuauaacuucuagcucaccaccaccacgacauucaauauuucuuaaguaccuacuaagugucuaguacuauucagugcuuuaaaaaaaaaaguuugcaaccaugcacuugaauguguacccagacacacucuaagggaggacuucugcccugaaaaaggcaagggagcaggcuguuaaaagucacacacagaaucugacucccagcacacacucacacaagcacacaugcaucagaucccagcccugucgcaaggaucugcuggcagaucacauacccuguucagaguaacaggcuaagguuuaccuggggucuuuagaggucuccugucuccuaccauccccuuccucaccugaaaacaggcagccc

SEQ ID NO: 21549 - RNA, 1315 nt, Homo sapiens
accaugugucacucucgcagcugccacccgaccaugaccauccugcaggccccgaccccggcccccuccaccaucccgggaccccggcggggcuccgguccugagaucuucaccuucgacccucucccggagcccgcagcggccccugccgggcgccccagcgccucucgcgggcaccgaaagcgcagccgcaggguucucuacccucgaguggugaguaucgccgaagugggcauucgcggggugcgcugcccuggagucacuggggaacgacccgacuccagaggccucgaccugaccugucuccuguuuugucuccccuuagguccggcgccagcugccagucgaggaaccgaacccagccaaaaggcuucucuuucugcugcucaccaucgucuucugccagauccugauggcugaagagggugugccggcgccccugccuccagaggacgccccuaacgccgcaucccuggcgcccaccccuguguccgccguccucgagcccuuuaaucugacuucggagcccucggacuacgcucuggaccucagcacuuuccuccagcaacacccggccgccuucuaacugugacuccccgcacuccccaaaaagaauccgaaaaaccacaaagaaacaccaggcguaccuggugcgcgagagcguauccccaacugggacuuccgaggcaacuugaacucagaacacuacagcggagacgccacccggugcuugaggcgggaccgaggcgcacagagaccgaggcgcauagagaccgaggcacagcccagcuggggcuaggcccggugggaaggagagcgucguuaauuuauuucuuauugcuccuaauuaauauuuauauguauuuauguacguccuccuaggugauggagauguguacguaauauuuauuuuaacuuaugcaagggugugagauguucccccugcuguaaaugcaggucucuugguauuuauugagcuuugugggacugguggaagcaggacaccuggaacugcggcaaaguaggagaagaaauggggaggacucgggugggggaggacgucccggcugggaugaagucugguggugggucguaaguuuaggaggugacugcauccuccagcaucucaacuccgucugucuacugugugagacuucggcggaccauuaggaaugagauccgugagauccuuccaucuucuugaagucgccuuuaggguggcugcgagguagaggguuggggguuggugggcugucacggagcgacugucgagaucgccuaguauguucugugaacacaaauaaaauugauuuac

SEQ ID NO: 21550 - RNA, 27092 nt, Homo sapiens
aguuagugggcguggccucagaggcgccugcgcggaggcgguuggagggaggcccgauuccccuuuguucggguucgccauuuugcuaggcagcggcaguggcggcggcagcggcggcuggagccucugauuggguuucggaguccgguacuggagccaaucagcgcgggcagcgaaccgggggagcgaggcacggugagugugaggagccaauauccagcggcccagagccggccccagcgccccgauuggcgggucucgcugaccacucaggagaggcccaggcgcccgucgagcccggggagucgagcugagccuagccgagccgggcggccagcggccccggcccggggccugcgagcgccucggggcacucccggccgaggccugcaggggccgccccgcgcggggauggcgccucggggagcaggcaccucggggcuccgacccucgcagggugccagggccaguugggaaugcgucccuguuccccgacucaggcccagguucucaggccccaggccuggggccacgaauggcccuacacuaggggacacaugcgcgcccugggccucggcgauuuccuccuggucguucuggccgcaaacuuaaaccugcccuugcacucuccacucuccggcccuugggacaggaagccuccccggggcccgcgccccccgcuccccgcucccagcgagccgggucugucuuaucugcagccccucuaggucgggagggaggccuggggagggugcgcgccgcggccgcggggucccgugugcggcuggcaacggggcuggcccgcccacgccucggagcccuaugggcccgcccccgcugucucccugguggggagagggggccguuaguucgcccacucccccugcuccgccgcgccccuccucccagcccgcuccgcccgggucuccggcccggcgccguuaccaccccuuuuggcucgucauuuccucucuuccccgccccguucgcaguggcaggaccgcacaccuccgucuuggagcccaaccaagcggucuccguuucuuguccgggcuguaagaccaguccauucggugccuggaaccucacucuuagaagauugauacccuugcgcauucuuuccggaggcugcacaacuugcuguucauauuacuaaucuuauccacugcucauuuugugaaaucucccucccuugggaauauaguacaguuuuggggguuuuuuuucccuuuguuuuugccuucgccuuucuauguuacuuugugucaggcuugacccaguccacucaucucuugguuuauguuuuucugauacacuuucaaguccuguguuaacguuuucucagcagauguuuagaaacuaacaguguugugggguuuuccuuagggugagagguugcuguuggcaaccaauuauccagcaguuaguauaugccagguauaauccguguguuagggagggaguacguagaggucaauaagaacugugccuaccugauggaaauugacaggugaacagguaguuaauaccuaacgguuagugcuauaaaggggccaaguucaguugcugugaaguauccaugcgugagcuagccuccgugaaaggcuuaucaccaccgcacuuuugacuggccuugaagaaugaugguaauucuuccacaggaaagauggaagagcuugcucgaagagaagaaaagcaugugcagaggaaucaaauuacacuguuggaggcaggaagaugggauagggaagugggcaguaguugugauaguuuaggggggaaagcccaguugguaaaauacuuguauaucuugcuaaggaauauuuuggaaacaguuauuauuuuguauggagguucaaguagaagggaucuagagcuauauuuuuuccuaagauugaaaaaacgaguuucugacuuguuuauggguucugccccgugauaguggcugaguucuuuggggaugaagaggagacuuguccuaggacucugaaaauuauuuuuacucaugugaaucaucuagugcauucccuggcacauaaaggucuuaaguaucuggugcccauuucuaaauucacauuuaauguuauacaacuaauagguuucagaaaacucguauuccagugcucuuucauuacuaaaacuucggggacagguuuuauuuucacuuuuuagggugaguuuuucauuguugcuuaagugauuuucuuaauucauuugauugucacguuauccgcauuagcagaugagaugauagagcuuaaguagucuaaaaaacauguauauuugccuuuggaacguuuuuuuguuuguuuuuggauacagggcuuuccucugucauccaggcuggaguacaguggcgcaaucguagcucacuaaccuggaacuccugggcucaagccauccucccuucuuguucucccaaaacguugggauuacaggcaugagccacugcguccugaccugaaauagauguuuuaaccuuaguauuuaaaaauagguauguucuggucacuucaaaaucacuaaauacuuuugcuuggcaucuuucuaaaaggcauuauaaucugguaacuuuuuugcuaaauaccuuacaagcuuccaccagucugcagaagaauuucuuugucugacauuuugagagaaaguaguguggccccaagcuuuuuuuccuguuuaguccacuguucacaugcugaaauauuucuguucuuguuuuuaugcucucuugauuuguaguacuucaccuuccuccacaucaucacauagcuaaaucuuucucacacuuaagaccaguucauccugcaggccucugauagcaaagaaaaaaaaaguucaaguaguaccuuuuuuuuuuuaagccuuguugauuuauccccagcuggaacaaaucucuguccuccaaauucccauaucacuuuaucucuuaggauuccaguauagguuuuuaguccauuacuaaacuuaaagacucuuugaaguuugaaucuucgucagagauuucuuuuuauuuuuaaaaccuucagaacagugucuggcacaugguacauaauuaguggagagaagugcauuagaaagcuccaauccagaaaucuguaggaugauggggaagcuggacagcccuuuguuguagucuagucuuucaucaagcgucuaucaggacccacuuguugaguugugaaagaaauugagugagccaaugcugggaauuuuuaaauaauagaauagaaaauaucugccaggcaugaugauggcucacgacuguaaucccagcacuuugggaagccgaagugggagaauccuuugagcucaggaguuugagaccagccuggguagcauagggagacccccucucuuaaaagaaaaaaaagaauagaaaauaccaaagugcaucuuguguuguauaaagguaaaugcuguuucaugaaacuuucauuucaguuacaugcuuuauacaugugugcacugaguugugauaaugaaauguguuucuuacuaaggguuguggucaaaaaaguuaaaaagcuacuguucuaggcuuugccugguagugauuaucaacugugauaauccuauggcuuuucauaugcuuacacuaguugaguuucugaagagguuuuagcuuuggaguuuguguagguccacauagaauggguuccuaguaagugguuggcuaagucucagcuuuugcaccuuggaauaguggggcaaagagaauugcacugagaagagaaugcacuaggaagagaauuuucaugcuagccagaauaaacacuuauuauuuguuucucucucuuugaggaaaaaccauucaaaacuuuguguuaagagcaagagcuagacagacuaaaucuggcuuaguuugucauaaucuugggcaaagaggcacuuugggaaagacuaucgaauuguauugcagucuugcuaacugaagcucacaguaguaggaacauaugacuuuacugaagccaguugcuuauagcauuaaccauuaacaguaucaauaucaugauacaggcuaaaucacucugucauuaaugugagagagaauugcugcuagauuugaagcugcucuucaaaucuugauacucuucaaaguauaaauuuaaauauugcuaaauugguucauuuguauuaccagaauaaacuaguuaagaagaaaaucuguacguuacauauauuagucauuaugugcuucaaguuauauuuagucuuguaaagauguaaacuucuggauauuagucaaggaaaaaaucucauauaagaaggaaauuuggaguuggggaggcguugaaaccuaaaagacauuccuuucaugauccuuauuuuuuaaaaucaauuuauugagagauacuuuagaaacaaaguauaauaauuuuaaauguguauuuugaugaguuuugacaaauuuguacaccugugcaacugcuaccacaaugaagauauaaaacauuuucaucacccuacaauguuccuaaggcuccaugccagucaaccucccucuuuccugucucccuguauucuccacucccaaggaaccacugauccauuuucugucucuagauuacugaugucuuuuggagauuuuauauaaauggaaucauauauauucguuuacaucauaaccuuaauuuuauuaguuuauagccauaaauguauuguguauuagagacaagauagaauuuagggaagccuguuagugccccuaacagacucacagucuggcugaaaaccugauuuucuauucuauacccagaaucucugaggagcagacuuagucaaccaauuccaaagagacugguguaaaaaucagaaaaccgguuugucauguugcugauuauauuugcucccuguuggccaaucuauauguaaauccaaauuauagcuagaaauuuaccuagcgagcauuccauuagaucaagggcagugcuuuggagaaccauauggccacaaguccucuugcugugaugacauagccuguuauuuauggcucauagauucuuauguuguauccauuuugguuaugaguaaugggguugauuaauuuuuauuuugauuaaauuuuguuauauuuuuccuaacauuccaacauucauuugggaaauaagaauuucucaaaauucuuauucuagaaauaagaauuuucaagugugcagugaaaucaaaggaauuugaaaauaaacaccuguauaccugccaguuagggucuauuaacaucuuacuauaauugccuuaccagauauuucuccacccauucauccauuuuuugaugcauuucaaaguaaauuuuagauaucaauacacuucuuucuaaguacuuggacauauaguugcacauauuuugguuucuucuuucacacuguauugagacaccuugcaaaugauuaauuccaccagcauguguggauuuauggagagugguacuguacuuugccacgauaaugagcagcucaguuaggucacgucauuuuauuauucagauguuggaauuuaugagggccuagugaaaaaucagagagaaagaccuaucuacauuuuuguuuauauaucuguccucccucccauauuuccaagaugaauugccgauugcuaacuuauaucauuuuaauuuuuuaaugaagucuuuauuaaagguucucagauaucauucaguuuaucuaauuguauccuuauuuuuaaaaguggaucuucaacucuuaaagucuaugagaaggguaaauuuugccuaccauauguaguggaccugaguaacauguuuggugggaagcaauuacguguuacaacuuaaagaagcuuuauucucuaaaguauaugugcaaaccugaaaaucaguguuagguaugccuuguaucaaagugauguagcuuaacgaguaucucuuaggugcaaguauugcucugacaguauugaaagguaagguugccaguauacugaaagcauuuuagaaacgugaaaauagcauuauguuguuaugauugugccauguaaucccaguuaaaaaugauacugaauauaagcauuuccuauucuccuauccuguuuucuugcaaauaaaguacagugauaaauuauccagguuaauugucugguaaggccuuuauugacaaucucacuuuaguuucuuuccccaccuuucuaacaggaguguaccucacagccuucuaggaucuccagaguggacaggaaucucacuuggagggaccauggagcaguauacagcaaacagcaauaguucgacagagcagauuguuguccaggcaggacagauucagcagcagguauggaagcaaaacugcuuuaaacauuacagcaaugaaacugauaacagcaccacucaauugguuggucuauugcccuggggaauuauuugaaagauaccagaucuugugagauauugggucugauggcuugugcugaaaugccaugucuagcccaugaccacuuagaaucuacucuucaugggugccugguuauaguaaauugccucuuuuaucucauuuuaaguaaaaacaucuagucugguuuucagauggaaauuuggacuuuaaaauuuuucuggauucuauuuggucuuuuucucuucuuguuugagcuaacuugugauuuaguaagucuuuggccacaacagacaaaccaacauagcuuccaauaaaucuucuguuuuuugauuuggucugccacauuuuuuauucagaaaagcucugguuuaacauuaggauaauauuuagacagccauucuuauggauaagacauacuagaaaggaauucccugcugcugguuuauuccuaauuaauagauugcuuucuugaauuuauacacagguuacauuuucugaugcuuuaugcuuggguuuauuauaguaaaauuucacuuuuuuccccaccccagaagaaaaaaauguauuauguuucuauuugaccuuaggccaagauugauauuuuggaaauacuuuguuuucaaaauggaauuuagcuaauauagaaaaguaguagggaagggaaagguaguauugaugaugaguuuuucccgucuaaugaucaaagacgaacuccccugauagcuuucccuuccauacagcugcuguggcucuggcaguuuccuucaacugccuuuuuagaggaagggauuccacaaagggcccuccauucacaccagugcccuggaggguggguuuuuauucuuucagaauuugccauuaguggauguaaaaauaagguugaaucauugaaaacauggcucuuaaagcaguccaguuggguagaaauaaucuuaguuuugaagcugggcauggugcugcaugccuguaaucccagcuacucuggaggcugagacaggaagguuggcuuaagcccaggaauucaagaccagccugggcaaaacagcaagaccccaucucaaaauaaguacauaaauaaaguuuaaaaaaaaaagaaucuuaguuuugggacaugagagcauugacgucaugaagaugauuucgguucauagugauuaauuacuccuccuuucuuggugauugcauuuaagcccagaauuuuuuaugguaguuucagggcuauuaaaaccuaaucauuuuuuucuugugaacucaucugaggagauaaaaagggcauuaaacaauuguguaaguagaagugucagauuccuguuucuggagggaaagauugcauuacaaaucuuuguguuaaugaugacaacuguuuugaguuuuugagucaaauuuuugagguccacucuggagacaaagggcuaauaucuuuaauccuacuaccuucaacaaaacagcuucaauauagggagucuguacauuuugaaaguccuucaggcuuccgucucucuccuccaagagguaaggugaucugugucuugaacuacacauuuccuuccugacauauuucaagcucuuccuguuccuguucucagcagcaggguggugucacugcugugcaguugcagacugaggcccagguggcauccgccucaggccagcaaguccagacccuccagguagugguacccucucugauucucugugagcacugcaugaacuucuccucuccucaugucuggugcuguuuguguuaggaucuccaguaggaauggcaaagucaguugcaugucuuugaugcugcuaacuugucuuugaggcuuauaagaugccaguuuccuaauauuucaugccaagucauauagagaccccguaucaacuuucugagaauuggauuugacuagcauguuucuuugagaaugccuggaaaagaaaugguauaagugacaggaagaaauucuuauaagugacauuagaauuuauucagggcucggccgggcgcgguggcucacgccuguaaucccagcacuuugggaggccgaggcaggcggaucacgaggucaggagaucgagaccauccuggcaaacauggugaaacccugucucuacuaaaaauacaaaaaaauuagccgggcaugguggcgggcaccuguagucccagcuacuugggaggcuggagcaggagaauggcgugaacccaggaggcagagcuugcagugagcagagauugcgccacugcacuccagccugggugacagagcgagacuccgucucaaaaaaaaaaaaaagaauuuauucagggcucacacucugauccaauuaauugcaugguaaaaauuuuguguauuuguguuacaauggagaaggaaauauauacauauacagacacacauaaacuaggcuaggcugugcuuuauuuuuauucaaggggcaacucaacugaaaaauaaucauugcacuuggcaagguuuaucuaagcacugaaucuuguuaaucucuuguuaacugcuauuguuuccacuaccuuuccugggggaauagugaccugucuuauuacuagaucugcaaagauuaccccagauaccucuugguuaggcagaagcaggaugugcuuucuguaagucuuagguguuaaagccacugugauaauucuugguuaaucaauacaguucuuuagcaucguguauggcuaaguauccuaaauuggguucuaauuuggccaguuccuauaaaacacaggaguagcagcacuagucuacucuguguauguagguuacuuuuauuaaaauaacucuauuuuugagaaauuggcaagauuuggguacccuacuuuuucccuccauugaauuagaaaugauucaaaguagaaucuagaauguagaacuggcaucucacuuuauugcuagugcugcuaagcauccagcagauaacuaccucuuauugucaucacuuuauccuuucaaucccaccccuaccccugccaccaauaguguuugguaaugauguacagccaacuuugaacauaaauuaagccgaaagaaacugagcuuguaggcauuccaaaauuguguucaaaucucacaguccaacagcuuguuaauguuuuucaugcuugcuucaucuuacucauauauaaaacaguauuuuggauugucauuaaccccuuguggaauaggaauguaacaugcucuuaacuguauggcuucuuguuugaugcaugugucuuuguaacauuuuucuguuguaaauacagugagcucuuuggagucucaaaucauuuaucaugugcacgaauagcacaucaauuggggaggaaauuaagaugaugaauagauagaaaauuauuaauagcuguaucuuaaaacuuguguuuccuacuuacauagauuuuauuuaaaagaaguggaaacacuuuauggaaauaauagaaaccuuuccucuagggaucugauuauuuugggagaauuuuaaauaguuauuuugguuauucuugcuauauguauucugagaaaucuuucuugauacagaauaugcaagcauuugguguagcaaaggggauuugauuuggaauggggaaauaagggaaagagauagcaugagagagucaggcuguaaaguccuuaaaaaaguaaaguaaagguucucaauggacaguuuaacaaaacuuaggauuucaauguuccuggugauucuaauacauuaguggugguggcaguggcggcgguggugguggugauuguaggaggaccuuacuaucuaaccuacucaucuaggacagaaugaucuguuaacuaauugcuguuacuugcacauacuuucauuaagugugaauauuucagucaugaauauucuguucuaaguaauuucugucaaagauagagucugaaaaugaaaauuuuggacuauuccauggaucauuacaguuuacuucuaaagcacuuuuaaagugcuuccagaaagcauucuauuagguauuuuuguauugggacuuaagaugugacagagcacuuguagugaccuggcuccuacaguagucuguuuacucauaggagcuugaaauuuguacacuugacugcucuguguaauuucaauauuuguuguugcuucugauaaagcuaaaauaaccauguggauauuauagaggccagugaggaauuccaccauggagacugcaaacugaccagaaagugcuuuuaagaaaucuuuaguagugaguuuaaacaacaaacauaucuagaauucacagaguaaaaugagcaggauaaagguauacauuugacauuucauuuuagcuugagagacuguagggaaaaaagggucauccucuacauaagcuuccagagcugcuugcuacccagccuccuagagucauugcuggguacaguuugauuuaccuucuucacuuuauuuagaauuuguacucaaccaccaucaccaccaucaccuuucccucucauugccuucucuccagccuucacuacagaccauuccuggauugguuuaaacaggcaacuaaccuugccauuaugauuaaauguuugucauggauuuagcccguguuuggugacaaaugccuuauaucuauugagacuucucaaagacucuggauauucuccauuaugucugaccuuaaaguauugagcuuggcauuuaguaacaggauucauagauauuuaaagauaacuugaggacuugagacauauauuuucuuagucuuuucuaccuuuuccuuuucuagcaaggcagcagaauaguuccagugauugucuuuugguaaaaaccauuuugugucuuauguuauuucauuguucuuauuuuauuucauucuagguccaagggcagccauuaauggugcaggucaguggaggccagcuaaucacaucaacuggccaacccaucaugguccaggcugucccugguggacaaggucaaaccaucaugcaaguaccuguuucuggaacacaggguuugcagcaagugaguaauauuuaaaaauauugagcaguauaucagaggagagguuucaaagaauagauuauuacaaccuauuugauaauugauauugcauuuaacugcuuccuaacccacauuuugcauucaguugauuuucugccuuuauaguaccagugauauaaacuagaacuaugcagaaauuggacagcuccaguaaugacuaagauauuaggcaugaucuugaauugcuguaaaguauaugaagagguuagaaucuaguuuauaguauauuuuauuuuaaaagaaacaaaaaugaguauuuagaaaguuagaaaaauaacaaaacgagcaaaaaguggguccaaauuaauuaaguagaaaacugacguauagaaaggauaaauaaaaucuagauuguuuaagcagaccaauaaaacagguaaauccaguugaaacacugauugagaaacagaaaacaaaaguaagcaaagauguagaagagauuaaaggaaggccaggcgcaguggcucaugccugugaucccagcacuuggggaggccaaggcagguggaucacuugaggccaggaguucaagaccagccuggccaacaugacaaaaccccaucucuacuaaaaauaaaaaauuagccgggcgugguggcacgcaccuguaaucccagcuacuugggggguugaggcauaagauaucuugaacccaggaggcggagguugcaguaagccaagauugugccacugcacuccaggcugggcaccagagcaagauucugucucaaaaaaaaagaagagauuaacagaaauauguagaaauguuacauacaacucuguggcaucauauuuuaaaauuagauauuucucaucgagauggcaaaaaaaaacaaaaagucauuauauccacuguuaggauggauguggagaaaaagaauuaaucauuauuuuugguaauuuaaaacuguagaguuauuuuggaaaggcaccucacuaucuguuaaauacaaugaauauuugagcuagcagucccacuucugagaaucuguccuauaggaagaaaagcaucaauaguagggggaaauuacaaagacacuuuucauagcauuguacuagcaaaaaauaaaauugcaaucugaguguccauuaauaagaauaaggaaaugguuggaauaaaucauaauauauucauagggaauauugcaucaucauuaaaagaaaugaacuguugacuugggguggguuaauauugaaauauuuuuaguggaaauaauuugcagagaaauagugugugaucucaucuuuguaauucauaaccaaccccccaugaguauauguuuauagucauggaaaagagaguaugagauaacuauuaguuacucuaucuaaauguuuauauuguuucaacaguuacagcagucauauuaaugucuuaguuuucuggaggaauuuaaguugaaaaaagcagccaugaucccacugcucauaaaucaaacuuguacuuuuuguguauucuuuuguguuuuuaugcauaauuuuugggcauaauuguaccaugcaugugggguuguguuuucauuuuuuuuuuuuaauucuuucauaauguucagucaacuugaugaaucagaauuucuaauuuauaaaauauaguuaaggauuuugguuuucauuugccuuuguagguaaacauuugggcacgauaguuuuauuuuucaacugaauucucaggauaauuucuuuggauuggggauugcuuggguaaaggguaagaguauauuugagcccacuggcauauuuuugccaagauagaauuguacuugggauuaaaaauaguuuucacauuucucuuugcauaaauauaugaggcuuuaaauaucuuuucagcaugugcuuuccuugauucccuauugcuauauccuuucuguucuucucucuuugcuuccucuccagucccccuugcugcgccuucuccacuguugaguagagacaaugugguauaguuaggaacaguauacugugaguguagugguccaagcuuucauuaccaggucugccauuaaauaagcauucugaucuuggccaaguuauuuaauugucgguuugcucauccaaaaauaaaauuuauaugagaugauaucuaggguucauucuagcucuaaauucugugauuuuuaugggguuuuauuuugcuauaaggaaccuucaaauaguuauuucccugcuuccaaguagggcuauaacuaaccaagcugaaaaaaauauauucuguuacguaaauaaagcucucuaggugagauuccauagccucccuuacaauacuuaaggcuuuaauccccuuuguauaggaguuuuuuuucucauuaguguugaguagccauuuuuuaaagaagacuacuucuuaaccuuuuuugaauuguauucucuauuuuagaauccuaguaaagcuugcacccucuaagaaaaaguagagauguccagucucaugaaaaauucugcauauaauuuuagauuaaaauccuuggccugagaaagauacuggaaccagagagacagccaagaaauagauagaagaauauuggaaguuggcauauaauaaaagugguauaaacauaucaaugaagaaauggcugaagaaugauacagaaaagaaacugauuucuaauucauacuguauuuuaaaaaauauuugcuagguggauuaaagaucuaaauguagaaaaguaaacuuggaaaauucaaaagaaaauauaagaauuuuuaugcuauagagaaggauauuuuuaaaaacaaauugacuaaaacauaauaugcauugaaauacaucaaauaaaaguaaacaaggugaaaacuuggaaaagauauuuuuaauacauacaaccgaguuuguauucagaauauguauaaauaacguuuauguauuuauacaaaaauaggaaaaugggcgaagaauaugaauagauggaagaggaaauccuaacagccaauauaaacuuagaaaugaaguugguucacauaaccagauaaauuuguuuacuuauuuauuugccaauacuuucugaaugccaauuaugagcugaguauuuggaaaaaauaauucagaagaccuaggcaaucuauccccuaacaaaguaggauccaugaaugucucuaagacauggaacccauugaccuguuuuuuucaccuuccuuccaucaguaguccuuuuuccuaucagcugguagacuuugugauaacuuaagguucuaggcauguucuucuuuccagaccaagguggucccaaguugaaauuauggauggaaagugaccuggcuauaaaaaucuaucuuucugaaaguauccuccuuccagacugccaucuauguugaagcaaugcucaaauaaaaaaaguuuguugauggaauuaauggucaaagaagcaaagagaagguuacuuaguacuagccauguauucuggcuuuuaaguuugggagguauucuugaauauaaaauacaagacauuuugagcuauggggcucuccucacugcuuucucuuuugcacuuaaaaaaaaaaguguucacuaguuauaugaaaauaggauuuuguacacccaacauuuaaaggguuguauugcaguuuuuuaguuccaaaauuuagagaaauauuuuucaagcuucuugucagguuucugauaacacuccuaauaaaguggcuauagccauuaaaaaaaagaaagaagauagauuuggauagcacacgaucccuugcuuuccauaauugcuuuauaagguuuagcuauccaauccuaggaccaaauaggagauacaaauuaaaucaacaaaaauuugacaaacauuaaugacaguagugaguauugguaauuggaaacuaauaggaggaauauaaucugucacauugccuuaauuaucuauuaccauauaacaaauuauccuagaaguuagcagcuuaaaacaacaaacauuuggccggugcgguggcccacaccuguaaucccagcacuuuggguggccgaggcggguggaucacaaggucaggagaucgagaccauccugguuaacacagugaaaccccgucucuacuaaaaagacaaaaaaaaaauuaagccaggcgugauggcggacgccuguagucccagcuacucgggaggcugaggcaggagaauggcaugaacccaggaggcggagcuugcagugagccaagaucacaccacugcacuccagccugagccacagagcgacacuccgucuccaaaaaaaaaaaaaaaaaaaaaauuuauuuuauaguuucugugaguuaggaauccugacacagcuguguuggauucuuucaagguccucucaaggcccuuaucaagguguuguccugggcugcagucacauuugacuagaguagaauacauuuuggguuuuuucuuuguuuguuuuuuugagacaguuacucgcucuguugccuaggcuggaaugcaguggugcggaucuuggcucacugcaaccucugccucccaggcucaaaugauccucccaccucaguuccccaaguagcugggaccacaggcauguccuaccaugccuggauaauuuuuguauuuuucaguagauacaggguuuugccauguugcccaggcuggucucgaacuccugaccuaaucugcucgccucagccuccugaagugcugggauuaugggcauaagccauuguacccggcuuucagcauuuuuaauauauauaguauuuccucuguaaaaaaguacuucaucauucaccaaaauggcaagauuaaaaaauaauaauaaagcacuuuagaguguauuuuauuuuuuuauuuuuuugagacggaaucucgcucugucgcccaggcuggagugcaguggcgugaucucggcucacugcaaccuccgccuccgguucaagugauuuuccggccucagucucccaaguagcugggauuacaggcaugcaccaccaugcccggcuaaucuuuguauuuuuaguagagacaggguuucaucauguuggccaggcuggucucgaacuccugaccucaagugauccacccaccucggccuuccaaagugcaaggauuacaggcgugagccaccacacccagcccagaguguauuuuaaauaugcaugcuuuucaauauauauaaucauaccacugcuaucuuucauaaaaaccgacauugauuuguuaauaucagguauccagacagugucgaaauucccuauuuguuucauaaauggaaaauaaguugugucuacuucauaauggagggcagagcaggacuucuuuuuuccucuucagaacauuuucugcuuucuagagaaauguggauaacucucggggaccaaaggagaccagugucaguagaguacaauccuuuuuuuauguucuuuucugcagauacaguuggucccaccuggacagauccagauccaggguggacaggcugugcaggugcagggccagcagggccagacccagcagaucaucauccagcagccccagacggcugucacugcuggccagacucagguaauuccacuagcucugucacacaggagcaaaacugauuuggaagagucagauaacugagucagauauuucauguauagcauguauaguagaaaaggggaugaaaaccauaaaaaaauauauuuuuggccgggcgcgguggcucaugccuguaaucccagcacuuugagaggccgaggcaagcugaucacaaggucaagagaucaagaacauccuggccaacauggugaagccccgucaaaauacaaaaauuaggugggcaugguggcgcaugccuguaaucccagcuacucgggaggcugaggcagagaaucgcuugaacccaggaggcggagguugcagugagcugagauugcgccacugcacugcacuccagccuggcgacagagugagacucugucucaaaaaaauaauuuuuuuuuuuaaggacuacaucguucuuuguuaguaucuuugggaucuguugaauugugucauuacuuauuuccuccagacacagcagcagauugcuguccagggacagcaaguggcacagacugcugaagggcagaccaucgucuaucaaccaguuaaugcagauggcaccauucuccagcaagguaaguguacccauaagcuucccuaggacuuuuuggggcaacuuuuuugucccuuagacaacugacaucuuuagaauuugaguggugaacuugacacuacauauuuuuuggacaaaaaaaaaaaagauuuccucuagcucuccauugauuguugguuucuugucaccaucugugaccaacagugauuccauguguagcaguuucuauagugguugcuaaucuagggauuguguaagcuuuuagggaagaaguguuucuaaacagaagaauagaaauagggaguucauugguaaagagagaaauagaucaaaaaucaaguuggcuuuagagugcuauugcugcuuauguuuuuuucugggucauuccauuacuuuaaaugacuauuauguauacagcacuuuuacuaagaaggguccucaaagagccucuagucuaguaagaaagacgugaacaaauaaauacaaugcagggcccucauggaaguauguucuaggaauagauaacauaaauaauagauguuuggucugggaggaggagugcagaaacugaacuugaaggcuuuuggaagcaccuguuagucaaauaguuaaaucaaaaaaggacaucuuuguuagauuccaugacuuugugauugcaaauuugcaauauacaggauccagagagugcacuaacugugugcucuuguauuacuccagggaggcccugaacuggauugagcccaggcaagagcucaaacagaauggugaacaaauccucaagugcugcuauugauagucuggggacuuggaaugcuugguuuaauuuuaaguuuuaauacuacaacugacucauugucaguuugagauaaacaaaguauaaguuuuaaaaucucuguccugaagcagauugcucauuauguacaagagcaguagguauagcuguagucagacugaccuguagaagaggaggccuccaaaccuuuucaccuuuugaaaacugcuaaggauagaguuacucaaaacugggaccuagacaguuaauagaauuucaaagauugugauuacuuagauuauauauagcacaccacagugggagaguacuuuuucuccccuuguguuuuucaguguguuuugccaggaucggugaguguauaccagauagaagagggacuaacuauguucccuucuuucuguucugugugccuguuuuuuguuuguuuuauguuuuguuuucuuaaaguuacagucccuguuucaggcaugaucacuaucccagcagccaguuuggcaggagcacagauuguucaaacaggagccaauaccaacacaaccagcagugggcaagggacugucacugugacacuaccaguggcaggcaauguggucaauucaggagggauggucaugguaagaaaauguauuuuucagcuuugucuuugaaauuuucuugaacaugcaacuugaugccuccuaaaauuuauuauguugaccucuugggauugagaucgauccuuaaggcacugucgguaaucuacuuugacaauaacauuaugacaaaccauaauucauucugagcaccuacuaugugccagggacuauucaccagggacuauucuagaugcuggagauaaagcaauggauaaauagugauuuuauggaauucuuuucagaauucaaauaacgaagggaauuauauacuaaucuuugagaaguggaaaguaguauugcccaugauggacaaaauaagaaauaagcuaaaaauuagaaagauuguaauugauagagaaaccaaaaaaaaagugucauguaaauguauugggaagauaggaagauuugggugguguaacugaaagcuaaauccucauaugucaaaauaggauguuaaaaugcauaaauuaagaaugaguaacagaagucugcacagagguggaggaagcuaugaaaagaaacagaaccaacccuggcucaguggcaugcaccuguaguccuagcuacuugggaggcuaauccaggaggauggcuuaaguccaggaguuugagcucagccugggcaauguagagagaccucguuucuacgaauugaaugaaaaauaaauaauuuuuauaaaagauucaauacaguuauucaaagcgguuguauuugggaaagagcugugggguacaggacucuguuacuuguuuuuaccuacauuuaguacaguguuuugguguuuuuuaagaaaaauuaggauugaauuauaaguuaacuauuauuuuuauaaauauaggcauuuaguagcacuuggucuaucuauuuuugugcuguuuuuuugucuuaugacuacuguuccugaccauuagauggcagcagaaauaucuagagccauggguggacaugaauuagggcaugguuauauaguuucucagaguggcaccugaaucuccuaugacacagucaucugggguguuuguuuaaagugcagaucuuuaguauaaauuucuccagggauccgcauuuacccaaguacccuauaaaaauuacuuuuuguggcauuuacaaaaaaaauggaugaagaggaaccaagaaacuguuucuauguccauacuucaugccaccaauaagcucugguuuccuguucacacagaugguuccuggggcuggcucugugccugcuauccaaagaaucccucuaccuggagcagagaugcuugaagaagagccucucuacgugaaugccaaacaauaccaccguauucuuaagaggaggcaagcccgagcuaaacuagaggcagaagggaaaauuccaaaggagagaaggguauguauaacauugggaaggauauaggaaaggagaauagcaggguucuacuuuugaaauuaucuuuuauauggcuuguuuucucacguaccuuccaaacaauugacguuagauacuuguugucucuuuuguaagaguuagcauuuguuauuacuaauaugcagcugcaguuauaauaacgaaaacaaacaguggcuuaaauaagauguuauuccuuuucauacauaaaaguaguccagagauaaauuauccuggacugguagcacauuuucacaguucucaagaccuguuucacugcuuuaauauugcuagugugcuguucaugguccaagauuccugcuuaggcuccagccuaggaagaaagggaacaagaaagguacccuuucuuuuuuuuuuuuuuccugagacucagucuugcucugucauccaggccggagugcaguggcacaaucucagcucacugcaaccugcaccuuccauguucaagugauucuccugccucagccuccugaguagcugggauuacaggugugcgccaccacgcccagcuuauuuuuguguuuuuaguagagacgggguuucaccauguuggccaggcuggucucgaacuccugaccucaggugauccaccugccugggccucccaaagugccgggauuauaggcgugagccaccauacccggccagguacccuuucuuucaaggaaacuuugaagaaguuguguaccuuccacuagccggaauuuaguuaccugaucacaccuaacaugcagauaaggcuaggaaaguccagccuggugugguggcaaaugccuguaguccuacuuggaaggcagaggcaggaggaucacaugagccgaggaauucaaggcugcagugauucaugaucaugccacugcaguccaacagcaagggugucagagugaaacccuguuucuagaaaauaauaauaauaaacuuuaaugcuaggaaagucuuuuuacugaacacucauuugcucaaacgaaauuuggccuguuauuaaagcagaggaaaguguauauauugugaaguguaggugguagucuguuauuuuuuuuaaaaaaaauucauacuauaagcauucacagucuuacaguaguuauauaugguuagcuauauuacuuacuagguguuuucuccaaagcuuccaucgucauucuaagucauaauugucccuugugacuuugaucccagcugucuuaaacuuuggagaauggaauuugugcacuagauaacugugcugguucuggauaguauuaauaguuaaaugguuuuauuucucguuuuagaaauaccugcaugagucucggcaccgucaugccauggcacggaagcguggugaagguggacgauuuuucucuccaaaggaaaaggauaguccccauaugcagguaggaagacauauacauuuuauucuucucuuuauuaccuuguauugacuugaguugaagccuucagcaguguccucuugcuauuuuccuacucugggacuacucacauucucuaaacuggaugcaaucuuaugucucuuuagauuaucuuuuaucuuaaaaccacuaggccagacuugguggcucaugccuguaaucccaacacuuugggaggcugaggugggaagcccaggauuucaagaccagccugggcaacauggcaaaacuccaucucuacaaaaaaauacaaaaacuagccaggccuggugaugcaugccuguagucccagcuacuuggaggguugagaugcucuucgucuuugucacuuauuacuauucauucuuucuugaaaaucacacuuuucuuaauuuucaaggaacaaguuuuauuuuuauugaacagguuuuauuaccccaucacaaauauaauuugaauguuuacuuuuuucccuucuaacugaugugagccuggucuaauccucucuucuuuggcuuagauuuauaaaauagcugcuuaauuugguuucccuucuuccacuuuuguuccccucuagccuacucuccacauccuagugugaucuuuuuaaaauguuuauccuaucaagucccuguucugcucaagcuccuucaaccccuacccuuucccauuugcacuuagacugacauccaaagugcuuacuacuaugcccagcaaagccuuacaugcuccagcuccugucuaccucuaacugcauuucuacuucuuggucucuaugcugcuguuuacuguucauuggucuacuuccugccacgggucuuuguccuuagaauuuucagucuguaugcccuuuaucuuuuucaugcaugucuaucucccuaucuguuaggucuggguuuaauuaaauacccuaucuagaauagaucucuucucucucaguauguucuuacaacaucuuuucuuuuuuuggaggcaguggugugauuauggcucacuuuagucuugaccucccagcucaagugauccucccacuuuaggcucccgaguagcugggacuauagccacgcaccaccaugcccagcuaauuuuuaaauuuuuuguagaaauggagucucacuuuguugcccaggcaggucucaaacuccuaggcucaagcgauccucucgccuuggccucccaaagugcuaggauuacaggcgcacaccauugcacuuggcccuuuucuuuacaguguaauaauauuuaaguuguugaauuuuucaagauuguuuccuucacuagacuguaaguuguauagaggguagaggauuguuucguucucuguuauauuuauuggacuuaauucuauuuaaguaaguuguauuuaaguacugacuuagauguauuuguuggguuuaguauccaguucugaaccaagcaaucaguguuucuugaauuaauagauuccucccauuugcugauacuccauucuauauuaacaucacauuccacuugcacuauugcaauauccaucaaauuaaucuccagucuccucuaauuggccuuauauaguacuuauacaguacaugguuaaaguguuuuuuuuaaccugccaguccccaggucaaggaugcaugcuauuaauaguucucauuucuuaacugcaucaaaucucaaacuauuucuguauaacaucuaagcaacuuugccuuaucacccccucaacaaucaaacuagguuuccucaguguccccacacaugaacacuaacaacucuuucagugcuauuaauccucaccuguagugugagagccccuccuuucucauugcuauucauucauaacgguguaugaaugugggccugacagcuauuguggcaggagggcauugugccaggaacucuccucauucugugugcuaacaauaugaucuuggucaauucagccucuuuuauuuuuaucuguaaaguggaauacuguugauacuucacagcaauguuguagggauuucauucaguaauccacauuaggcaucuguguagcaccauaccuagugcauggugaguucaguaaaugcuaguuguuuuugcucauuguucaagacccaguuccagucuuccaucuccagaaggcuuucagcuuuuucucagauccugccuaccaaggcuucagagccuugguaugggggaacuaaaggugguucuugcggaguguugcaaaaagcuuccaaggauuuauccuuguguuaacacgguaggucuuaagugagaaacagcauauagaguuuaguggaaagaagaugaaaugggagucaggagauuugggaguuagcccuugcuggacuccuaacuuucugacccugacccuaguccacgcaaaucacuuuacccaucuggccuucagauuuaucuguaaaacgaguacauuaaaguguauagauucuaaugauucuuucuagcccugcuaaguacucaguauuuaaaugaugaucaaaaaacagugacaaaaauacagcaugacaugguuucucugggucuuuuccuuagacaccugaaucugaauacucuuaacccuuaaguauagagaacaacacaagguucuuaggaaagagauacacuaacagcccugcaguguuucaccauggagugcaggccagacuuuaaauuauuuuaagaauaagguuuauugucucuucuuuccuaauggggcuacacuuuaagccauguaugcagacuuaagauguauuacaagccuuugauuuacuugguaaaguuauguguauucucuuggggggauaaguagugagagccaugaguuccuguugcuuuugcaaaggacuuuaaucaucaugucaucuuugucucuaggauccaaaccaagccgaugaagaagcaaugacacagaucauccgaguguccuaaccccacgccaugugauggagcugaucaaggucauguuucucacuguuccaggaaauugaucaacucuuccaaugggacauugaugaucacauucugcccuuuacuacaggacagaaaccacuuaguuuuuaauaaguggcucaguauuacaauugcagcgaugccuggcaaauugaaguugcaagccuuugucuuacucuuucagucaggaccuauuucagacuguugaugacauugacauuucauggauucggaugaugcaaggagacacaugccaccccagcaguacacaaagcacuuaccuugacuggugaagucagccagccaucucagcagggaagaacaaccuucucaaccaaaacugcaaucaggaaagcagcagcccacuccuucccauggaaucuagacagcauuuaucccucuggugggggaaucucacacugacuaacugaauggacgcuuuguauucagagauggcuuccaggcaaggaaguucuaucuugugauacggaaacaauaaauuccugagauacauucuuccaaucugugguaauaauaagaauuccucucugcccagaugguagguugauauuucuggacucuagccaagaaaaagcuaauucuggggauagaaugauaaaagacucaagcacuaaaaauauacauugccgaaucucuuuuucuagcuuugaaaaguuguggccugcuugucccucuguugacuggucaucuggaccaucguacuugcuguggcuacuucuaagacaauguagaggguuauuaaaccuugaaacugccuuuccuaaguagagaacaagacuauucaacaacuucuuugcugaagcacugaggagauuuguaauacuccuaaaggaagggccaaacuagagauuuucaaucauagacuuugugacagcauuuggggaacuaaaagauucauguguuucagccuagugggagagagugggggagaggaagagagagagagagcauguauacccguauguuaucauagagcacgauucuccaguggauggauaccuggaauggaucauuaagaugaagagaguaauucacauuuacucuagaaccuuuaacaagcacugaaaggaagaagccugagauuugauccuugacaauuucuggaaagcacuggucagucacacuguccuggacagaguccaaguuacccacuaaagcuugagguggauguuggcuucacuccugcagcacaaugcuggcccuagaaagcgagcauuuucauucuucccauggcagcugauucuuuggugccaguuuucauguuuucuccauaggccuugugcagaaagguuuucucauugcauccauacugugagaauaaacugcagacugaaagaaacaugccugcagggucaggaacugggccacuguucccagaacggguugugccucagaaaucuauuucucuuuuagauguugaacccugagagaacuaagaugauauuucagaagaguuggcugccuucucuggaaacaaggaaaacccaauaauuccgaggaacauuggggguuaaauaccaagaauaaaaauugguucuucuuugacuucagcuuaacuguauuaagacagaaauuaagcccucuaaaaacaccacaaagagagaugauuguaaugauagaaauagagguacagagcuaugcaaaggaaacaggaagugaaauauuccuagucccagggaucugguaaucgcuccuggcuuccagaugucaaaggacugauccuuugguaagcucacuagaaacuucuagcucuacaagaguuugggauauuaauguuauucaguaagucccaaguuuuucagagaauagauuacuaacaaugaggaauuuauauuccuugguuaauuuaggagucuaagaugcagaguucagaaagaaauuacucagaccuaacuuugagugcuuaagcugccaacaguuagaagaugcuauuuauuugugucuguaaguuuguacauaguaaugccagccuuguugcugaauuuuuuauuuggggggagaugacuuugaauuuuguuugaaaugcuucaguugucauuuugucauugcauuucaaauagcucaugacccuuuucuuguggucacuuuggcacaccauaguagcccacaaagugggggcaggguauugacauuuggauuuuuucuuugauacuaguucuuuuauucauuuuuauuugugacuguagugauaacuuuacagauggagaaagagugaauggaugaaugaauaauugguuuaaugccuaguuaugcaacuugagugcuuuuuuuuuuuuuugcaggauaauuuuaaguguauauauuuuaacugcacugguacauugaacaugucagugucgaugccacuggaccaacagagcauuuuguggcuauagggugccugauaauaaugucuugauuuuucuuugggauucaacuauaucgaagguuuuucccccagcaguaugggggcguacaggugaucgaucauuaaugucauugcaauuguuauuuuuuaaaauaaauuuauaaaaauaaccgaaaaguaau

SEQ ID NO: 21551 - RNA, 89137 nt, Homo sapiens
uaggaucagaauacuuuaauaagauaccagugucaaaauacauuuccuuauaaaguuaagcucccauacaguuauaauguugucaguaggaauucgacaauauaauaacguucaugaaaucguuacguugacagguaggguuaauaugaagcuuggaauauuuuucaguguuuuaguaaaacugcaaggguaaaaugcccuuaaugccagggcaacacacacaggaaaucaaauaccagcauuuacacgucaguaacccuucaaguucugccacccugugugggguaaugccgugcagcuaaaauaugauuuacgcaacaccaugacuaaggaauuucucauagaacuuaaauuucuuuugaaagcuauuuuuuguuuuuggcaauaagucuauccgggcuuacuaaauaguuggcccaaugugcuuuguguguguuuuuagaaacuucuucauuguacccauuacagaaaaguuccauguaauugguauugaaaaaccagaggugucgucccucuuacccagggaguugcaaagugcucugggaacacuauuuucagugcuuccuaccuacaugucacugaccgacccagagaccucagccagggccuguggcuaggggccaucccuggaggccuugcggggccaucuggcugccggcugagugggggcugcagggcuggucuggaccagcugcucucccgcugugcagccuccuccucaguccagcuccacggggcuccaaggucgugagcuuggaggacguggacggggucacuauaccauuuuugaccccucauuugcaugaauucccgucuaaaccaucucaugguaguucuggaaauguccaaaugugccgugugaaagaccauccgagucacauagcucagugcacuugaagggcuagcaacaaaaccuuaagaaaaguuagagcacuuccccgccccaccccccgaccccacaacgugccaucagacccucuuggcagcaauaauaauaauacauacauacauaguacauagagaaugugaggggauagcgcgcagugcucccgcugaaugacuccacugcucggauugucacaccuauggcauaucacagauggcaaaaagccgacagagggaggccuuccacaguguccguacaggccgugggagcacuggacaagucugcaguguccacaacacuaagaaaaauuaacagcuucgaaaagaucuuaaagugauuuugugagcaggauuccauuuccguuucuaaguuuuuagauauuacaaaguacccauauauaugauaaacacuuaacccagauauaaauuuucuccucuuuuaaaaaacucaguuauguuuuugaauaauaauaaaaaauccaccaaaugcgggggaaaaacaccaguuuaggaaaagccacgcugugcaacuuucacagauaaccacauacguuggaguugacccuucacauuucuuuuuuuccaaaauuagagcaaagagucagcuuaaacaaaaaaaaaaaaacccugaaauuuacaauauggugauuaguuuaaaaaagaaacgagaagggcucugcgagggagacgccacaaaccaagcuuggaaagcaaaaucauuuuuguuucucuuuggcaacaacaauaacgaggaaucuuuuuaguaaaaugaagcuaaagcuucucccuacagaagaacagacaugcaccaaacuuguuaguauggacaguugugugugagaaggagaaggagggagagaaaccuauggauaauauaaauuagaagucauugaagguggggaggaaaaaaauccuacaaaauuuaagaacauuucagaacagguaaaacaauuguguacuuuaaaaauagggauaauaaagugagcaucucagaaaaaggccacugcuuggugaccugggcaagucugccagguaaguccaucuuguaaauagugugcuggcguuagaaauaccuaguugcaaaaacagacggagagagugaagcuggugggacggcgucggcagaggugcugcccagguagaaggccuggcucagguggccugguccagggcucugaggagguccccuccuugcaggagcguggagcuucccagcacgggcacguucaccucacagucauaucuggucaguucgggcagcagguaggacucaaaugagggcccgagcagccggcuugccaugccugaaagaaggguugguaccauaacuuaaaggccuaaaucgaacauuuggaaaagugucuacuucuuugugacugggggauaccaauagagcagcccuaauuucacucugcuccuucaguggugucugucccacggccugcugcaugcccggggaacgugucugccuccagaaccacugccucagguggggugcugagacccaagaaagaggaaagcgugaggugcgggcugcagcacagguauguggaagcuucaggaagagccugggguugcugacccccaugccuccuggcagcagggaggaaaggcugaaccaccuggcaccuaugcucacauacacagaacaugcagaacacacacauacauacagaugcaaacacagacugccucaagauucaacagucugaaaauccaguuucuggucaccacccucagcaguccuuucuucuugccucugugcuauucucuugccgaggaggcagaccagggaguggcaggggggacacucgcagcacacacacaggcccccaucccaaggaggaaaggcuuagguggcagcagagagccuggaagcccugcauucugccccuccgaugggagaugcccacccaccuucccuuaucugcagagccucguuccaguggccauugccuccugcaccuccuagcucagauccuugcugggguccaugccugccuccccagcuugacugcuccuguggacaguaucaauggauaccugcucaccaucccuugcuaacuucucuuauucauggucagaaaagaguuugauaugauucaacucuuuugaaaagaauaugauuuucccuugauuucaauauucaagguaauucgugggcuucacauaacaggaagaauagugcuggcuaccucuuacugcacauaaauauauaccagccccugaacucaacagcagagccagaauuuaagccagggcugucugguguuucuacagccuggacucugaagcacagaacuauaaccuuccccaaacucuauugcugaggaaauugccuuuuagaacaggggccugguauguuuuuccauaaaccacgaauuauuuucaggccaaacaaaccucaugaagacauauauguuucacaagauacugucaagaugaagguggcccaggguugaaggcaggcauuggugccugcaguugaaccaaguccaguggggugggccuaccagagcuuuccaggcuguucuaccugaaggaaguuuuggcauguucucagcaccugccugaacucagagugacaccccaaaacacauccacaugaagaacugaggaaggggcaaggcuccgggauucucaggguggaaagagcccuggauggcaccugaucaugggaggguucucccuaaagccccagggaaggagcacucccuucuccacgcagcaagcucauccuugcauagacgggagauccccugccucugcccagaccgcuucccaacucucucucucugaacuuucucuucucuucuucaacaggcccucaccacuguggccgccugcucuuucuucugaaagugcuccugucaacagugguacaguguucugggggucgccaacccaguguucaguguucaguccucuuugggcagucgguaguggucugcauucuuuccuucaguauucuagccugaguuugaguuuuuuagcugugucucagacccacccacuggggggccugaucacugaugucacaaggaacuugugaggagguucccuaaauccaaggagaccugagcccuguauaggugacuucaagucaagcaccucccugugccuggcacugugcagacgcuggaaaaaaaguagacgugggcuuccccuggcaucgaauccugggaugggggugacagauccugggcacacccaccugacaccuugugggcugacgacaggcuguaguccugguacuggguggcguagcacuguggggggaaccugcucuugcuguucuccccgggacugauggcagauggaggcuguggcagcggcagaugucucaggggauggcccaggccccucaugggguuuugggugaacuuaucugaaagaccaaagucagagagugacgguagcauuggccugagggaggggagaggccaggaagcccuagcaucccuuuccuuuauaaaaggugcucagagucaccagaacuacagccaaccuucaggacccucugauggcaucaucuaagucagaguggagauggaaaaguugggugugugggacugcgggagagacagaggacaucgccccauucuaacaaggcucagagaggcagguacggccuguggugaauggaagaaccaggaugggcucccgagccccaguccuuccaccagaacccccaggaggcccaggccuguggccgcugcucaccauuggguacauuugcgcucaguggcuuguccggcaucaaagggcagcucccaccccugagguucuucauccguuuccacaucaaaugugaggugcugccaccaggugggucccccugggaguaagaagggcagauggaaaggggaaauggccagagaaccagguccccagacuggguggguugggugggccuggaacagggcuggcacuugcuggcuuggaagggccacauccccaccccucucagcagcccuggguucccuaagggcuaugcuggcuuggaagggccacauccccaccccucucagcagcccuggguucccuaagggcuauggagaggccccuguggccaguggggaugacucaccccgcucagguccuggaaggcuugcucuucauacuccagcugucgcuucagcuucagcuuguuggagagggcuaccauggccggacucagcacgucugggccucgagccccaaaacccuuugcagaccugccaagcccgagagagcaggcuaugagggagucuggagccacaugccacucagugccuucucaucuuaggggcccuuccagucccaaugcugaugccugugaugacucaaagacccaaaaggcagagucucagaggcaggcugugcaccugcaggccgagcucgagcucugucuccuuccucagcuauaagaugcugaagggcucaagccuccuggucugggggauggcugccuggcugggcaauguuaguccuuaggaggguuucuucugcccaugucucuccucugccuuuugcucccacugaaaacuaguuuggcugcucuauaaagggcaaguaccagcggccccugggaguggcaggucauguaccaaccccugugccuuagcccagugagcucgcagcuggugaaaugagcaugcuggggagaugggaaggcauuucuggagccuaggcacagcugggagaggcugcaguggcgaggacccgggggcagccaaaaggcaaggggaggcagggguaucuuuuugcuguuuucaaccagggaaaaucaucacucaauuuucuguguggcucagaugaugaaccgagauacgaaaggcacucugguggugguccgaagggagacacugagguacagggcucucaacaagccacuucuuugccugcccucaguggcagcccagauaaaaacccauccuacacuaggccucacauggcuugaggugauuccccaaagucugagcucagagaagggcuaaaugggguaucagauggcuggggagaggggcaggggccucccuggggguccagcuaucuuacuagugggugccucucgguucggcccugcugguacagcugaguaucugccacuuaccuugucuugaagguggagacaugggguggagagacagggggccccaacggcgcugcucccaagaacucugugcgcugauccccgacggcccacuuugugggcccaaaauguaaugguggaucugggggccacuggguauuggaucugccccccauggaagagagaggggugcuggccuggccacagcacgguggcagggaugcuuugcuuccggcaucaaagaagauggaggacaugggccggugcucgggcucugucuucuugcucuccagcugcugcugaaacuuguccaggaggaagggacugugcggggcuacaggggccaguggcuggaagauguuugucauggcacugaagcagugcugggggguggacuguggguucuccgccaagagccgcuccucggggcagauggggcuuagcuggaagucuuccccguccauggggauauagggugccagugucuccaaguccagcucauugaaauccgucugaggggagacagcaccggcaaagaggcaaggggguugguacgaccucacaaacacuauuccaacucagcuccugcagagccauucaucucaagcacuguuucacagugcugcucaaacgccuccacuggcucccgagggccuaucaggaaaaccucagacuuggcugugucauguacacgaccuuguaucauguaccagccuucccccauguuuauccccucuucacccugcacauugagaaauguucuccucuccccaucccaccuguccggagcccgccuucucucuugaagccgaggcagccccucuuccacagagucagcccugccuacuccagccuguggugguuauccuuguccuacaaugcuuaggccuguggugcacacuguggcuuuuuuuuguccucuucucccuccuguaagcuggcacgggccuaagcaagcaguaagugcccagguccaucuguggacucucgcagaguaacagccuaacagccagaccccagggacagagacuuugguuccaaucagcagauacucagaucaucccuuaggguggcaguaucaugacggacgcaugauacaagcaggggaauacaagcagaugcggaaaacaguuucuaacuucagagacugacacccucagugggugucagcugacuaaugacugcaauacuaagcaaucuuuaaggagcagaagcagauagcugugauuaagugccacaugauauauacuacaggagugcugaggagggagggugauagaaaagcuaaaauugggcauguuuugcagaguagcugggauuugugccaaguaggaucaagaaacaaacuaaguggcaaggcagaaaucugguugaacucaagacuaagacaaaugggggauuaaugguuuucccugggguuuuguaaaacacguaccccucccucuaccuuauccuuguuuacauaguuuuugcaagaacauuggccuuauguaauaaauguguuccugaaaaguuuuauguaaaugaaaaauugucaaacagauguuauuuauuuuaaagugcauuucauauaaaaaugauuauuuuuuuaaaaucacaagaugaauguguuuauaaagggauuaauuguccccuauguuuauacauguuuuauacaucuggcuaugcuuguuaaauguagggccuguuuaaagaaaggugcagugguaucauuucgguuuucaugugugcuaagaaagcuaucuaaguaggagacacauaugcuggaagagcuggauuugacagugggaggagggggugaccacaggcuccauuacccuguaccccuaccucuuuaggggaccugggccuuggccaaacgucuccacugcucuuuacaacaaagggaugaggcuacaagaauggaugugagccuuugcuguccaccagacagcaggcacacacccuagccugaucuccacagccaucuaccuggguacugcauugguccuuggccucuguguccauggcgaagagcuucucaaucacuucaaucuucaggucguuauccaaagauguguaauagucuucagggcuauugggcuaggggccaggaaggagggggacagagucaaagauauggcacuggucuccccagaaguccagcauggaagaagaaauaccuuccuggacccaaagguucaauuccauuccaccacacaacuauuuguagaggggcugcuaauuaacaagcuguaugaauuaggucaauucaucaaccucucuaaauuccagucuccucaucauaaaaugaggcuacugucgcuucacagguuguccugucuugaggaccaaacaggauacaggcuguggccagcagggcugugcaaacugugcagcucugugccacauacgggauguuacugcccuguauggggacugagcugggggcucaaagcccuucaaggagcuuauuucaauggaguugggggaugaacacuaaaaggaagaaaacagcucugauaccugguagguaagugucacggccacucuagggggcucugugauaaccugagaaggacaguaccugucccaaaugucccuucagccaucuggcagcagucauacauacggagcccucucuguguccucgccauaagagggcugcucaccguggagcagcugcugcugcugcugguggcacuggggguggugcugcccggggcagcugccuggggcacggugaaggcaggcaggcucccagccucgcucugggugcuguggcuccucaacuccguggcccauggcuggcucgggggcaggauggccuugccauaggcugaggacuccucgaaguucugauucccuguggagacaagggccugggaggugaacacccacaaccaucgggcucaccccaaggcagaggaggcccaaaaaccgcagagaaggcccuaagagggucuggaaggcaugccuggggcuaggcccccccaacacccuggggcucagcuggaacacaugggucuuugacucuggcuaugagucaacguagagacucccuuuaaacggaacagucuccugggacauuuaauuuucagagacuaaauauauuaggagccacucuucccugaggaacagauccggaaggguagacaaggaagguaugagagggagaggagaauugggcuauugagcuauuugccucaguacugccacaaaacaagccgcgagaccuacuggccaagggcccgcugcguuucagauucucuuuagcugcaauccucacguggccgcuguagaacccaucuaaaaggggcugacacaguccagggugagcaccacucuuccggcagccacagcaaggccaggagaggguggcagcggguugcgaacuggggagcauggggcuucaaggguguuuccaggauuggagcagccgagggcugaaaacccugccgggguccccagugacuuacauccccagggacaggcagacacuuuaaugaagucguggguuugagggcuuaaucccaggccucaauauguucucuguguuuuuggaaugauccuucccaacauuacuccaacuuggcccucugccugaacaagccaucuguccuuccagacccugguaggaaucugccccuucucuuugacaguguccaaguggccucggagcagaucccucaccucuccccucccucucaucucagacucucaccacccaugguggagaaucgacccucagggggguguccucucuuaaccccuccucguacagcacuuggugaggucggauaugggauggucuuaucagggcaggagcgugugguguucuuuugugcucagcagggccuggccucuaacaggugauuaacaagacuuggggggcugggguagcucugguuaagaaaaagcugcagccagggaggccuguuauaguaagaacucuucccagccccaacgggguuccaggggccuggcuuagcuaagaagcacccaccgaaauccagagagaugauggcgucuccuggggugggagccagcugggccagcuccucgggcuccuccuuuagcuuggugaauaggaaguuacucuucucagacacagcccccuugccacugcuaucaaagaugcuguucauggccaucagguggggcuugaacagggauucagucugguccauggagaacaccacgucauucuucucaaucucacuaaugggggggaaagagccauucagacuuuccacauuuucuagaaaaauucugcuccccuagaugcauggaaacccucauagcuaagcucuccgacaaaaaauggguaggacuccaggcauuggcgucuuauaaagaaccauacaauagaagugugugagccauggagguagugacaacagagguauccucugaauguaugucuguuucggauccuguuuuauuaaauauuauugcacuugaguggggugguauauaugaggccugaugcuuuuguuuuucucugucuguagaaacaacuagaaaugacuuccucuagcuuucuuuccagguacuauagagugaaggcaugacaucuuuuuuuuuucccaaaagcauaagcgauucucuuuccuuuuuccccauucagaaaauauugacuauugugugcuaucugccuccccaccugggucagaugcauggcauaaaugacagaugccagggaaagcgcagaaaaaaaaaucccaacccaguaucccacuguuccaagacauccacaggaaguccucucagucacuaggguuagcccugcaagaccucccugagguggugcccagggcgcugagaggccuggcaucuccuaggccugucauccugagucugggaagcuugggcacccccacauacccugcaccaaggcccgccagcccucacaugcuuaccucaggacguaguugacacacaugaugcacuggggcugcagguugcgaggguuguagaugaccguccccugggucuccagccacacguagcccccaugcuuugcgagcauccgguacuggccacuuacuaccugacccuuggugcacacuaggggaggagaaacagagcugagcuuagggagguggggcaggggugugcaccacaggcucagcagaucgcaugggagggcagucuaaucugcaggggaacagacagaacagggcgccacgacagugaggaccagggagagugaccugggagggagcuuagggaucaccucagccaacucuucauuuuaaauauaggaaaaagaggugagaagaggugaaaugacuugcccaaggcugucuacugagggagggacccgcucacuaugcagcuuugcaguggcccaucaccaaucccuggacaagucaggcucacagaccagcucagcuauaagcagaaccaaguccagaaccugccuuacuuucuucaugggguucaaugagaagaagccccuucacacuggguaaggagcgccaucccgucaagcacuccagguggggggacuucuaagcagccuggagaaagccugaccucagggcaguuuuuuuuguuuuuuuuuguuuuuuuuuuucagcagacccaccaccaauacccugcuuaugaauaaaagcauuuaaaacauugauauccuugauuucuccaggucaucugucaggcuugccaccuuuugggccacugaagguuugugacccacagcaaaggcagaggcaaaccaccccacccuuucucaguuggggcugagaaagagcugggacccuggcagcccacacacagucucuucauaagcuguaauaaaucacuuauacuccuucucccaaccgcccagcuaggcuuccuacuuaugagguuuuuccucuucuagauuguucuacuaaguguucauuuaaaaaacgcuuuuguugucuaccuuggggaaggguuucacaucacagacuguccuuccccaguccagaauguuccaucugcugccauucaaaaggaaucaauaaaucucuuuaaagucuaauaauguuagaauuuuugguauuuuucugaacugcccauuccuugggaauuuacagaacuccagcucagaagcucccaaaucacagagacguuaggaaagggcauggagggaggaucgggaaaucuugcuagcuugggauuuggggaaaggaacaauccuucuugguuuugguuuccuccucugcaaaacaggauauugauaauaauaguaguaacgguaauaacugucaucauuagcuacccagcauaccacugccauuuguacugaggaucgacuguacccacauggcuuaucagguacauaaguguugaccaacugucaccaacaaauuuuguauaggaaaagccaccucuuucuuagagauacuaauacauauuaugcccauggccugucacagacagucuguuacacguugguagauagucucaugaggggccacucgggaggauauccaggcucucgguagacagagagucuccccgguucuccugguaggcucgcaggccuccuccccauucaucagcccuguacagcugaggaacauggcucucuucauacuagugcaguuugguaauccuuuacacuuauguuuugcuuucuucuucacaauuuaacaagcaccugcaaagugcaagaauuccuguaacuuacauuuguauagugcuuugcaguguucagaacuaucugauaagaugaauucguuucugcaaagcauucagcacagugccuggcacauagggcgcucacuaaggauuaggucaucaucacugcauuucauaggcaacaccauggggugccuguuguuauucccacuuuacagcugaagaaacugaggcuuaaaacuacugagucauuugcugaaagaccaccucaguggaaacaguagacagaauuauaguucaaauuaaagauuccuagucuaagcuuuuucuguuugcucuuaauuuuuaaaaauaaauguuauuggggucaaauuuaccuucaauaaaacacacacccauuugaaguauacaguucaacaaguuuugacaaagguacagugaaggcauagcacuuuuccaucaccgcccccaccaccccauuuuuuaugccucugggcaguuaaucuucauucccacccugguuccaggcaaccacucuucugcuuuuugccacuauauauucgaauugucuuuucuagauuuccauguaaguggaauuguauaggaguaucuacucuugugucuggcuucucuacacucagcauguuuugagauucaucauggcguugcaggcauuugugguuuauuccuuuucaucagugaguuguauuccguugcauggacauaccauaauuuguuuauccaucugccuguugauggauguuugaguuguuuucaguuuuugauuauuaugaauaaagcugcuauaaacauuuguguauaaaucuuuguauggacauauuuucauuucucgugggugcagcuaggagugcaauugcuggcuuaccuguaaaguauauguuuauaagaagcugccaaauuauuuccaaaaugguuguaucaucuugucuaaucuuuuaaacaaaacccugugccacagggaggauaaguauuuucuuuuaacaugaggaaacuaaggccagaggguuaugauuugcuucacagcuuacaagacaauagugacagagucugagcuacacaacaugucugguggcuccuaauacaauggucucuuuauuaccuggguccacaaaucacugggaagaccaaacuugcuguugccgcuguccuaaaccaucauggacucaaccaaggaaauaacuuuuguccucucugcucucccuuuaucugugccacugaggcuccucugcugcaguaaaaugauucuugcacaauuucaagugccuguauuuaacuuauuuagaugguccuuaaugcaaaccaaauucagggcucuuacucuuuuugaucaaacagugcagcaagcaaagguuuuaagugcauuucuaacaauugcaggcaagggccugcucugucaguagaauauaauuaacgccagcuuucuaaucaucuggucauuaaugccagccuuggugaagggccugcuacuuaauagauaggaaaauaagauuaaaggccauaaaaagccuaaaagcacauaauauccucauauaacaaagggagacugaccccuaaccucacgcccagaguaacaguguauaaauuauuaauccauuuggaaauuacagcuuucaaugaucuaaaucuaguugagcuucuccaggcauuucaacgguaaaccuuuacaggcuaagacauacauguguguaaaugggggaucccagugugugaaucuggaccugucucaaaccugagccuccaguuagucuagagcaugugugucagucuguagugaaacuugacuugcaaaaccucaaggacgaaugagagacaggggucgggggcaaggggcaagcucgugucauaacugucauuaauccaauuuccaacccaagcagauuucccuuggcuagcuauggguuugucccuuugcuagcuauggguuucugagcucagggcagcuuuacuuggcuccaucaaggggagagagagccugugauuucuauuugggcugugaguuaccuuucagugugccuaauaaguaaauacacggauucaguaaaaagcaccuuauuuucccuagagucagcagaaaacauaaaccauuuuuauccuagcccuuuuuauggauugaagauguucuaagaagaacaagagggaaaauccuuucuauaugccuagucagaagucacaauuuuuuuuuccuuugacaguagcuucuucugcuuucccauccuacaagauaaaagguaauacuguccuccaagaauucccagaaauuuuuacauuugucucuugccuuggcuucacccuuagcuuggaaggaaggcuagacuuuuccccaguuuuacaucuaaagucaggaagguccagaaauccaggcccuagggaaucagugggucggcugggccagagccugggccgcuaagucccagugccuggaugauucugucaccugccuuugaaaacaggaaccccucagggaccaggaagcaugaaggaaucccaaagggaaggcuggaaccagauguuacaauuucaaagcuugggcaggcuaagguggggucacauucacaggcauaaaagaguaccuccacuccuaccccaucucuggguuccugaguggggcugaaucuagguuguuugugugugugugucugugugugcgcguguguguuuugccagagagcacagugagaaacuucucugagauaucauaaugggcccuguuguacugucaaaucaaacccaaaagccaugaggaagaggcagaggaaccaauaaaagaaaagaaagaucucacuccuuaagaguggguuaaccauguucacauacagcuugcgggguugugacucugcuggcugcacugaacuuggcugucuuagccuugggguagauggguggauuuaggagccauggacaaauggcugcccuuccguuuucuccauugccagcagggccacugggaaucuucucagacuuacuuuacccguuuuuaauccucccauaauccucucagcaccacugucugcaccacugugggcacucguuuugaagcauucuuuuccaaauacagucuugcccaucgguuuauauagugcauuuagugccuguucuguaccagacgcuaugcuagauacugagguuaaagauaugagccccuuguucccaaggagcccacgguccucuuuuuuccucagaaauaaggucacuuagggcaggaaucaauucuaccaauuuauaucacccccagugggccaaguacaggguuauaggcccagagcccuugcacagugaugagucgcauggauucaagggaacgguccuggaucaccugccuauaggaagccugaauugggaacauggccaaggauacacucuagaacuucucuguccaauaugguagcuacaagccaaguguggauauuuacauuuaaauuaauuaaaacuacauuguauaaaguucaguuccucgguuucucuagccacauuucaagaacauuuccacugcagaaaguucuauguggcagcccucuuccagaguccuuacauaacucaggcuucuuucaaacugcaaagcagaguuuccauacgccaucccuggguugccuggacagccuuuucuaaagcucccuugauccagcaagcaagcucucugagaacuguggccuaccucaacauauguguuaaguuggacccguaauacuuuccccucuguucagccuaagccuccccgauccuucaagguccaacucaaguguccuuuccucaacucccccugcccuccucuucugugaauguauguacuugaaucuauagcaugcacccaaguugaugauauguugaauuauuuuacucucuacagugcuguuccacaaggugugcaaaccacugacugcacacaggcacuccguggaggugguaugggggacugagacucaacccacccuccacugccucagcugugcaccuuggcacgggugcaucucccuggaggaaguguccuuuuucuaauuugcacgaaggagucuauaggcugguggcagccuugguuuucuaaccaucuugagggcauaagucuugucugccacacaagacagcagcucuguggaggaagugaccuggucuucugucucaccagucacaccccacucaaggccacauaccacagacacaaggaagccacaaggggcacuccuggaacucacaguucuggugacucuuggucauguucucggagucuagcgcaugguagaauucauaggcugagcggccaagcagcuccucagggugguaaccaaucaguucugugauucugaguuuuuaaaaaggcagcauguaaggaagaaagaccauauuaacuuagcacagcaugugggcaggagcuaaccccagaaggcaaaucaaacacacacaugcagaugaacacaauccagacuuucuuguuguaccauguauccaagcaaaagaacacugugcucaaucuacaguugcagguuuaaccaaaccccuguuguuccugcccuuccugaagccauguuugggaggagagaaaagcaccaguucugaggacucccucuccccaccaccccgguacacacauaugucuguucuccaagaaccacuggaaggggcucaccccaaguuuuugcagaugagggaguagacauccaggacgggcagacaauuugcucgaugccuacacagguguccagggacagagcaagaaugaaaacuggggccuccaguugcuacaucaagcucauucuaguagaaggcaguauaaaugaaacaugaaaauuauguggccccagguagagccaccuuugucucugugucaaccagcacgugagagggaguccaggcaggcagaacccgucugugcuuaaaccuucacuuuucugcagguccugccugugaccucaggugcccucggacacuuucuacuugugccucacauuucaaggaaacgagggaggcaaggaggugcugagaggaagaaauauuaaaucauagucauagaaaugugccuuauuauacucuaauaggcagcucagaugacaccacuggcugucauuucagugucccuuucuucauucuguaagguaucugguuuugaugggaagugggcagaggaaagggcaaauguggagaaccaugaagaaucacuuaacauucuuaggacccuuuguuuugugcuguaaucacuaaaauaaacaaagcccugccuaagaaccaccagguuggccgcuuuacccaauaucauguccuauccuaggcuauauaauaccuccauauuaucucucaaaaucuugguucucucacagacuuuaaauaauggcuucacugucuuguuuacuuggccuaucacaaguuagaagugaugccacagucucauuauuacaacucuacuucagaaggcaugacuccuggauacaguccuauaauuuauccuuguaggggaucaauaacacggagaggaaagcagaagcagaaagcagaagcaguggcuccucauuuccugucucugcucuaaacccaccccccaaacaggucaacuugcauacaucugucagaccaaauugcccuaaaauacuacuugcaaccugccauacucuuauuuaaguaucuacagcuuucacuuuugccaaccacaccaacaguaaaugcugcguaacuuccaaguccccccagaaccuacucuccaucuuuugagcaauuugauuuucaacucaucuguaaaauguuauguacccucugucauggaagaccccucuccccucaguucccuaugccuggaaaacucauucuugcugcagaagcuuuaugccuucucuucuccccucuucuccaagcccugacaccuccaggaccagcuaaagccucaucuucuccacagagcccucuccaguuccuccagcacaacgucucucgugaaguccuaaggaguaugcacaauauuacagaaaauuaugcauuugucuccucacauccuaggcugucaaccccugaacucagggaccacuuucuccuuuugcuuccucuauaacgggugcuuaguaaaaaccucaacagcugaccaguagauugauuuucucuuugaaccuacgguacaaacagacaccuguuuaucccagcacugcuaaggaaccugggcacuaaggaucuacuuuuuuuuucuagaauaauaugauuaacugucucaaugugugugcgcacacaugcacgcgcacacacacacacacagaaccugucaugauagucuauccauccuuucuucauucuguaagucaucugguuuugaagugggcagagaagaggcaaguucucugcuugggugagaauuuggggguuaaagccuuugucaaacaaggagcagcucaacagggcugagaggcuuaggucucagcugauucagcccaguggagauuucuccagugagauccuagcagcucauuugugccagccagccagucucagagcagaaggaucugucccgucgcuuggcccugagcagagaggucucugaacucauuagcaauggauacauuaucuggcaaccugacccuggggcuggcgcccaaguacaccuuggcaaagguggagacuggggggaacaaggagacagaacagugcugguccuacgaucaaauggcuucgcugcugggucggaugacuuucaagcuuagccugggaacuagaacugcaugaguaagcccugcuaacaauggucuggccaucugcaggcucacugacuugccagauaaacugcuucuguuccugggcaggucuagaauuuucuagagacccuccaaaaugagccuacuggcauucuaggaaagaugucuuucuacucucugaaggaauuaaauuuccuuucgagauuagaaucuuuaaauuaaaauguucaaaguagauguuuauuauaaucugccucauaauaaaauguuuaucuaauuaauguaucauccauucaaaggcauacaaugggcauguuuuggaaguggaaaaacaaaccuagauuucagaacugccagauaucuucccaguagcagcuuucauuuaucuugucaacuaaaauaaauauuuaaugucuuucuucauuccuuuaaacagacuacuauaaaaacugggaaauacaccacaucccaaacacaauugaagaacauuugaguugucaaacuucacaaagccaggaaaccccaacuuaaagcucauggucauucgcccccacgugcaggcacguagacgccaguggggagguuaaugaaccgagcuuguuuauaaggucgcuccuacggcacacaagggccuuccccgcucauuucccccaggcuccagacaagccuuccgagcugggcugugauaacacaaguucaucugcucucuccaucaggggccagggaacuauuuuuuuuucuuucuuucuaauuaaggaccccugacucacugggaaaaagaaaaucaguuugaggucacccguaaauuucaaagucaacucaguagggcuguucuaagagaagagagaaauguacaaggacuuaauucaccagauuucaaacauaagaacagaggauacuuuuuaauaauaaagucaaaaaacagcagaccaaggaugcagugaggagagagaugcagauagauagucagccacaaggaggcagaggaaggaugaaaggaaauagaaaauacagcuuuaaaggggguuguuaaauucugaaguugguguuaccccaaguaaauacgugggucagcucucugagcacuggacuucagagugagaugugccuucaaaauguaaaaugaaugauucauugcucuuuacucucaaaacuguuuagaagcucuauucaaaauacaccaccuacagcagagugcucgcaaaaaaauuauucucuuggcuacagcgugagugcugccaccucaaguggcagaaagaaauccacccacaggccugagaaggcucgcucuucuuccccgcauguaaucgccagcacccguccacgugcggugcagcgccacggugccugacuucagaugccaccgccuggagucacgcaagaucuggcugcaguuuuuaccccuguucccuacacgaguaaaggauuugcuagguaaauuaaucauguaagcaagauggugagagaguauuuaaacuguuuaagaggaugaaaguuuuaaguacuuuguaaccaccuauuuguuuuccaaagaauguaucugcuaauaaauacuucaagucggcuugcuuuccuuccacacucugcccaucgccucuccucagcaccccgugauuuaucucauuuugguuucuauaugugcuuauaagcuuugacacugcguuuccuuacuaauauguacgcuguucacuaacucagauuucagugccuucgguugguuuuaauauauuuucaucuagauuuuguuugcuuuaaacaguacuuaagccuuguguuuuccucaaauacuacaugguuauaugaaaucuauacaaccagcucuguaauuaacgggaaauccauuucuauccugucuguggaguguuacaggguaccuguagggguaagaguauacauaggaagguuguguguguguuuuaccacuuauggcucuuuauaguucuccuuacugacauuaucuuuaggauccucaacguuucccucacuuucaccauuuuuacuuauucucaacuucuuuguagaaaaacaauucaccauaaauuuauccacagaacuuggaauguaggcaucuuuauucaacuguaacuccugauauuaauauguccuauguucccuaaaugcaaugacaaaacaggguugcccuaaaguucuuuaccuguaaaaauuguaugacccucuuuguugauuugaaauuuuuacuguaauuuugaaaccucuuccccuggugauacugcuccuauccacauaauuugguuuuauaauuuauuucuaagauacaggaagacuccuacaacugacaaaaucgcagugggauuauaugauaauuagaaaggccuggccucuaucucccugacggcuuggcuuccuucacaguuaccucuuucaccacuagauggcaccuccacaugaauuuaagaaccacccuauuuuaaaguuaaacuacuugggaacaacuuuugucuuccuuuuggguaaauggaauguuguauuuuguaccauucacugugguuucauuaaauggcuuaugucucaaacucucaacuccugaagaucaggaaucaucucuuuuacuuugauguaauggucucuggcacacaguuacauagcagaugcacaguaaaugacaguucguaacugguugcucaguauuucgggaaacagaguauauugccuauguuugagucguaaaugaagaagagaucauuaauuccauuaauaaucaggauauuuuucuuuuacccugcuacucaacuugcuccccuugucuagagcaguugaccauagguacauaaaugugaccgacaugaauuguuaugaaauuuacuuuuaaaaguauuuacuauuuuaaaaacaauuaaugcaggacuuaauaugguacucugaucccucauuaacaggaggacaaaugcauuuugaaccaucuguauuccuuuauucuauuucagauguuucagaauagguuguuucagauucaacugauuugaccugagaguucaauguaaaauuagaguugucuuuucucucccuucuuuccugucgguuuucaucuuuuucuccaugacccuuuuucuuuuuuugcuugauugugucuguggucucaguauauauaagacaaguaccaaacugcuucaaaauugauuuuguggauucuaacugccauacauuuucuucagauucuaacuuuucuuguaggaaaacaauccccuuugugggaaucacagcaccuugugugucucagaugucauuaaaccuagugaauuuccugauuaaaauggagaaccccucaccccauuagguaucuuggacaggcauugguuuuugcaggauuugucucuaaaggggaauugaggcggagaguguauauaugugugcaugugcauaugcuucuccccaucccaccacaaagagugaaaacaaaacaagcuaccaaaaccaaaaauaucucaggccucaucaaagcaauuaagauauaacacuuagggauuaaggacuuaaaauagucacuucaucaacugucuaagccaugucugugcccuuguuaacuaaucugcuaaucgguuaaacacaacuucugugugacacagcauucuaugucuuuaaaugcuucuacaugcagcucuccagcaccacugaauucagacuuggggccauguaauuagguuucuugaaaggcaagauuuugcugaaaaugcagugugucucgcagaacuuauaagcaauaucacccucuacauuaugagucacaaagcccuaaaucacgaggcuugauacuuccuuuaagccagaagcuacucuggcuaccagcccugagccaaacuaagaagucagcacagcaucuuuccccuuucuauguacauuuccucuccagccacauuuagacauccaauuccuuguguuucucccccucuucuuuuguccaaagguuaguaccuucagaaaauuaccugaaacucauuuaaaccaagauaaugaauaaaggauaaggcugaauuaccccuuccagaggauuucuucucacuguaacaaggaucaaaaucuuaagcuuaaaaaaaaucucuuuucuauuauguagggaugccaaguuauuuucuaggacaguaggguuuucccagugcuuauggaguuauguuacggaugugcuucauucaccagggugaagcacguaucugacuuucaucauccccagcacuauauaugcucccaggcuauauggcuacgucggcuugagccacuucaccucaaagccagugacacaggggcuaugcagugggauuguccauguuaucucacaagacuacugagguacacaaagcugugucuucugcccagaauguucaccugaauacaaagacugcaucugauaaauaaccuuaccuauaacauggauuccugcagugccugucacuaaaagugcaaucuucuucuugaaccaccaucauuaucaccaccaccaccaccaccaccaccaccaccaccaccaccacuaccaccaccaccaccaccaccacuaacaauuacaauaaauggugacugugucgaaguuccaggacggaaggcuucaugcaugacauuuucucccuaugagguuagagcauuucuuucuacuuauauaacuacccacuagcuccaaaggcugugaauccuggcccuacuguggucagaacugaaggacaggaaugacucaaggauacuuuuacaaaaguucugaaauugugccacaagugguggccaacucuaagaaggggcgaccaaccaacaccaggccggucuggaaucagaggagagaaaccccauccuggagaggagggucccucccaugaagaaaccagaugcccuugggauguccagcugauaagagaaaaguggguaggccuaggggaggcugagcaggagcuuuuuuuccugggguuccaugguuuccugcuagcugaggaagacaaggcagauucuugcugaucugggggucagauucuuccucuuccugccccccagccacuaacugccuucagaagugguuucagcuccuugaguuuaguggaagauuuugcuuuggaggaggccaaggacaggaaguaagauauaagcaauaacaagaagccucacauguguuguggugucuggacuucucaaagugcuugcacagccauuaucucauuuuacagugaccccaugaaacagguuagaaaguguuaucucuauuuuggagaaggggaaacugagaucugaggguuuccugaggagaaacccuagaagaugagagaagaguggcaaagaguuggggguggcaaagagcugccacaggaacugucacccugggacacauggcggcucuagaugcugcagaaagcugaggucaggcagggagaucucugccaggaagggcgcaugcggggggugcugcucagcaagccccaguggcgcuuacucaagccaggccuacccugggcccagucuucugcauuuccuucccucccuggggccggccauugcuccgggcaucuguucuccccaucuuccuccuccuaccucccaucaucaggcuccacagucccagaggcagggcuggugggggaguuaggagcuguaggguaucuaaauacucccuccuaugacaaccccagucucuuccccaccugcuucaaucuucuaaaugagcuaagaacccgagauggcaugacaugccuaagcagucuuaggcacucuuucaacaacucuaauaaaggugauaauaagagcuaacacugaacauuuauuacuaaauuugaaccuaagccaucuaguccugaagcccaugcucuuaaucacuacugugucuccuaagagacacugggccuggcacugggggguuagcaucuggcucagcuaccuucaucuucuucaaaauggcuggacacuggccggaauggaguugcaugcaggaaggaacaaggcggagggaaaggcucagucaguaauggaagagggucagucuccagggcagaagcugaugcuccuuacuggccucugaagcaggaguacagauggaagucucuagacucuuucuccuggggcagaagacugccuugagaauuuccucaggagccugauacacguauggagaaauauguucacaccacaaugaugagaagaguugcacaccaggaaagcucugcagauggacccugaggcucugucaaugggagaccaccaaauacaguaccgggaaccucugaggggcacugaugcaaugaaacaguggcacagguccacgaacaugcacccggcaauaccacgucuauguucaguuccacaccuuuaauacaggcacaacuccccacacacacagguaagacccaucucugcccacagcauacacacccauggcccccuaccugucaucacaguaggugaacuucauguccaugcuguggcggcucaggaaggucuugcuauccagggggauguccaugugggaugggugcuggauugguucacacaugaugaugaggcaggacagcaggggcuccuuguagccacacagacuauugugaggagggcaguuguuguagacuuucaccuggcccgugcagugcaagaccugagacaggcguggaagggucagacauggagccgagagugcuggggguggggguagggccuuaggcauccccugcaccgccguuacccuacaccugggacuccaacccaggccugauguugcccuaccuuccagguggcugacuugagguugacaguacggccucuguuggugaccgugcacuucauccucaugaagaagucccgcucuguggacaugucuuugcuuuuuuucccaaaaccagagccuggauguggaaggaugggaagaaccagcugaagucaguuuuauauggauauucaugagaggggcccagcugcaguuuuucuuggcagccuauuguuuauauuuuccaaauaucugcucucuuagcaccuguggucugccaucaacacugagcuccaucauggccugugaacuaaugguucccacucucaagcuuaucuccucaacuggagcauaaacucccacaagggaggagcugcuccaucauuugauuucccauugcaucuggaacauggucaguggugccuucagagcagcgacacaacgacugccuaucagccacuaacucagccacccuuuccuggggcaggcccaggucuucucgcagaaauuccaagggacagucugagugaggccacaguuacuccaaggguguaagccuuccucacagguuagaaaugucucuccgacacucccgucuuuccuuuauaaccugucucucaggaggaauuuaaccccuccuguaccccauuugcaaacugcaauagcuguguucaggauaccaugccauuagcuuugucccugaagugacauauguaucaaggcucuagagagaacucugguacgaaucuccuuacaguggacuuggugagcaaguccacuuuauggauuaacucaaccuggaucauauccucucucucagcaaaaauuaaaucaccaagaccagcaauauagcuuacuuccuuauaguugccaaacagccucccgauucagaaccauuuuccacuuuuuguaaaacaaaguaaugaagagugccagcugaaucccacuugucugugucuaaauccugccuacaccaccaucucugguaccuacuuucaaagauauaauccugcccccuacccagcaucauagaacaaucuagagccuuguuucgaauagucacacuccuuccuccaggaacagucaccagccccugcacuuaaacuuccagaggaucuugacugacauauuccugaagaguuaugugucaaaggaacuguggcacccuugaacaaaacuucaacauccuuaggggaccccacucaguaacagacugaauagugaauuuuuuuaaaaaagagagaacauuccuucaucacgauuauaaaaccauuucucccauaccaaauuaugauucuugccauuuuaauuuucagaggugggguuagcauacaaugagauauaccuguaucuugggaucuggccccaccaccaggaccagaccaguuguuggguauaagggggcuggagggauucauuuguggcuguugcugggguauuauugaggccucuuaacuugcuaaccucuggauucuccccaugcugacauuugaucuuuuuuuuuuuuuuuuuuuuuuuugagacagaaucuugcucugucgccaggcuggagugcaguggcgugaucuuggcucacugcaaccucugccuccuggguucaagugauucuccugccucagccucccaaguagcugggacuacaggcacgcgccaccacgcccagcuaauuuuuguauuuuugguagagaugggguuucaccauguuggccaggauggucucgaucucuugaucucgugauccacccaccuuggccuccgaaaguccugggauuacaggcgugagccaccgugccuggccuuguucauucuuucuaaacacugcuccacacagaucacuccaccccugcacagaaaccuucaauagcuccccauugucuauggaauaaaguucaaggcccuccaccuggccuucaaagccuuccacaaucugccucauggcuuucuuuuccucuaggaacucacacuaacccuuuaggucuagaucacgaguccacccauaggcuggcaccuucagugaagauuugcuguugcauugaguuugacugaucccaaguccucaauaugcagaucaagagaucuaaaguucuacucagauaauuagaggucacuuggcugugaaucauggcacuugagaacugaaagguugucgccuuugccuaguccaauaccaucaauuugaaaagaaagacucugaggaacagagaaguaggguacuugcuucuggucacagacucaaacucagacuauggucaguggcugaacugacacuaagaacccaaaggccaaaggguuucuggaguacagaagaaaucagucuuugguuuucucaggcuuucucaggcuucaagcaccuacccaugcagaacaugaauccucuuuuuagagagcuuuagaaagucugguagcccuuuccccacagaaccagacaagacacugagcagccuacagggugcucucugccaguguacccuaggacccagguggucuaaggccugcagaagagagagcagaggagcugggugagggagcuguggcagugguagaagaggaggugguugugauucuguacuuugcaggcccaaauguggacugcagacucagucuguaauaggguggaggugagccaaugaagugucuguuuuugcagcgugugugguaauaagagccaaaccuuguaggcuuagccucacugccucuguuauucaggcuggacaagcacaagccccauggcagugacaggugagguuguuaaagaggacaucuagacaugcacagaaucuccccagaccagugacagaaucucagguuuggaagggaccuugacagucauuaagccccaauucugaccaaagcuucaguccucuuaacaaugucccuauucaugccuuuguugaauggccacaguuacaagacaggaagcuccacugccauugcaaccauugcaacgugcuuucugccuguguggguccucucaucuacuggcaccugcuggguauccccauggguaagguccugaaugcuacaucuuuuuaaaccucuucuccaucaaaaccuacuugaccugcgucucaucaggguaccauuuccugugguagcucuucuccaaaaguagcuccaacaagccaugccuuuugacacucauggcuucguguaguuuccucccacaaugagccagggcuggccuguaacaugcucuaaccaacaagauggggcagaagugaugcucugccaaucuggggacaaagccuucagaaggccuggcagcuuccacuuuagugcuucugggagcccuaaacugccacguaagaugucuggcuacccuagagacaccauauggagagggagagucucugagucuccauagagugagagaacaguccuguugucccagcaugccaacugaguccaggguuccagccaccugccacaaggucccagacgugugugagcuauccugaucaccccagccuagucuggcccccagaugacugcagcccagcugacaucacauggaguacaagacccacccacugaacccacagaacccugggagauaaucaucaaagcccuauguuauaggugguuuguuagacagcaauagauaacuacaguaguuacuaugagcacuuuggcacagacuaguuccucauugguuuggguggugucauuuggcagagaugcuugacucuugggugaugaaaccuccuagagacaguguccuaacccaaagguguccccuaguagugggacaccaggcaccaugcagggccagcaggagauauuucugaguacuggauccucucaaugccccaaucucaucucacaggcuacauacuuaaauuuuuuaaggacauccauuuuuccugcaucacaagggccaugagcuaucucccuuauacccguagacaaaggggaggcagauucccacccagugggggcaagaaggaaguaaacacaauuaaggauaccauuuuugagacucagguucucacgaaucuccucauggucgcagggaugagugaagucaaagauacuauguccuguuagcuccaccuguuucaaaaacaagguuaggcaucauuauuccuaacagugaaguaaaagacuccaagaguaagcugagccaccuuccagauuuggaggcagggaggagacugaauuggguuuucucauaaucccaguccagugucagguccacagacagaaagauguaaucggggacuacugaugaugacagagacuuggucuguuaaugagucaguagagagcugucuaccaggauggacaugagcaaagccaaacccaaugcuugggggugggagcguggccugaggcguguggccugaggucagcgagggucaccgugggcauuugcagggagaggucaagugggauuguggcuagcaccuuccacucauuucuacccccaaauggaaacauuucuucuuuugaaagagauagaggagggugucaccuguguaagucccaugaacuugcugauguuuucugacagaaagaucaugucgccaucuugggucaccacggcaaugaaacccuccaaggcuuucagguacaaguuguccaucugcuggucagcuucggcuucggacucguuuucagagcaaacuggaaaggggggggggugggacagcuugcaugaauguggagugaaaacagaugggacuggcacagauaggcauuugccagggauggugcaaaggcauuggguggacuuuucuggaaacgcauacugccaaccaucugaaugucugccuccgccuggcagcaggcaccacugcacagaggacacccugacgggagcugugaggacagugugcuuguugugacaacaguacuucuggcacuaguaaugagagcaguaggagcugcugugugagugguucaggguggaaguuuucccaagcugcccccagcaaccaccuguacagccuauagacucagcucuugucccagaccacaaaaaccuuuuaggccccaggccuuuggcuguuauacacagaccauagacuuuauuucagcccucuagcccucuucuccuaguucauuauuuaucuccaaagacauuuacuuaugaaaaucuguauuuauccagugcaaacaucaaucaaaguaugccugaauauaaugguagucguaguaguaggaacaaauuuuagcugcuaauauauacugcaauuacuacaugaaagguacugcacuaagcaugcuauguaaucuucacagugaccgacgagguagcuacuauucuuaaucucauuuuacagaugaaguguagagagguuaagccauuuguccaaagguauaaagauugcaaagcuagcaagcuuugacagcugaauccagaagccacacucaaccauucauaggcuuuggaguuaaacacagguucuauuccuagaucagccuccuauuaggcuaugacucuggauaaguaacaaccucuuuggauaucacuuuccucaucagcuaaaugggaauaacaauuuccaucucugaauuguaaggauaaguacguaaagugccuaaaacuauaagaacaguaaauucuuucuucuuucugcuccaagacaugcacuacccucaaauugcucagaucccaggugaggaauauguagcacucagagaugcaaagcuaaauaaaaguucaagggugucauagcugggcucccaaggaaaaguguagaugggaagagcucuaaggggucagaggacgagggggucgcuuuggggugaucacagacaacuaacuguugcaaagaagauuugaagagucuuagaaaaaacagauuucacucuguggaaugcaagaagggccuucugaaccagacgggauugugugaacacuggaaaacaccuggagcaagcuucaguccuaggacugaagagaggcccaucuggcugaagaagagaauccauuucccagucucagagauugggcuggugaggcaggcccaguguccuggaggggccucacaugucaagcaaaugugaucagaggagugcaucucaaagcacugcuuuggggagauuagucuggcaauggcguacagaaugguuuggagagagugaagcccagaggugcaaaacagagugagcaggcaacugcauucucagcaggccguacaggugguugcugggugcagccuaggaaaacuuccacccggaaccacccacacuuugaguauccugcccuaucuaguauaccucugcuaucugaaaaauauagacucggcucuugucccagaccaaaagaaaccucuuaggccccaggccuuugguuguuauacacaaaccacagacuuuauuucagcccucuucuccuaguucauuauuuaacuccaaagacauuuacuuaugaaaauuuguauuuauccagugcaaacaucaaucaaaauaugccucacuugauuuacagaacaaguggaugagaguaauaugucaguugcaaacauuaacauucacugaacuaaaaggagucuuccaaauggagacuauucuaaggaauguagaaugcaauucaauuuaugggccacuuggccagggacacaucaaugcugugaaaugucguucaagggccuuucugcaagggaacuggguuucucuuuuaucuuuuuccuggagccucuaaauuuaagcuuuggguuaccugcuguuauuccucaagaagaacaaauccacauuacaagaucuuccuaccaagaggcuucagugaaggcaaaggggaccagcuaucuuucaggacacaggaucagagaacacgccagagucacagaugccuuuugcagaggaucacaguggguccuguccggggaugggcaaggcuucagagccaagaguuggguuguacagaguaaugccccgguggcuuucccucuguucugcuaaaauggugaaacaagggaaauucuuuccucugcacacccugguucaggcggcuagccuggagaggggagaaccacaggucaugggaaugaccuuacaccauacacauacgcacaccugaucccugcuugggguuucugcugauacaccuguucucugccagcucaucagcccgcugaagcgaugaugcaaugucccaggugugggcgaugccacugugaauguuagcuuucccagcuaaaaucuucauuugaacaggggcuuuaggggagaaaaugacuuaacucagugcuuucaaauuugaguaugcaucagaaucaucuauaggccaggcugaaagaaacauuucugagaccagcacugcuacauaauuugcguggcccagugcaaaauaaaaaugugagaccucucauuggaaaaauuaaaccaagccugagaacuuucuaaguguggcgcccucuaagacugccugugcugcacgcccaugaagcuggcccuggacgggccccugcuggguuccugguucaguagaacugagaaucuguuuuucuaaaaaguucccaggugacgcugacccugcuacucauaggaccacaugcugagagcuauggccucaacucaaagauccuacgagugaccuuaauuacccugugcuggcagguggugacuuauuuuggagaugagugaggagagguuuucagcgccacuucaaucacaccagauaggugaccaccuucuguagauacacagaggccaacccugugguuucuagccaaccgagaagauauuuucucuucaauuucuuugaucucagugguaacgcugacuucaaaaucugaaguaaucccaagacaacccuauuuggguuaacuagucccagaggaaauaguccugcuuaaaauuuccuguuuuuaacaguuccaacacagccaaacugguuuccacccaugcccagugcauuugcuuccaggagguggcgaaaucggcuacagcagcaucgggucagcuggccuccgggagggagaggggcaaucuagggccacgaaggguaacagaaugucuugggacugcggucacaauggcuggaggaccaggaagccagcagguuggccccagggacccugugacggcagggccgggacagggucucuucccucuguggaacuaguugcccucacagcaccugcuuguucuccugggagcuucugaaggaaccuggccaggucacucccagcuuggagcugagagugaaaacuggggagccaggagguagccccucaccguggaggcucaugucacaaaucugcugaagacccuucugccucuuccccuaugaacaucgugucuucccugacguaccauuaauauccuacucaguguuacggacaugggaaaaugcacgcgcucccuacaccauuauuaaguuucuacuguguucaugucugcuuuaugcuaggcacaagguaaucuguccagaagugucacuuacugugugcucaguccugucuuaaggagaaucagggauacugaaagguguaagggcaguuccuucccucggaaucgacagacugguggggaagacagauaaacugcuguaaggugaugccacaauccagcaucaacucuuggucagaacaaagugaggagcccagaguaggugcucaauaagccaccaagugggucuguaaaucauccugggcuccagaucucaguuacuugcuuccgaggacccuucagggucugaccccaaagacgagagauggcucauuaaaaccagaggugcucugcugagaaagugcaugcccguccuggggagcauaacaagauucuuuaaugcuaaaaauagccccgguaaacaggcuuugaugacuccccacagccaggauaugcgcgggcugagguuuuggagcacuuuuuccggagcaacgcucauuuccuucaggcagcaccgcccauguggggugggacuuccugggcagcaggggcugugcauugggagagagcaggcagaguggcagagcagaggcuccugaguggucucagagaccaggcugccccacggugcugcuggucagaaugcuggcugcacuuuuauuccaccaaggucgcuuugccucuuguuuccuacuccgagaaguuccaggacugcucugacuguucuuaaagccauucugauggggucuuccugguucagaugugcuuggcaguuaccacuuugugaccaccacaggggccuuccuucuaaggcucugccuaaacugauuccuccccuccaccugacccacagccuggccccucaaaccccgcccucccggaugugcagacugcaagagcagugccagucaagccacagggaaaucacucugggaucgcuuacuggauccuuagccauaccuuuaaaugccaccauuagcaggccugggcuccucugaugccuuugacagaaggcacuguguccuuccugaucuuccugggcucccugagaguccugaaaguccacuaggagagauucaugccuuuguucuuugcauguaucuuacuauccuaucuugccucucuguauuacccuugauguaguacaggacuggguucagcaaacaccuguugacugacgagacuuuuuaguuuaaguuaaaggaaugaucugaacaaagucaguaucucuagaagagacuguauauuagcuguucucacccauuaacauccucacaugaaucagcuuauugaguucuuuccaaacaggacagaaaaaggccuugauuuggagugggugggacaaagggguggagguaggagugaaagccugggaaaagaagucugaaaguggggugugagaggguaccagaacauauaucugccuccacaauucuuucuuugucccacuuuuccugcauggaaaggucauaucaagccuuaaaaacuuuaaaaucacuugucucacauuuuaauauccuucccuuaguagucuagagaucaggaaaauauaaucucuuguuauaacugaugucuucgcuaagcaaaugaugaugaauccauaaugcaacugacacuucucuuuagaaaccuugcuucacgcugaucuccagguccauggaaaaugaauuugauuucgccauguaugaguuugggcaagcccaaaauucaguuuuacaaugaaaagcaaauuuuguauauucacugcgguuuaaugcccucagaaugcagaguugacccugauucgcucaugguuuguggggcucaucuugaaagaggauuuaggacaaucaaguggcauuuccaccgauguuccuguaagaguguguucuguccucagcccagcguggcagcuaauaucauaaagcuauuguuucaguuugcuuccugugauacgaaucucaaucggcagcccagacccacagccugaauuucucaacguugagguuuccucuccaacauucccacacagaacagccuacugugaaaaucaaagggaaacguguuacuaaguaaagagaaacuuuucuaaagaaaaaccugguauuuuuuagccuuuugaacuuugagguaugcaaccagcuauuuccuauuauaaagugagccaaaauugguacucaccuuuguuagaaaugcuuaaauaaugaauguguggguuguuuugccuuggaaaaguuugacgacucugcauuuugauagaaauugcuagaaaguagguuagaggauaguaagaauuuacacuggguuuucuuuuacaucauuucuccagaagccuauauuuaauauaaaucaauauauuuguucauaauaauuuuuauuucuaagcuauaacuuauugagagcuuaauauguggcaggcuagaggauaaggccuuuuauaucuguuaucucaauccccaaauaacauugcaggguaagcaccauuauucccuuugugcagaugaggaaacuaaagcucaaagagaaauuuuuacuacauugcagagaaagaaggcagccaaacuaagauuccaaugcaggucuaucugcccacaaaucccguacuccucuucauaacgcuacauguguuggaaaagcaaaauacgauuuagaaagaaaaagaucuugucuuacaauuucugaaaauaacuuaacaaucagucuagcgaauguguggcaggagccugggagagaagucagagaaaagcgggugcugagaaaccaucuccuccucccugggcugugcucguuuggugagaauuucuccuucaaggacaucaggaccacauggccaaaaguagaaacuuuuuauccuuuuccuucauuucuuuccuugggacagagaggaccagagcugacaggcuaaaggcucuagcuggucuagggccgagcccagccagagggcaggcaaguuuguguccacaacuuucaacaggcuccggagaugggauagauaugggaugucccacuguggccacucugguccuaucucuguggguguguuuagcacacagggguucccaucagcacaugagggcucacaccagaacacacacagguagaugugcucagggaguccagccuaacucguggccuuuucgaggccaaccuuugaaccacugagauggacagccaggcucaggagggcaagcaugcaaaacgaagcccugcacuagggggaaggacaggacaacucucugaaugugugaggaccuccuccccaucacgcuggcccccagcugcuucuguugaccuuuguuccccuaccuucucccuucccccacaccccauaccccagcccuugucagcaucuuugccugaccagguuuacaaaaugcucuugcugucccaugucuguuuucccauggaccaaaauucaaaaggacuugaauuccaggugcagguucaccaugugcuaaaugugugacuuugagcaaucuuaaccugucugugcuucacuuaucugugaaauaaggagaaacacaacgaguccaaauuuagucagaggcauucuacaauuaauauacagguugacugucccuaaucugaaaaccugaaaucugaaaugcuccaaaauccaacacaacauucaaaggaaaugcucauuggaccauuucaaauuucagauuuuuggguuagggaugcucaacugauaaauacaaugcaagcauuccaaaaucugaaaaaauuaaaaaaucaaaagcacuucugcucccaagcauuucggauaagggauacucaaccuguauuaccccuucuggggcuuuguguggguggaggaauugggaguggugaugaaagaagcaaugauuaauccaaaggaauuaaugucuaagagcaaaaucucaaguaccacagcaggaaagcaggggagaggguucucacuguggggaaggggccuccauccagucauuaaauccuccacugucuacucuuuuuauguaaagaugauugcaacauuagccaacuuggcccucaguuauccaguaagacaagccuuuuuaaagggagggguacacaaaugcccugugauggagucucccagccuuucuuauauccagcaauccaagccuugccagggcucagcccacuguucucucuuugcagcaucuaggaucauguaucugccauugucuugcauuguucuuugaaaguauuuauggagcauaucuucccccuuggcucuccugcucuugucugcacauuucgccucuuuaggccuagcccuccaaccccaggcccacugagcugucguccuauuuucugaaagucugucccccauauccuuccuguacuacagggaccagaauaguacauucuggucuggccucccagccucacacuggauucccucuuucccagaauagccacuucauaacaggauggcggaguccaccgucuccaaggcaccaggcuuacuccggaaaacugaaaaacaaccacaaaagaaccuucccucccugagugccucccucaugcucacccgucagacacuguccccaccuguggcaccagaccagguggggaggagcacaacucguugcccagcguccuuacagaacugacaccccugacgagaaugucaccuaggaucugaaaccagaagacuacucaagacaccuguuucuggucaggacgcauaggaaaugguuucuugaagaauguaacugagaaaaagcaaaugucuugugaacuuuggaguugcagaggugcuagggaggggagaaccaguuauuuuccgagggaggggugaugucaaggacuccccagugugagugagcucagccaggccaggugcuuuauggacaucauuucaguccauucucaccgacacccugggcaagaaguauguuuaaccccauuuuauacacgaggaaaccaauguucagagagacuaaaugauuuacuuggccuaacuggcuucucagagggaaaagaucauccgggcacaccuucuugcuguucuggagaaggcacuggaaguuaaggauuagaaugcuuccugcggacucaaucuaguguggaggaugggucuuauggccagauggcaacaaauugagaagucagcaaaagccguccuugguucucccagcccguguucuccacagccucugggugcccauguucuucccugguccugucccugcccuccucucacagcuggauucacgguaaaggucacugcuggaagagagauguuuaacaugaaggaauaaaucacucaugaugguguuucugugggugaaaguucuguaguggggugacuuuccagcucuggcagcagaaggguccccugcauauaggaacaugcugguaaggcuggcaucugcccagccuaggggagccugcuggccuuaccugaggagaggagcuuguguguucgcaggaagcugauugccagucgcaugauggaggccuuguccagaugggagcucacacuguggggcagaggcagcucaugggccagcucauagaacaccuccgucuccuugcuccgccggcaccgcgcagcaucccgggacuucuccuuccuccucuccgagcuacuccuaaguggagaagaagggguuagucccggaaagguuacugucagccuaucauaccucuggccaggacauccccauggccccaacccccagugcagccacacucccuuacuagacugaucugggcucacaccaguugucugagccacacacaaccugcuuuguauuguuagcucugcuuuuguguguguuggugucuucacaaccaaaguccuccucuugcauucccuguggaggccagaacagggcuucacauggguggagucugggcaaagacuggcugauuaaauuaacuaccaaugccugggaccuagcccuggaauaucuggggauaggggugaauguccagggauggaaagagaaggguaaggaagcuaugaucaguggcucagauggcuuugucaagggcucuggagaacaagauaaaaaaacugcuuuaagguucuuuuucugcauaagacacaaucagaaaaaauuaagaguaguacugaacccuagaucccgcuucauaccagaaagugauuuccacaguaaaaacugaaaaugccauuacagccccagaacaguuagccagacacccaacagucuagaguaccaacgugcguucugucaaggauuaaaaaggagugggcacaaacauuuucucucuaagcccugccagcauagguugccaggcugucucagccucauucuccucuuugcugcaggauggaacgaaagaugacacgcacugaagccugccucuuuuagaaguccuaaagaaauccuggacuuucuuauaaaguccauggcaaguucuagcacgggcaauauuuaaaagccagaauguuuagauuggaguucuaacuucucugcuuguuagcucuguaaauaaaucauuuaaacugcuuagccucagucuccucaucuguaaaaugguaacaauagugcuuacccuacagaguuaacugugaggacuaaaugugauaauuuauguaaaaucuuuagcacuaagccuguuccaacuguaagcaaucaauguuagcuaauacuaauuaaaaagauggccaugaaaagacaaucauaagaguuaaaaaguuacaaaacaguacaggacaauucuauuuucacagaaauguauuauacauaauacuuccuauaaauuauauaggagaaaggcuagaugcauaauaacuauuauuauagguaucacagacauagugcuuacaaggacuguuuuaagcaguacuaccuuggcuuauuuaaacucacacaacugcccuuggaaguaggcauuauuauuauuauuauuauaccuaauuuacauaugaggaaacugccccauagaggccaaguaauuuaccuguggccuccagcagguaaauggggaagucgggcuuugcacugggaaggugggccccagaaucauggcacuuaaccaccaaugacuguccugucuccuucuacucaaaaauguuagcaguugcaugguagugagguuaaagggaguuuuuuugguuuuuguuuugcuuuguaaugcuuaucuguauuuucuuguguuucuauaaauaaccuauauugcguauuuaaugaagaaacaaguauguuuuuuauuuuuuuaaaaagcaucuaagccaggcaugguaguauuuggaccuguagucccagaugggagaaucaccugggcccaggaguucaagaccagcccgggcaauauagugagacccugucucuauaaaaauauaaauaagauaaaauaaaaaagcauccagcgaaguucauagguuucaaggccucaauccaaucagcucuagcuggcucguucuguccugccaucugagaucccagaggcugcuucuccuuuuguuuggcuuugcagccugcuauuuggacagaaaaucuguauuuugggauucauggaaugugagcaugccucucaaaucccucaagauuuggggcagaagcacuguuuugauuuuacaacauacuucauuuaaaaagacagacuauccagcuccguggauggauuaagcaucauauacucggauuaaaggaugaaucguccaacagcuguugauggucaagaagaaccuucagaaaaauugugaaaugagugaaacuauuuuucucgucaugucucccuucucugcuuccuuuaucuaaucccuguuucccucucucccugacuuccaaccuucaggacaccuaccccugcaccccccuuuccccaccuucucaggacuugcccugauuagaccuuuaguggcaguuuuuauauuagucccucccacgugcauuuuaauccugaccugauuguggagaaaaaguuaaagaauugcaaguauucuggcacaggaaaggaagaugggaagagggcaggaugcugaaaccgcacacaucaugccuuuggaucaggagggucaggugaaagaugcuggauuucauuacuaacccuugugcucuccaacaaaagcaucaucaacacauaaccucgucaucaggggccaagggaagccauccugaagcaaaagcaaucccagcacaggcuauggcauuaacgccaauaucugcaugcacaaagcuucccucugccauuggccccuuccucgaagaagaggcagagaggaaaagccagguagggaaaaggcaaucuggagucaaugcucugacaauggcaucugauauaugagucuugcugugcuuuuugugccuggugcucuaucaaaaaccuuucauauauuaguucauuauacucuuccuaacaacaaaauaaaguagguauuguuuacacaguuuagagauguggaaacugacgcucagaaauaauaugucauuugcccaaugucacaaagccaaugccuacauaagccauuuaaggguuuauagucagugagcagacacuuagaaguccggaaacacacaggggaucccuaucuaauuccauccuugcaaccaagugagguaggcaagacagguacugucacuguuccccuuucacagaucuggaaacagacacuugagcagguaaguuacuugccuagagcaacccagcuaaucaguggcagagcuagggcuagaacccugcucuuccuaggcgaauacucuuuucacugcuuaacuguaggagauaguggcuuuggcaagaaauaaagaaacagcaacaccuuagcuuccagaaaaaggaagauugagaaucuuaggcagccucuugguucaaaagucagggaggugggauuucagcugaaccuaaaaggacaaauaauaaugccuuuacagaaagcacuucuucuuaacauguguuaucucauuugauucucacaacccugagagauagaaacuaucaucuccauuuaauagaugaggauguggagauuuagagagauuaaauaauuugcuaaaaacauugucucaaaccuaguucuucuggguccaagaucaaaaguuuuuccauuggcagcaaggagacuaucauuuacuguacaacuuugauguucccugugcuguguugauacuuucccacaaccuggaugcucacacauacuuugggaagaagggcuaauacuuuuuuaaauacagugacaaaaauuucaugaggggagccucaugucuuuaagugugcacccauucaccuuaggagaacaccuggaauguuaagaguaggacuaagaaccagcaucagaguucagauggggucggcgggggaagaagggacuaagugcugugggccuuagcagacacaggugccggucacaguagugcugggagggugggggaauguuaucagauguggcucugcaguguuccauaaaagcagcagguccaacccugccacaguaucuaucuaugccgcagguggagaaaaagguguuucuuuuuguuuuggguuuguuuuggguuuguuuuuuuucccccuggacauuuucauaugcacaaauuuauaguuacucuccccgagguggaaacucacauucugaaacguuugaucccagcuaaaguuaacaaccacuuaagcaccaggcagccagucaaaagauaaaacaaaacugaaauguccaaaaauugucagcagagauaugcuacaguucauccaggaaaaaccucuuugcccagagcuucguuaucuuaaaaacaucuuaacuuuuaggucauugcuccgagcauggcuuagggaucgcuacuuaggucaugaaucuaaggaugaucugcucuuggucaagaugaucuugguuccugacuuccauaugaacacagccuggagugaggccccaagaugucugucaccaguaacacagagggguuggcugccuaauuagcuagacuuuuagagugauuaggacucacaugccuaaugccuguggccauucagguaucaaaacaauaugccuauuacccuauaagguuaaauggcuuagaaacagaauggauuucagcagguaaagagaugacugaggcuaauuaagccagcugggaucagucuauugguugguggugaaauuccaagcuggagccaauuugcaagaagcugagaauggaggaaauaaaggucaaaugcaauugggagaggucuagugacacuucuaugaggcuuguggcugcuguacaggggcugccugauaggagaaacacacccagcuccagguuccagagaugagaaagagucacugguccccauacuuaacuggggcagaaccaaagucggugguucucaguuuugcugcucacuggagucaccagaggaaccuuaaaaaacagaugccugggcucuauccccagagauucagauuuaauaggucucaggugcaggcugggcaaugggaguuuuaaaagcuccccacguguagccagggcugaggaccacgguuccaaagcagccaguuuuuaaaggaaggauggaugggugggugugugugugguggggggaggcagaugggguuggacuuaaauguuuuuggagaugcaaacagcuaugucaccuuucucaaagaguaggaugaaaaggaaacauauuuauugagcacuggggccagaugcauuuaauaaauggucucauuugauccucacuuaaaugaugcaguguuauuggccccaguuuugcagagccgugggucucaauuuuagcuugcaucagaaucaccuggaggacuuaugaaaacauagauuuccaggccugugaucaugugucuauggaagacugacgcccagguccacuuccaaaaccuaaccacacucuuucccucuaccaugcacuguguccauauucacuguguccagcaaauuugaagucaccaucauaagccaaacagucauuuaucuaggaguuggugugaucaccacuguaccagaugcuauggcuaauaggaagagggagaugaaaauaaugagacaugugaaauagaugccacacagaagguggcuacccuucaaagaagccaccuugggagaagccuauaacuuuaugcugguagguggccaucgcucugucuuuugggaagucuuuuagaauuaacuucagagccacauaagaaaaucagucacaacucuucaaaggacacaccucauuucaaaccccaaacaauauuauccaguuuacccaccccguuagucaccagacuuagcuguggauggauugugguuguuugauaggauaaaaugugcccucaaaagauaagacuuugccacaauugaagguauugaaaagaauggucuuggcugugagggccauuccaaaggagugacaaaaauguuugagaugaaggcaguguuccaguggucaguguucuagguacauucugauguccaaaggcugcagggaucaguaggggaaucuaucacaaagggaggaaagguaucaauguuagauagugaaaacagaaaauaggccaggcacagugacucaugccuauaaucacagcacuuugggagacugaggcaggaggauugcuugagcccaggaguuugagaccagcugggcaacacagcaagaccccaucucuaaaaaaguuagaaauuagcugggcacgguggcacacaccgguggucccagcuacucaagaggcugaggcaggaggaucccuugaccugggagcucgaggcugcagugagccaugcaccacugcacuccagcucaggugacagagugagaacccaucucaaagcaaaacaacaaaaaguuacaaauucagaauggaaaauauuaaauuagcaaauucaggaggagcuggccagaucagacagacuuugacaagagaaaaaaggcauuaauaugcuuuaauacacacaccucuccugaggggcauggucucuauccugaaagagaccacagcccaucugggagauaagacuaauaauccacacuaguauaucaaaagucuacaagaggggacaaagaagagagaagacaugagacuggagugguuaaaacagggacaaaugcuuucacuugccacuucccugaaagaggaauccuggaaagcaucucauaccucagccucccaaccuccgcuccgcuggggcugagccuccagcucucugaccuacucuaacggucugugucccuggagcagagggccuggacugcauucagcgcugacaguaaugucuggggcucacccagcauggcccucuaauggucaauucugcuuggguugacuggagauacuuaucuucuggccuucucagccccaggcagccuuguagaaaagagcagcagauucgauuacuaagcagcccaucuggggcuccagauaacccagcuccuuacguaaccggaggacacguggacuccccagcccagcugggaaaagcuguguguacacaggaauaaucauaaugaacugucccugugcuuagcuucaucaagcccaagccuuagugggugccaaggucugaauguuuacguccccucaaaauacuuauguugaaauccccacucccaaugugaugguaucugaagguggaaccguugggaggugauuaacucaugacagugaaguccucaugaaugggauuagugcacucgcaaaggaggcccaggggaacccucucaccccuuccaccauguggagacacagcuaugaaccagaaagugggcccuuaccagacacugaaucugcuggcaccuggacacuggacuucccagcauccagaaccaugagaaaugaaacucuguuguuuauaagccacucaguuuacgguaucuuguuguagcugcccaaaugggcuaagacaguggggcauucuuuauucuacauauuagugaauaauaccacuuuacauuuggaucacacacuacagucuaaaacacucgugagugaaucuggaaaucuguaacuaaauuuguaaauuucacacaguaggcuaggaagagcagcuaccaucauucccauuuuagagauaaggaaaaacugagguuuagaaagguaaugggaguauguggaacuggaacaaaagccccgaguucuggcuuuuucaaggcccugugaacagagcgccugcugacaagcagcacuggccauguggcacgauuagaaacagaccuucauuaucuguccaucauauaaccuagcuuuucccaacacauaauuuccuuuuuaaaaaugccguggugaagauaaggguaaugcauauuuaguauaagcaacuucaaaaauacaaaaagguaugaagaaaacgagcugagaucucauuggauuuauaaauuaauacuuugcucuuuuuacuuaacaggauaucccauuaagaauucuuucaaaauauucauaauagccagcaauaucacaucauguggcugaaccacaaugcauuuuacuauucccuuauugcuuuucguuaugguuucuaauuuuuagcuguuauaaauaaugccaugacaacuaccuuggcaucagguauugcuuacuucuuacaauaaaagauauguauccagcuugcugccagcuccccguagccaccucacagugaccccacccccaccccaugaaagcugaguuggcagauuuggcuacacuggcauccucaggaccacagccagcauuacugagcacaaagcaugggucacggugcuucagagggcaguaucagagggaaggaagacagaacaugcaacagucucagccuuggaaccaggcucagccuccuuuucccauggccagcucucucuaggcugcuucucuuccucaugcauacgcaggucaaagcaucugaagagaagaccagcugugcuaaaacugguggcuuccuuugacucuaauccaguucugagaagagggccacccuugcugaugagcaggaccucuucccccacuguaaaaauaaaguguucuuuccaucuuucccaccccucaucuuauccacugcagggauguauagagaagacucggugcugucuucacucaugaaaaagcagggagaaagccagcgggugcaggaggcauuugcguggcucuccauugcucucuguggccucugaugucugccacugcccgaccccugacaccaugcagccuucagcuaagagacuaauuaaccuccgcaagcugagauacugacuauauaacuaggaaacaaccacaugugacucuuuccaguuaguaaagaacucucagcauauugcuucuguuuaauccugaaucaaucuugcagagcagguguaucacucccauuuuacacauaaggagacagaccccaaggauguuaguggcaugcccagccaucacccagugauggagccagcacucaaaccuggaucauuugacccuaaaucccauauucuugauuguaauugggugaccuucccuacaaggccaauaagcaagucccucagguucaaaagauuuagcugagcugggcaucuugagggugaagccuucuaggauacuaaaucugaugagcuuuuugaaacauacacuuggucugggaagcagcaaagugagacacgcuggccaccauuuugccugaggccagccccucagcuggcacaccagcccccuugggauaguucucagcuuggagaagucugucuuuaaaagaaaaagaaaaaaaaaagguuugugcuuugcuugcggagucuacagcugccacagguuguuuccuucucaccagacuguuuucuuuggugccaccucucugggcuugaagguauuuccccacacccaggcuguuaccagaucugauuuagauuuuuuuccuuagggcuucuacccaucagcagccuucuuccuuuggaucucacaagcuuccaacaacaccaucugugguuuggcucaaacccuucugccugugcugccauccuguuccuacaacacugccuucagcuaagaaaauugacaaagaaauugcacggcgguugaaucaagaagaaaaggccugagauguaaaacggauuccucggcaugaagcaaacuccguggggcaaguggggagcaguuucccgccccacuucagucucuaggggggacuuagcuacugcugcugccccucccacucccugccuggaauauacucucuccaucucccaggccugucugaauuaggcucauauuucaagaucucccaugcauccguuucccuaggaaagccucaccugcacugacuucuccuccaagucccauuucagagguuacacacgcacgauuuggcccuguguugcucuccuugauuucacuucuguggcuucugucucccuaacuagaccacauacucuucagggaaagaaccccacaccuguucuuuugguguccucuaaagcaucaguaguacaaagugguacaaacuggagacaucggauaaaaaccacgucaaugacuucaguucuguggauuccucaaagcugcucacuguucuagaucuuuccuaagaauucuaacccggcucuuaauuagaauagacgguuuccaucugggaagagucacccugcggacacucaaggugugugugucuguugguguuuugucaccucugugaaucaaaucuggggucugaacuagugcugcugacagcugccuguggagucacccagagcagcacuucccaaccuuugcuguggccaggaaucacccagggaucuuguuacagugcaggcucaguaggaucugggcugaagccugggauucugccuuccuaacaacccucagaggaugcugauucuacuagucugugaccucacacuuugaguagaaagagacccaggaacacgugcgaucuugagacugaagaugccaucuggcaggguuagugcugccugcugccauccuaaucugaggcacguaaaguccaacaaguccaaucuucucucuggccaggaagaauccuguucucuuuguagcuuucuuuaugggauuuuacuaagcccuacauuaaugucccucuccuccuucaagucuucccuaccuguaucauuuuauuccuuccuauuucuucaaaacccaccccuuaggaccagcccaagcccuacuucuuccagcagugucccuggccccuuagcaacauucuccaggguacuuccugcccacacuacucauaggcccuuauuaaaggccucccugucuugguggcuuuucuaugcaaacguucuacuccuauaacugugcuguaaguaccaggggaagggcacagacacaacaucuuccacuuucguguauccuucaguggaaccugggcuagggcagacaaacuggguaaauauuugcugauugugaaagacaaucaaaaaugcccuuugcucuuuuccuuucccucucaaggaggaaagaaaaagugaucccagcugccuuggccuccauccccagcccagccuugcuccucucccaggcgcugcagcuggggcggcuuagauuuuauuucgcucucugcagcuccucuucccuucagugaagaguuaaagcaucgggaaggcuccuucccacuuggaaaucuccauuuccuccugcagcgugaacaagagaacucuauggacagaggccgagugagccaacugcgcagggagugaacucacucugaauggggcuguucuaacacccgccaagucaagucauuaagaugccauccccgaggugcagcccccagcgucaccucuggauauccauauccucaagcccgccggcagaaaggaugaauggugagcacagagcuggugaaagcaagcucuuucaugagcagggcgugagaggaccucuccggcuccucuuaagguggggguggggcgcuucggaguagaagucguuccuccucucucccacugccuccucuaccacaccgaacuaaaauuaacccucaaauuuacagggaguuacccaaaagauugcuccacaaaaggcaaccaagaagggggcuggguaauaacauuagaaaaaauaucugcaaugccaaaaauaaucacugugucaugagaaaacagagcuggacugccucagaggccagcacuggguauauacaggaaggagggggcagaaauuccccuggcagugucgucaaacauucuggauggaaaaaggcggguggggggcgggggugcacauaaccgggacagacaguugucagaacucuuuucaaguacagaauaugauuuuaagggucaguucucucuucuuuauuucagacacuuuaauuucaaagaaaacauuuguuuagacuuuuaaucaggacugaugcuugaucacaugcuaauagugaaauauccuaggaucugccuuacuaaucccaacauguugccagaacuucugguuccuggaauuuaaaguauuucaaaacagcaagagaagggggagaaagcacgggaucccucacucuccuacccccauccucauaaccccuucuccccucccuauuaaaaaaaggaaagcaaagaaagaggaaaagugaaagaggagagagcugguagagaaucuguccugggcuuccuuuauaaagaauccugaucugaggccuguucacauggucacaugucuaguauugugggaucugauucaugccacagcgcgaacacuugcuuucccccaauucugcccucucuugcucugaugagaagugagaugucugcgcacauuuccauuccuuuguaaagaagucaucaaaagccacaggaaaugcuaaaagucuuuuccaaauuuauuaucaugcucucaaauaacauugagcaauuugggaaauaaaacuguauuuuucccccagcaauggcuuauucccucugcucauucaauauauauuaaugauucucucuuccuacgauggggcugugagcaguagaaugaaauguggaacaacuaugccugaccucagggagcuugcagagaggugaagagccaaguccugaagaaugggcugaacagucagggcuguaggaguuugggaggagaaagccugcaaggcuggagaagacagggagaacucugcuggagguuggcuuugaaagaagagcaggauacagggaggcaaucaggauggcagagggaugacaaagacacacugggaaugggcagaggugccaguggucgggagacaggcuagagaacagggagcaaggcauugagaaucuggguggggagaacgcauucauuaaacagaccuuguugaguauccauaaggugccaagcacacgaaagggcuuuaaacaaaaggacagguagcuaaagucagaugcccggauaauugccuagccuguugucugauuaguggcugaggugccagguggugggcagugccagaacccaaccuccaugcuccuccugcuggucaugcuuuggcccugcuggacagcaagugugagaaccccucuuuucuuggcaccaaagccaaggaaaaugaaacccucuguuggaagcucuaaauauggcagcaauuccugggcugccacaggcuggagccucagcucaguccacagagaccuccgcaaggcauucuugcugaacaguaacucauaaauguuacccaugggaugaaaaacaaacuucacccagggcacacgccuccucuggcucuggugguguuuuauuuauuuccacagaccuuaguccccaucuucuguuuguuucccuugccccucacuuucuuuaccacugaccaagaauaaaauuugagucagaucuuggggcaaggaacagcucgccagcccaccacucuuuccccaaaaccauuuucagcuugucgcucccccauuuuaaaaugaaaauugcuccccaccauccucaugaugaaguccaagcuggacgugcuccuugaggucucccagcccuuuccaaacuuagcuccuacgauccuguagcuccacgcuuacuccagccagaccacacuaugcccugccacccccaaacuccgcaccccuuucugcugcccagccauguccccaguugauuuguuccaccugaagugcuucuuccuuucugaccuucuaaacccuaaaguuugagagccaacauaggccugccaccuccacagaggcuuuucugagcaucuuaccgagccuacacuggugucuccuccucacuccugccuggaacacuuagacaaucugugcuacuugacugcaaggcaccgucaccuuguuaguccuaguuuuaagguucucugagggcacaggcaaaaugucaaaccucucauguaucaaaguaccuuacuccaacaauaauagugucauacagcccuuucaguuaugguauggugagcuggcaugaagauuaaaucagucacggucccccagcuguggggguauugcagaguuccaaugcuuuagugcuuccaguagaaaguggauuaauaaaggcgagugaugguggcuauauucaucacuagguugcuuaacaccccaugacuccucacuguccccaggaaacaaaucccuguauacuaaggauguuuucacacagaaguagcuggcugugcccgcuguccacaucauggguguguuucgugagccagcugcuagucagcucucacugacacaggugaacaaguccggacaagggcagaccccuccccuccugacccgucccauccuuaagaggccagggagguuucugccucagaucccaccuccucgacacuacagaacaaucuguugcccaacacccguggcccagagcccucaccucacauguguaggugcccugcuuggacucagauuucuggcagaggaugccagggcuuggccaggguuccacccuucuggugauauaacauagaggugagaaaaugggccaagccccagggggaaaaagccacuaacacaaaaauccuaagaaacaaaacaaaaaugaaaaccuaaugacaucccuaaagaucagcaaguggggcuaaagaacagcccacacuuuggaaaaaacacuguccauuagcccaaacuucaaaaaguccacucuacucuacuccuccgccuuugacuucccugcaagacacacaucagacgaggaggggguuaacagaacccagcugccccucuuaucuggcuagccugcuaauggcgaaucucugcuacugaggucccgucagugauuucugcaaaucacuuuuauuagagauaaugucaucuuuacuucauuauccagcccagcagccaaagagaaaacaaguugauacacacacacacacacacacacacacacacacacacacacacguauuuuuuuuuuuuuuucugugaaacaccaguucuguccauuaacacugacaggugacagggaacugaaacuccuggaccauucuuauaagauuuuggucaaaacuuggcacuuaacccucuuuuuccugggacaagcagagcacaccccacagccucuuccccagagccucuaaagcaaugguugguuucugugcgaugcucauugcccuggcagcugaagacagggccgcuggugacaccauggcaggccggccugcacacucaguucuguccagcagauaaaacaguuguauaacacgcaggcaggugagugcaggagcacugcuaauucuacuuuaugcaaagcaauaauuaacaugugagucagcagcagagaaagacuuuaagcccggggaaaaaaaaacagccugaaaguccugaagccucagaggcagcgccgugucugauuaaacgauuuagaagauuagagugaguguagggagaccuaaguggagguggggugugacugcaguggcucucccugaguagucucucagcuguguccaggauacucugaauuucggugccgguugguagaaagaaaagguucauuuuuccagaaucaacuaagaaguggucuuuucugucucuccgcuuaguuauuucccuuaauuauuuuuaaaccucggagcuuuggcuucauuggagugacgucugauggccacagagauucugacaaaugcaucuguucuuuucccaugguggucugccaaaccccacaacucuaugccaccuagaggaaagaucuaaagcagucagaguucuaaaaggccacccuuacauagcuaaaacaguuuuguuuuguuuuaaugaaaaaguacuucuuggcauuuuagcauuuuuguaaaaaguauggcuccuuggaauuuaaaucacaucuggucuuuguuugaugagccagggcuuucauuuauuugacaguuacugagugucuacuacaugccaggcacuggggauagagaagggaagacagaucccuacccuccaggaacugacagcccagucagggagacacacugagcagaccaggccaagcgcaugugccaugcagaugcagcaggacugcccgggcuugaggacuuggacacuuacucuaugaccuggggcaaguuacuuaaguuucucuaaaccucagcgucuaugagugccugccuuacagagccucugugaggaauaaauaauauauacauguaugcagagaaccaugccuaagaaauacuacacacucaauaguguugaggccauugcuacagaagucaggagcaagugcucugggagcaagaaagaugacauaacccaaaauggggaggaaaaaaaaaaagacuccucaaggguuuccccaguugugaauuuaaggacaaaggagaguuagccaggacaaggaggugguaaaggagucccaaaaagauggggcaaaaucaggccccgugaggcuaugguuguaggaggacaggucuugccaacaggggcugaacuccagaacaaugcuugggaccaucccuccuaaggugucccaaggugcccucagccggaagcagaauccugguuuagcugaaccauggggcaacccuauuguggcauuucuucuauuuuugcauuccuugugcuuugacaaugagaugauuguguggauauuacaagaggugauuaucuccaugggcacugagccuguuuuagcgcaaagaccuugcuuugccagagccaagacuucugaggucacagcuaaguugccaauucuagagaacuucugacaaaccucaaggccacugggaacccugcucuuugcaggauggcuuauuuuaaaagauaagcuacacuaaguaggugcugggcagaagguagccuggacuugagagagccucaguucagggacagugcacuacccaucuaugugugccuagcucuacguguaggaagagaaaaagacagccugugcuaugaagcgauaacagcucagaaacggagcuggauucuggauucuguaaagccuuuuaucccagaucucugugggaaugggggugcuuggugaagcucaugccaucacgggggucaggggcagagggcacagagcuuguuugauucugucaugauuuaaagcauuaagauggaaacuuggagggaaaguuucaagaaaagagaaacaaaguauuacugaugauucugccuguuacaacaaacauguggcaucacaaacggucuggaaccucaaucagaauguucagcaguuacacauucuuaguuggauuuaagucauucugugaaugauucaucucaaugccuauaagugaacuucuuggcugugaggcaauaguuggggaauuuaaaauguguaauauuccacagaggcaggcagaagcuaugcagacagccagagguguuuuugucuuuaagaaggauguguguguguguuuuguuugucuguuugcuuguuuugagauggagucuugcucugucacccagagugcaguggugugaucucggcucacugcaacuuccgccucccggguucaagcgauucucccgccucagccucccaaguagcugggauuacaggugcccaccacugcaccuggcuaaauuguguauuuuuaguagagacgggguuucacuaucucggccaggcuagucucggacuccugaccucaugauccacccgccucggccuccuaaagugcugggauuacaggcgcgagccaccacgccuggccguguguguguuuuaauagaaagccuauagagaugagcacaggccaauuaauaggcaaggucuccaaggggaaaagagcuuaucuuacagggacaacuccucggucucauugccuuuuugcugccagcuucccuugaccaucuuccuguuuuuccauaggccuccccuuaccauaaauaggauagccuacacguuccccuccugucuugcaaggacugucggcauaggugcugaguccuaggaaagaaagagcauucuagcaauggugccuccuacccugugguugccucgcacccagaugacaaucccugaaccagagucaguaaccaauccuagcgcuucacuuucagacacuggccuacucaaccaggaaggguuucuggaaaugccccuauuaaggaaaagaaauguaauaugcaacuugacuuuaaaaacccaggaagcucuaacacucuaucaaguucuuaagacuuuuucuuugcugcauaauccuuggccaaguucaaaggugagcacuuucccagaggcucauuaggaauaauguuuacuucauacauuuugaggaugcaaaguuugacuccauuuugcuuauuuggaaaaaaauaauuuuuuuuaugaacaaaaaggaggagggaacagggaaugagacaaggguaaaaugugaaagagaagaaaaaggugcuuagaagacuggccuggaaggcagacuuguguucugaacauuuucaccucugauuugcucugaagaguuacaaugggaagauauuguacauuucaccuuucugaaccuugaagaccccaucuguccuccccacuguucuaagugauugcugaagguacguucugaugguagauaugauauauacucauguuuucacagaggaugcuacauaaauaaaguguagugacauuuauaacuaggacuucuggguucuguacugggaaggaaauucaacagagagcucugugaagguuuguggucugcugcucucaagccaggaggucauaaacaggcccaucaaaccaggccaucacugacuguuugggggaugggcagccauucucagugacugguugaggccagggaguucaagcuugcacuucaucugucauuuucaucucauuuccucccuuagaauaaagcaccagaucuaaaugggccugccaccucccauguuugguuaacgaagagugguaugggggaacuggucauggggacagaaguacuuaaugccuccaccugucuuaccugccaucguggccucuacucauucuucaagacccacucaagcuccuagcucucccuccuuccaggaggugcccccaauuuccuggccggggugaccucacuuacugucuacaccacucuuuuggcacuuagcagucucugccaaguuuuguuaagucucuuuuuuaccuguguaagccagggucacuaacagcccgaucugcauauggacucuggggaccauaggauaguuagacuggaagaaaaauuugaggcuguugccaaguuuucucaaaaccuaaguucagacaauucuggggagggaguacguguagcccccccggagguagguuaacauuugggagcagagaauucaccuuugauagagggcuggcucaggaggcaugaggcaauauuaagcucuucccaaagacuuggcaggagggcucuggcggggccuccucugugcacugcccucuggagguggggcugagaccaccaccagggugcccacagcuguucaaagcugaacagggcagaacacuuuuuccacaagucacucaacagaugaauuuuugugugugccuacucugugccaggggcuauauucuaauggaauugucauccaaggauauaugggaagcugguuugagccucuuuauagcuuccauccacacuaccgguuuuagacauggaguuuuauaaacuuugucccaccuuauauuccaaauagguaacuuuuguuuuucugcaguucaacuuuaauuuaaauauuaauggcaguguuccaagcuucagaauucaugggauuuguaaacaagucugagcuccugucuaaagucucugugguucuaaacauuagauaggucacuaucaaaucuccugacuacucugguccauucuaaaaucucuauuccuauguucucacugcccauaccaccuagcuuuuaauuucuaauauucucuaauucucuaauacucuccuguauauuaauguccucuccucacuuagauuauagcuccuugaggccagggaccacauauccuacuuuuucucuuuuucauuaugccaacacaauauugggcacacagcaggcauuuaauacauauucaaccaugaaaucacggcacuuuagaauaaagaaaauguuagcauuuauccagucuaaucucuucauuguacagaugaggaaacugagaccuggagguuguaagucacuagcucaaggucagcacggccccugcugguccugaagcugagaccaauguuuaugggcaguaaaccauuaucuacugacauagguacaacagugaccuacauuuugcaguugaagaaucagagguacaauguguuuaagugacuucuccaagauaccacaacucauaggugguaaaucucggacuggaacccaggcagucuggcuccagggccugcaggcuuaccgccucccucucacuucuccucuccaaaaccccuagaaccauuuucccuauuuccauaucaggguauuuacuaucuccugucuugaguaugaucaccuguaugcucgucuuaccccuuccuggcccccacuagacuauauuuccuaugggcaggaacaaaggugucuccuuuaauuuucugggaucuucagcccagugcccuuccuacagugggugcuuagugaauagaacuccaaauauguacaaaugaaguaugcuaggguaguaaggcaauccauuucuuccucuuaaaacacuguguagaacuuuaaauacuuguuuuuccccacggaggagauaggaaucuagugggaguacaaaugcuuugucaaggccucuccacccugaccaaauguugcccaauucuugcacaaccuuacagucacgugggaggcucaucccccaggcaggugaucuagccacuccucucugcaccuauucaucaugguuuuuacccccguuuucuuucacuguguacagaagacugcauccuggcgcccauacuuaagccacuccaggaaaucuugauagucgaauucccuuguuauuaggcaguugagauuggaagcuuaaagagaaaagcagauuccccacucccccugcuucucccaagagcauaaguugguucccugcuggugggagagucagcaacaacuacaagauucuaguguuucccaaauucacacaggagggagaacuaggcuauccccaggggcaacugaugccuagaaggaacugauccaaucccagcagcacagaaucauuuccauuucauauugaaugucacuguuuucucaaauauucaaaauagcacccaugcuauuccaagguuuccccuuaugaagaauaacugggcgccauaauuaugguuuucuuugcaggaagugaucacuacagcuuagcuacuuucccucuucaggauuuaaauggggugaagguaaggggcuuucacuaaccuugcauauggcagccuucuguuucuucuuugugucccuguuuuaaaaacaaaaagcccuaacaugaguucuaaugaucaucaugguaauaggauuucaaguuuuucgccaaauuuuuuauccaugcagcagcuauggaugaauauaaaacacccuggaagugagcguguaugucccaauggagcuuuccuguuggcaggaacagagaaaauggucauggaacuccuccuccaacaccugccugacaucaccagcacaaaagccagaauucuccggcuaagcaauggaaagguugacuagcuaccauacaauuacccugcacugaucuuaucccgccuggauucucaguugaacuacuaggaggucaccaccaaagugagucaugucauccuucgccugccuacaggauauucuaacacugaggcuauuagggcuuuuaccaugaaugaaggacacccuuuggugccucuccuagucccucagccucaaggaaaugcccacaucggcagaauuuuucuuuaugcucuuuuguauguucuugcucccaucugcaauggauaggacaaaacaguucucuccccaaaaggaacuaucuaaaaaauucccaagggcaguaauacucuaauguaauacaauacugguuuuaaaaucccauauuaucuaagacucuaaccuagaacauacagagcacugcccacuggagaguacuggauccaacaagcccaagggaaccuuccucaccaugcuuuuuaagcagggaaguggauuccucccaggguccuguccucaggagauuucccugcuccaucuggaaaggucagcucacccuaaagauaaacuggaccuuuuuucuucucuuucgauguuaagagcuacacaacauacuuaaauauuaaacaacaucucuaucaauggggaacugcccaguccaacaguauagcaaaagccugugcccaagcugggugagauagaagaaagaaaggcaggcugugagaugggcuccagcccaauucguuuucaguguagagcagaaacaccaaccacuucuggacuucucuauucucaacauuuaacaaaacagcuccaaauggaggacucugucucuccuguuaagccuuuuauaaggugcaguuaguuccccacuuacguaacugcuuuuaauaaugugccuugaaaacuuguacggaaaaaguuuggcaucuaggggcagcccaaggaugagcguuuucauccuggccaggcugccacagccuugccccagucuauagggcauaucacagccaaacagggacauaaaugcucccuuuaacugugucuugguuuggccagagauggccuuaaaccagucuguucucaggguuacuguucccuaccuccagcaugcaccuaugcuuuguauuuucacaagcaagauuuguaguuuuggaugauaaauauuuauugggcaucuauugcccaugggccuugcuaagaacuguggggugugcaauucauauaaaaacauaauuagggcugggcgcaguggcucacaccuguaauccuagcaccuugggaggccgaggugggcagaucacaaggucagaagaucgagaccauccuggcuaacguggugaaacucuguuucuacuaaaaauacaaaaaaauuagccaggcgugguggcgggugccuguagucccagcuacucaggagggugaggaaggagaauggcaugaacccagaaggcggagcuugcagugagccaagaucgcaccaccgcacuccagccugggcuacagaacgagacuccgucucaaaaacaaacaaacaaaaaaaccauaauucacccugcccuugcuuuuaagcugcacaaacagcaaaugagacaagagguugcccuauauacacaguagccauagacuaaauauuuguuguugguggugagaccagacauuguaugggcuggcagaaacacgcaaaagaucaugguggguuauuucagaagacaggagaaucacacccaauacagucaguuuccuuugauuacucauguauaucuuugcaaaauucuguuuuggcuucccuguggaaaacagaugagcaagugaccuaggggcauaauaguggcaauaucugauacaauucacaauuuucagaggaaaaaaaaauauuacuuucuugaugaguuuggucaguuuucuaccagucucuuaugccauaagaagagaagcaagacaucaaucuguggaugacuuugggacucagagagccucuguaauguguuuugguuuggccagagauggccuuaaaccagucugcucucaggguuacuguucccuaccuccaggauacaccuaugcuuuguacuuucacaagcaagauuuguaguuccguaugauaaauauuuauugggcaucuacugcccacgggccuugcuaagaacuguugggugcgcaagauauauaaaaacauaauucagucuuguuuauuccucccauccauuuguuaaaagaccucaucagguguggacacaguugccuuuggcaccuacuuuauuuuuccuuucuuaacaacuguuuauugaucacuauuuuauauccaucaccaaacuuagugccaaagaguagaauaacuauuuuuagaauaaaauguagcauauaugaauuagacaaaauauagcagcuuaaaaaaaaagucuccucauuaacuucgucuagauuuuuacacuuuucaaggguaacggcccuguguugccugugugcugaguguagacucuaguuaugauccgugaggucgccaugggagugcugugcuucacacagccugcaaucuaccacgcucuucccuccuaggcagauaagacuggagcucacacaagguuuguuuucagcuguuaauagauugauuccuugguaaugucuccauuuuagaaaggccauacagguuaguacagaaauugcaaacuucagcucccacugacggguagguuuggcugucaggagcagugugugaaagauuccgaggacaucucugggcucagaggugcugugauugauuaauauugccugucguggggguggacuaagugagggaagcacaggugguaucuaugccuuugccaucccugauauaauggaaacagcagaagcuuuggagugaggccucucagcuucaaaucugggcucuggcucugugugcaagaacugaggcaagucauuuggccucucuacaucucagcuccucaucuauaaaugggaauaauaucuauuucacaggcuugauggaaagcagugguucucauagugugguccagggaugagcaacaucaucaucaucuaggaacuuguuagaaaugcacacucucaggcuccaccucagaccugcgggccgaguaagaaauucuagggaugagguccaguaaucugaguuuuaauaagccccaggcaguucugaugcacacuaagguuuggaaccccuguuguuaagagucacaaauaaguccugcggcacuuacaaggauagaaguuauguuuuaucagucaugacugauguagucaucugccacacagugacuagcaaagugccaggcuuauagcaggugcucaauacauucuaacuucuuuuucuuguaaaaauaugagcugccagcauaagaaccuagcggguggagaagaggagggguuuguauauuguuucagguggagaaauuagcuagugcagcgguucaaagacuuaagcaaaugcuuggcaagaugucugggagauuuccucccccaagaagaaggaagaaagugggcccaggauuccguaguagaugacaacaauaauuauucucagggaagaauuucagggaaggguaccuauacaucacccaaaucaguagggauuauacaggauagauccagcccacagcaagcuugccuuaaaccucauucagagaguugaaguuacuuaagucccaaaggccucuauuuaaaauaguuucacaugcuccacagcacgaacugaaaauaggucuacugaggugccuguacuauauccuauaugccaguuauuauauauaauaaccuuauggugccuucauccuucucucccugacaccuuucacucccaaauaucauuauguugauagucuuuguuugccucacagguguaaacaauggggcagugauuuccauucccacacaggcuguugugggggugcgggggugggguggggggcaaggaacaggcaauauguuuauaaagacaaaucacugaucauuaggaaaauguaaaucaaagccacaaugagauaccacuucacacccacuaggauggcugauaucuaaaaacaaaaacaaaacaaaacaaaaaacagaaaauaacaaguguuagcagggaaaugaagaaacuggaacucuuaugcauugcucgugaaaauguacaaugguauggcugcuauggaagacaguacagcaguuuuugaaaaaaauaaacacagaauuaccauaugauccagaaauuccacuucuaggucuauauccaaaaaaacugaaagcagggacucaaauuguacaccauguucaccaugauucacaacacccaaagguggaaacaacucaaaugucccuugacagaagaccagauaaacaaaauauagugucuacacacaauaggauauuauucggccuuaaaaagaaauaaaacuuugaauacauguuguaacuuggaugaaccuugaaaacauuaugcuaagugaaauaagccagacauaaaaggacaaauacuuuauaugucuauauauacaaucuacuuggaauagucauauucauagagaaaguagaauagugauuaucggggauuggagcauguggggaauaaagaguuauuauuuaaugaguacagaguuuccauuugagaugaugaaaaaguucuugagcaguggugcuuguagcccaacaauaugaacguacuuaaugccauugaauugcaggcuuaaaaauaguuaaaaugguaaacauuuuuuguuauguauauuuuaccacaauaaaaaacgauuuaaccaccuuaaccccaccacuaccagcaaaggaaaacgacaacacaaugcaaagcuucuacaguacucuuaaacuaaacucucacacaaaguuaaguaucuugaauagaaaggacuccaaaaccucucccugcuuaaaaucuaagaugauaauggcacgggcagacaguuuucuuaauuuacuuucaucugccacacuccaagcauaucugcugugaaaaagagacacagcugaaaauggagauuuagcucuggcuguccaguguguucacccaguggcuucaaaaucccuauucuccuuuccguuaaugaagguuugcuucgaucuuuccauuagcccacaaacugcuauuagaaaagccauuuaucaaauuaacacugagcacugcaaaagucaucugcaagcggcgugcacuuuuccacguaggaguugcuaugccaacagcugcuccaugugcauuguacagaaguagccauuucaacaaaguccuguucaacaauucccaggaccaauuaagucuuacugucccuuugcacucccuaaauguguacacauggcaaguacccuaccagaaucggguaaugaccaacuaagggagcaauuacaaaaucaacaaauuuccacacaccgaaaacuuugaaaagcaggcaacaauuaguuucucucuuuaacuuuuacuccuagucccauccucauuccucgggaauagagucaaggaauuugguguaauaagagucuggccaguaauucuagaaaaaggaguccagggugaauaaauugaaggagagacuguaauuauucagauuguuguaauagaucauuugccugaagagcagacaacuauaaacaaaaugaggcaaaaauccucgcauucugccguugccaaauuuuguugcaaauuuuucuguucgaagaugccugggaacucuuaaauauguuuaaacugacuggcauuaucaugcuuucccacauagacaagaaaucugaaaaagagagcuuuaggaaacgauuugucuugacuaaacaguaaacuuuacaagcaauucccaaccacaagcaaucauccccagccucauacuaucacuucugauuaaaucaaacauucaacucaauuuaaaaaugaaucaaagaaaauaagcaaauaccgcaggcaccuggcuccaaaacaaagaggaaucaccauuauaucaaaguuuacuguaaaucuaugccacacuuccaaccacgaucagcaauggaggagaaaaagcuaaucacaagccuuaaaaauauacaauuuccaaggaugagacagaaacacugauagcaccuuuuucagcuaaacuaguuggauuuuuaaaauaaucuuccaacugucagcaaaucugaaugauacuuucuuuaaaguuuuuaacaucaugaaaacaacuguauaaagaagaaagagugccuuuuuaaagauauagauugugucauaaaauuucaggaggacaauaaccaauuaaaauuaaaaauggagcuuauuugaaaucuuggucacaggaauaccacugaagaaaaacuuguucucccagcuagcagcuccuggcucaaagcauacauaugggccacacuggaggaucauuuuacccaggguaaggucuggcccagcccuggaagcugucaucauugcagccucuuccuauguaaucaagugaauuauucuaagccuagagaaaggccuacauggcacuuaaccuuuuauuuugcagcuauuucuggggcaccauagcuaacacacuggucagaaauauagaaaagaugccgcuuuucagauaacacauuggucagaaauauagaaaagaugcugcuuuucaggucugaaaauaagcuugggcugguuauagcuuguuuucugagccuggacaugucaaugaauaaggguuucacuaugauaccucuauaaguggaacuuaauacaacuauguauuaaaucuuuguaacuuaguagcaagagauaguucugauauauugcuauauagaaaaugcauuucacaauagcauguaacaugauaaugcaggcauaccucauuuuauugugcuucacaauuaauacuauuaauaacuaauaauuaauguugaauuuagggaagacacgucaugugaauuuacaaguaguucugcuacaacauggcauaugagcuccuaaaaaucaccacacuaugcaaaacuaaaaaccacagagcuuacgggaaagaagagguuaggguacaacacucaaaaacuuucucagcaacacaaaaacaauaugggaacuuaauaaaaaugguagcacaguuuuacacguguuaaaugguuaagaaacacaggcaugccuuguuuuauuaugccuuacuuuauugcacuuugcagauauugcacuuuuuacaaauugaagguuugucaggcaaguuuauccaugccauuuuuccaauaguaugugcucacuucauaucugugccacauuuuggucauucuugcaauauuucaaacuuucauuauuauagcuauuauuauaaugaucugcgaucagugaucuuugauguuaccaccguaauuguuuuuaggcauaaacugcacccauauaagacagugaucuuaauaaauguuguguguguucugacugguccagugauuguuccucugugugcguguguguguuuguguguguguguguguaucucucucucccccuccccaauccuuccuauucccugagacacaacaauauugaaauuagaccaauuuuaauaacucuacaaugggcucuauguguucgaaugaaaggaagagucacaucucucacuuuaaaucaaaaguuaaggaaugauuaagcuuagugagaagaucaaaccaggcauaauauucccuuaagccaaagucuaauccagagcaaggcccuaacucucuucaauucuaggaaggcagagcaagguaaggaagcugcauuaagaaaaguaugaagcuagcagagguugguucgucacauuuaaggaaagaagacaucuccauaacauaaaaaugcaaggugaaagagcaagugcugauacauaagcggcagccaguuauuuagaagaucuagcuaagaucauugaugaagguggcuacacuaaacagauuuucaguguagaugaaagagccuuaugcuggaugaacaugccaucuaggacuuucacugcaagaggggagaagucaaucccuaguuucaaaggacaggcugacucucuuacuagggacuaaugcagcuggugaguuuaagcugaagccacuuaucauuuaccauucuguaaguccuaggguucuuaaaaauuaugccaaaucuacuuuauuggugcucuaucaguggaacaacaaaaccuggaugacagcacauauguuuaugugcucguugucaaugcaccuaguuacucaagagcccugauggagacgcacaaaauuaauguuguuuucaugccugcuaacacaagauccauucugaagcccauggaucaaggaguaauucugacuuccaagucuuauucaagaaauuuuguaaggcuauagcugccauagauagugauuccuagaugaaucugggcaaaguaaauugaaaaccaccugaaaagaguucaccauucuagauaccauuaacagcauuuguaauuugugggaggaugucaaaauaucagcaguaacaggagucuggaagaaguuaauuccaaaccucacggaugacuuugagggguucaagacuuuaguggaggaaguaacugcagauguggaagaaauagcaagaaaacuagaaguggagccugaagaugugacugaacuguugcaaccucaugauaaaacuugaacagaugagucagagcuucuuacagaugagaaaagaaaaguggcuucucaagauggaauuugcuccugguaaagauggugugaacacuguggaaaugacaacaaaggauuuagaauauuacaucaacuaaguugauaaagcaguggcaggguuugagaggauugacaccaauuaugaaggaaguuuuacuguggguaaaaugcuaucagacaguaucacaugcugcagagucuuuccugaaaagaagacucuauugauguaaaaaacuucauucuugucugauuucaaggaauugccacagccaccccaaccuucagcaaccgucacacuaaucaguucugcagccaccgauauggaggcaagaaccucucccaguaagaagauuaugacucacugaaggcucagaugauuguuagcauuucuuuuagcaauaaaauauuuuuaaauuaagguauagacauuguuggccaggugcgguggcucaugccuguaaucccaacacuuugggaggcugaggcaggcagaucauuugaggccaguaguucgagaccagccuggccaacauggcaaaaccccaucucuacuaaaaacacaaaaauuagcuggguguggcagcacaugucuguaaaucccagcuacucgggggugcugaggcaccagaauugcuugaacccaggaggcggaaguugcagugagcuaagauugccccauugcacuccagucugugcaacggagugaaacugugucucaaaaagaaaaaaaaaaaggguauguacauuguuuuuuagacauaaugcuaaaauauaaacauaacuuucauaugcacgaggaaacaaaaaaaaaucaugugacucguuuuauugugauauucacuuuacuguaguggccuggaacgaaccuacaauaucuuagaaguaugcccguauucuguaauuauauaucaauauucaugauauagagaaaaguauguucaccaaagaguuaacagugguuaucucugggugauggaauuuuggugauuuuuauuuuuaucuccaugccuucuuuuacuaugacuuuuuauggggaacauguauauuuuuuauaaucagaagaaaacaacuuagcaacuuuaaaaauaauuuuacaggagagacaauucauggagauagaugugugugcacauggucccagggccuucccaacuccccuugugcuauaaucuuccaaagaauuugagggggcucugccccucuugcccuccacccucagagcccagagcaccccugggugacguuugcagaucccugcccucccucuacauccugcccucgguccagcagugugagugagcugcuccugcacuggggccagccauucagggagcaaggaaauauuaugcaagagcacaggaagucagaggagacaggauucugggcaggccuggcaaggagucugugugaacuccagugaacaagcagacuuugcucaguggggccgaagccagcagaaggccuucccagggcagcaaaagggagccguccaccucaugucucuggccagugggcagccauccagaacuugauguaccugaugugaggcagauaaacccaagucucaauauuucuacucuucuggcccaaguucaaggugacuccccaacacuuaugcacugugacucaccuccgucccacaguaugcacccccgcccccucuguacaacaugacuucauucagugauuuucaaaccugcuccucucacggccaucagcuuuccggcucaguccguucucacugucucagagugagggacacaguuccuccggguugccugcauggguugccucacaucaguaucagcccugaaaacuucagauacguucauguacauguauaugagucacaguggccacaaccucuucuuuugcaguaguugauauuuuggaagccccaauccaacuggcagggcagagaucauaucagccaucuaacagaaguggaaacugaggcacagagggagugcagugugaccuaguugagggugcucuccgucaccccagcagccugccuccuucucccuggcaucaggagauggagacacuaccccuccugcaagcacaacuaucccuuuuuguagaaaccacugggcagcccaccuucucguaccccagcccaccuccuucuugagggugguggucuugcugcugucauggaaguggguugggccaugcccaacagcgacuuccaagucucugccccucuauuccaacagaaccuccucuuggagaauggggaguuccuuccuccagcucccgaccaaucaucuuuaaucguccaccuuccuucccucuaagggagcaugugaaaacaggagucaggacgaggcuccacuugaaauuuauuucacaauggagcuagaacccuauuggggaucucugagccaauuuugacugguucccacuuacuaguccauugugaagauggggaaacugaggcccagagagaucauccagcugauuggcacuugccuuugcugucuagcaggcuacacaaacaggacguuuuccugaacagaaaggaccuagaucugaguggagagauagccagggcuggguagaaauggggcuguaguccuaggacccacacucccuuuggcaucuguggagguacaggcagugguguuucaacacgcagagccagccauguagagagugacaccgacccaaucacugccccugaccugacaauugcuaauugugguaagaaccgacaguggcauucuccugggacucucuuguguauuuccagacgccaccaacacacaauggccucuacuccuccgguguaaacauugccaaauaagacaaacaauaacaucaccacgacagaaaaauaaggugccaagagagacagcaugggucuguggaaagagucugggucugggagcuguucagguaggcacugccacucucugguuuugugaucacauuuuugugccucaguuguuucaucuauaugacaaaaaugacaaaagcuucaaucuacaucaagagcuuugaaaaaaaauuaagcacugaacaaauauaagaaauaauaacguugaagacaaagaccugacaaccucagauuauuucacuuaacaaacauuuaaggagcaccuccuguguguaggcacugccccaaacccugaggauauggcaguaaccauguaaugcauggucccugccuucaugaagcuuacauacuagggggcagcaaaggugacagaugauaagcaaauaaauuaugacauguggggcuggucaccguggcucaugccuguaaucccagcacuuugggaggccaaggcgggcagaucaccugaggucagaguuugagaccagccuggccaacauggugaaaccccaucucuacuaaaaauacaaauauuagccuggcaugguggugcgugccuguaauccccgcuacucaggaagccgaggugggagaaucgcuugaaccugggagguagagguugcagugagcugagaucccgccauugcacugcagccuggcgacagagugagacacugucucaaaaauaaauaaauaaauaaauaaauaaauaacaacaugugggaaguacugcuaaaacaaaacaaaacagaacaggagggagguuaacuaaaggaggugagaaaaugcuucccuagggaggugauauuuaagcugagaccugaaggcagaaguuaacuggccagccucauggguggggcugagggaugagcaagcuuaggcauuaggggcaucaaagauguuacagaugaaggaucagaggccagagcugaguggccugucacaucucauggucaguauguagcacagccaggcguuugcacucaaagccuuuuucccacuucuaguaacaccggaaggacaagguaucuuuuaggugucaacauucgcucuguuucucugcuaguagcugucugaccucuuaaagaccuugggcaagucaucugcuuucuuugggagcccacaauuaggucuugcucauaagaugcaaagcaacaaguaggaccugagcagacaugguacagauguagcucuuuagguuuagagauuugggugugcugaguugaagggauauucccauucucgacagaaucacaucuugcacaaaccaccuccaucuccacaggggagggaaaaacaggccagauguagaaaggagcauaacuggucagacccuuuaucuagaauccuggaaguguccuuggucucuuggguauaaucagauuuccucacaucucaggguaugggcaaaaauagaacugauacccaaaaaucauuauuaguaaaaacuaauaauucugaaaaucccagccagguaagaaauuuaaaggccugagagcaagaguccccuagcuuuuccuaaggcugccuuccaacugcagccaaaucacaucaacaggcaauaaugugccuaaugauuauauugcugugcuuguuaauaaugaugccuugaaggucugcccuuuaaacuuuucaaaguucuauugagauaauaguugcaaaagugauuuuuaaaauauaauagacuuuaaaaaugcaugguuuuaugaaacucuagcucauuucaaacucauaauaguacucugagaaagcagcaaauaugucuaaccccacuuaggaaagggguuaaagaaagaaagguuaaauuaccuguccuaggucacacacaucagagaaagaucuagaaaagucuuucaaacuccuagagacuugagagcuccucugaaccccauguggagguaggcuuugccagggacacaaaaaaagagaaggugacucgggagcauuuacaauccguuuggcaagauaaaagccaagaaacacagaacccuguggucaucccaacgcuaauuuuggaggcaaagaaauucaagugggugaaaguuugucucucuccaaaauaaacauguacugugccuuggcccugaagaucuaacucaagaagaauuaaguugucgucauugcccugguaauauuuggagccauacaaggagauacagguggccuggaaucaccaagauuauguugauuuggguauggaaaaugguuucaaaugugcucaaaagagaugacucaggaacaaagggaucaaugcucacagucacccagacuccuuucugccuggguuuucugcucaccaggcuuucccaaggccuugggcuggcuggcggccacagugaccacaccacccucaggugugcccaugucucaacaucucacuagccaagguggggaaaaguacuugcuaggaguucagcaaaggcaaaguuggaacuuuucaaaaggauguuuuacuuuaaaaaggaagagaaaaggaaaugaacacaaaggaaaagacguggauauguucacagguuucacacccuaacagauaucuagucacagguuagcuugguaggacaucuuccuuuuccuucuggagguccaccuggagcugugagaagguagaugcuagacucaaauuucuagccauggcaagauuuggguaaacaacacuuucuagccuaggggaguucuuaggagauucuugaaacuagucccuuaguuugggcugcgcugugcuccaaagcucucuggcaccugcagucuuuuccugguucugacaguccaggcuccuuuccaccuaacuguagagggcccuucccugcucucgggccugaggcucagcagccugcacagaguaggcaaugagcagagaaugacuguggagcgagucauugaaccaaccaauccugccugggccaggcagcaguuucccaguuuuacaagcauuuauugauuacuagagggacagaaaaggaauaagaggccaaauaugcugggugcaguggcucacgccuguaaucucagcacuuugggaggccgaggcggguggaucacaggucaggagaucgagaccauccugguuaacacggugaaaccccgucucuacuaaaaauacaaaaaaaauuagcugggcaucguggcaggcaccuguagucccaacuacuggggaggcugaggcaggagaauggcgugaaccugggaggcagagcuugcagugagccaagaucgugccacugcacuccagccugggcaacagagcgagacuccgucucaaaaaaaaaggccaaacacgcaguugucauugugagguuaaauucuaagccaaaaguacucaggaguuauauagccucccucaaaguaccgguggacagaaugagcuaaagugacuuggaugagacccgcuggccucuacuggucccuggaauggaaucuucuccagugacuugggaucucuggccaaggccuggcccacaguguucagguaugacuuuaaguguuucuaaauuccuccaggggaaagguuacaccugcucgaggagggaaaaauccccagcugcucuacccaggugacuucaggaagacggcuccuuuuuucccucuucuggugguaucaucccaagaacuugaguuagggcuuuagggaguguugugaccaaacacuaggaaaggagaaggucaaggaacagcuuggucgcagugcuuuguacagggugugcaaugaacaguuauugguagaaauugaucaaagggauggucugacuuggauuuggcugugucaugcccuacagauagugggauauugaagggacuguucucuuuccauaaugguuagacucaaaaaccuagaauccagaaugagaaagggacagaaugagagccuuaucaaauaaugagggggacaaaggcuuuaccaucagaaagagaaccuuaucaaauaaugagggggacaaagucuuuaccaucagaaagagaacauggggaugagggucacugcuauuuuaggauacagcaagcuguccucuuccagcucccacuccaugcacuaggagacucagacauggcguuuauuacccugagaagugguacaggccaaaaagaaacauauaucagagugauuugggcacauucacacaugccugauuuacuaagggcuagcaggggaggcuuugaggucaauauuauagaagacaaaucauggccuccuccaaccacccacuugaugcucacacuagagcuaggcuucugguuggagggcuaaugauggagaugcccugagcagcuucucaugugccagaagaggcaugcacugcucccauggccccaaggcaacccaaagauuccaucacaacaugacucaggaaggccugccccuaaacuucccaacaccagcccaggccugguccucaucuccuuucugcuaacagagcuccagauccagcccuggaaggaacuggcucaccaguccuggccugcacacucuguuuauugcugccuucucauuuuacuuacgcaauucaccucaaauggaaugccccauacucaucugccuauccaaauucuaccuaaucuucaagacagaccuaggucuucaugcuccuccaauaaaccucccucuaaucuccacuaaucacuucccuaacuauucccaacacacaagaucuauuuacccuuacucacucucacuuaauuacuaucaaucuuccauuguuugcucaauguuuuaucugaguugguugugacuuccuaacaagauggcaacauuguaaaggcagcuuggacauccauuaacauaaaucaucuuauauugcuuaaacaaaucauuuuaggacauccugagugcaggguccaucuaaugccucuuuguaaccucaccguacagcauagcaccugaauuugggagggaaccuauaaacaucuacacacagugaugauucccacaaacccugcucuacgcaugguggauaagcaaugaggauaaguuagguugaugugagcaaagugucuaccugugcuuccaguucucuacaccaaacucccaaaguuccugacauagacagaauuacucagucuacaaauaauuacugagcaccucaagagaccucuauucugacuucuguggggaaaaaagaacaggaaaaaaugacugggucuuugcucuugaagggcuuaccacuugaguggugaucagggacauacgccacccccaaccuucaaaagcaaguuguaaaagcaucauacaaauaacaaaauacagacugaagaccaucuauaaacacagggguaaccaaugugcaguuaaucagggaaggcuucccagggaagaugaucucugaacugagagcuagugcccucuugcacaacuuccccaucuugcuuuuaacguugagauuaagcuggaguauucuguuuggcuguacucacauuaguguauaaggcauucuugaagugaagcacugauauaauacuagccugacguuugcaucugauauaaaguuauguaucaauaagaccugacuguggucccccaaauuuuuucuuuuccuuuuucuuucuuuuuaaagggaaauaaguaaaggggucaaaucuacaugaauaaagaaagcagagcuugugaggcaggcuuuccaaguaacccaagggacaugaacaaagcaauucuauuauuuuuuuuaaaaaacuaagcaugauuucagagcccccccccccaaaaaaaagcaagcaagguauuagggcacaucagaaaaucagacauccuuggccuucaggaacaugcuauauuguuagaaaggcaaaaacaaauaaagugucauuagauaacaaggaaauauaagcaggcucuuuggcaaacaaccaaaagcuaguaaugcagggagugggagugccacuguggaaauuucuacgcucccuuagugauuuuguguaagauuucgggaagccugggcucacaauagaaaaguaggagcuauuugaauaggaagagaggggaaaagcauccagauggaggagcuagugugagggaauagaagugggaaugaguacugcagcacugccuuugaggcugugggaggaggcuuguguauuaggaacucaggaggcacagugaaugauggugaaugggcgauagaggugagguggggucccuugcagucagcaaggugaacucccacugccaugguggcugcccuugggaagaaaacuagaccaaggacccaugucuuuacugaggcccugagugucuagcuaaucuuuggagaucccuaagagaaacccaaauccacaaaagaaaccccuaucccacucugaagauucucugugcuccgaggauaggacaaucccgcugaggaggccuaaaacagcugcaggaucagcaccauguggaccucuucugggggaccaggaaagcgaucucagcagccagggugccuuccagucagucggcagggaaaugcacgggggcacuaauuuccauggaacucuggaagacuccagagagucaggggaccacacagugcccagccacacagacuaggauuucuuuagaugucuuggccaugacaaaggcccuuaccaaaugggaggcgcacaucagcugaggcaagacaaacagagugauagcaagaaagccagaaaaccaagaagagccucaacucccaugccccacccaccaauaauucccccuaagucccggguacagaauaaaagacagacucccgcugcacaacgauaugguuacauuuauagaagcucucuugucaccagugaaaugugaccuucauacuuuccuuaucuuaauaucuggguaaacauuuguugugcaagcacacaaauaaagguucuaaaggugaaaugugguguguccagcaacaccacacugcuccaaacccaggccccagagaguccuuuuggcucugcagaggacuucucucucccuucacccugggcaccaaggcaccaaaauuagcuucguugaccucagccagcucuggagugaacgcugccauucgaaaauagcaucugagaacucuuggaaacacaggagagaaauacaaggguacagugguuuacagaaacuuacugcgaaagcaaucucacuggagugcuuuuuuaacuaaauacacaggaaaggggcauuaugaggauuuacuccaaucuguggaaagugaauuauaugcuucuagcucccauccugauuaauucuauuaagugugauuguuuucauuuagaaaaauauugcagagguaauguucauaaagagaguuugucaaaugacccaugcuuugacccaaaauuuugcuguacuaacuugcacaguccuauuauuucuagacacucucuaaaaacauugugucucauuuccccauauauuugauauaugugauuuuuaaaaucuugucuugaaaugcagaaggaaggauucucaagcaguuccucaaaaggcacaauuuucuguuguuucuauguggaauucauaaacaaagccaaguaaccgaguuuuuaugugugcuuaaaggcacucuuuccugcaacugugugugacguauuuuuccaggacaaucuuucucaauacuccaaagugcuucaguaacaggaagucauaaagguaggaaggaggccuguaaauauuugcuguaauugcucauuaguaaugagaauggcuggcauugaauuuugagucacccuuuugugcucauggcucauuaccuuguaacuggagcccaaggugguacauaugggcuuucccucaccauggacaaccagguccacuucuagguuuuacuucagacaguguggcuuguuucucucagcaccuccauuucccaaauauaaaggaaggaaagcaugcuggucuucuugcucccugcccccuaaccagaggcagucaggaaaaaacuuauacaaaguagugacaguaugcaaaguuuuuaucaaaagugaaauguguguauuuuuuuaauacuauacuaauacaacaucgagagacagauaaauacugucuggguagacacacagcacaaugauuuaaaugauuaccaaaaaauaaucauauacuuuaauggauguauuuuaaacaacuuauaaaaugcuucugaacuuucucagauucagcucauguguccucuuauucauaacaagccacugacuccccuuagucacaggccagcaucagggcaccucggacuaaaaaugagaccaaaacacucaacccguuacagaauugauuaacuucuaagaauacuauuggcuguacccccugcuucugggggcagccuacagggcaauggggguuaccuucagcaccacaaucaugaguacaacauaauggauccacuuuccugcccacguguuugauuacacggccuaaccagauaaaaucacuaauuuguuaagauugcuaccacuuaucucuuaguuuuuuuaauaggagaguuccauggcuggggauggggggauaguucaagaagucacuagggguguaugagacacuucuaacaauccacuuccauggcuuuauagaauucacaaaacgucagaugaguacauggcaaauaaacauauguuucaauggggucauuuuucucauugacaagacacccuuucugaaauauuuuuccacaugagaaaaggaucuguucacaggaucauuaucuggcauggaaauuacuuauaacuuuaaaacugaggaaucuuuccaaguucgggggagugggggcagugggaaaugugccuccuggaaacauguggaacuucuggcagugaugucaucuaguaagaguuuugcugacguacaaguggccccugcaaacagccuaaggcagucaagcaaacagguauuucuuaagaaauuagaaaaaacaaggucacuuagaaguggauaacauucuuguccauuccacaccugacucuucagcuccagguaucucacaaagggucucgccacucuucuucacuuuaugcuuucaucagaucaguuauggggcuuccaacagugggaacagacaagggucaccaaauuacacccaacaucuacuugaaaauuacagaugcuauuaggggcaucccauggaugaccaccacaucgacugugaugcacaguugccaacacggcuugcuucucucuugauuaagguaugugucaaugcaauucuguuuggcagcacuagaaaaacucaagguacccucuagguucacagugcaggggccaacagugugauggcuguuaaggcucagggcucaucagcgaaagggcucuauagaaaugcaacaugcuauuaucacaacaaucauagcuauucuuuaucccccuauccauucuuuccuuccugugcuugcaauuucaaaagaucaaaagagccacaggaaguccugugcaucuugaugguucuucagaagccacagaggaagagcuucuaacagguucuccugcacaauggaguccgaaggcugaaguaauuauugaagucuugccaccagcgaagggugggauguggaaagcuuugaauuucuuggggcaggagagaaccaccucuugucagggucuaggaaaacccaugaaaaauaagaaauucaaggaguuccauguuggccuuucagaucuucaaucccuaucugcuugugagguuugaugcaagugauaaaucacaaaaaagaaaaguaauuauaauuacaaggaaaacaacaaaggcaguugucauuuauagagcacuuauugugagucagaagcaguauuaaauacuuuauagauaucuucaguaagggaagggcguauggaacacccauugagaguauagacucuggggaccuccuuuacucagguugaaugcagcucugcccaugcuaccuauacgaccuugggcaguuagcccuucuagacuucagcuuucccaucaaugaaguggggauaauaacagggcuuaucucacaggauuaaaaaguuaauccauguaaaguucugaggacggcacuggcacaaauaagacugucaguuuuuuguguuguccugaugcaaaauauaauuucuauuaagaccacauacauuccuagaacaugaaggucauccaaauaacuguuugaggaugauggaacauuugaggauaaauuuguuuucacagucauuuuucagaagcauuaauaaaaugaaucauaccaguauuuacccugugcagggcacuuggcuucccguccuuccaagacugagggcagacauguagguggacggacacgccagccagggacagggaagauuaagcggcaccucagaaccuuuacuaaauacacacaccuuccuccuccccauucuucaccacagggagaggcaauggcaguaaaacacaagaacugucugggaucugaacaggaagacucugaaacauaagacagucaccaaaucagacauccaagagcaagggcuugccuuuuccauauccuagaaccuuugaaaggcuauggagagcugaacagacuuccuuuagaacaaguugcuucuauacauaaugucuugcacacauuuucagagauuuacacgccagccucugaaacccauucacaaagccugguuaagaagcucccucucccuucuuggccuuccuggagucauagcugucuccacugauauucucaggggaacagaaauuacuaccccuguugucuguggagccccaccagcucccuuuccauguccccacccaaagcaaguguauaaagaacagcaaacauuccauuucaggggccuuccuguguauggugucgaaguacaugauaagggauacaccauagggagccuuguguguuuucuuuccucucguuagcccucaaagacugccuucucccauuugaccuuccuucugagccagucuuuaagcugguggucagcaccuacucugugugguuccggggacacuaggaacaaauuucuccaccucuaaauacacauaauacucuuaaauaauugugugugcuuauguguguguuggggaggggggcgguuauuaccugaaaugcuacucagagcuuaucuuuugcuucaaaauauuagauuucuacagaaaagcauguaggcugucagcucuuuauauuuucuuucuuuucuuucuuucuuugacguugucucgcucugucacccacgcuggagugcaguggcacgaucucggcucacugcaaccuccgccucccggguucaagcgauucuccugccucagccucuugaguagcugggacuacaggcauacgccaccacgccuggcuaauuuuuuguauuuuuaguagagaugggguuucaccauauuggccaggcuggucucaaacuccugaccucgugaucugccugccucggccucucaaagugcugggauuacaggcaugaguuaccacgcccaaccccuuauauuuuuacuuaagcuuccuuguaucucuuuuuuuuuuuuuuuuuuuuuuuuccuaaucagacuaagcaacuugaugaccaggaccauauccccuauuucuuaguauucucuucagcauuuuagccagaguaggagucgguguugaauacaaguuugucaucuuauggauuauaucuuagggugaauaucagagcugguguccaucaugugaacaggcagcaugguacugguggggagagggguggaaguacagaguacuagggccccaggagcuaauauugcuaacuugacaauauugguaaaagcuagaccuguuaagaacuaccagcaaugguuaguacugaaagcaaaagggaagauucaucaggcuaaaauaaaaagggaaacuagcagguuggcauagggcagaaccaaggaaaacaaaacaaaacccccaaaaaacuacuagauuuccugaaaaguggaaaagccuaaaucucaagacaauuaaugacagcaaguauuuucaaauguaggagccuaaaauccuggagcacugagaauuaucuaauuguuuccuuccauuucuaaacacuuuacuuaauaaauuccuagaaaguugagaaucaccacugcccccccccccgacgcacgggcacacacacacacacacacacacacacacacagagagaaagagggacauucuaaguaaauuaaacuguuuagucucacaguuuucacuccuagugaaaaugccaacuaacccaguacaaaaaucaaucuagcagcugcuugaauguucucuaccucaaaaagcaaucugcuccacugaggagcgguccuugcauugguuuuguuuaaugaggucuaccuauauaaguagauuuuuuucuaacuaaaacaaugaauucauacuucucaaaguuuacagacacugggaacagcaucaauucaacucugcuuccuuuuuuuuuuuuuuucaaaaagcaaacagaaucaucacuucuacugcagccuaaagguguugauaauuauccagaaaagcaaaucuccuuucuauaagguucagcgguuugagaguugugauggggaaggcacuccuucggaaaucauccucacuaucuagagauauuucagggcugggguacucuccugugaacaauaggaaaauacauacuuaauugaaaguaauaaaccaggguucugacuuuuuuuuuuuuuuuuuucuuugagacggaauuucacucuugcccaggcuggagugcagcagcgcuaucuccgcucacugcagccucuaccucccggguucaagcaauucuccugccucagccuccagaauagcugggauuacaggcacccaccaccacgcccggcuaauuuuuuuguguuuuuaauagagacgggguuucaccauguugaccaggcuggucuugaacuccugaccucaggugauccgcagccucagccucccaaagugcugggauuacaggcaugagccaccgcgaccagcccugacucuuaucagcacuaauuuuccuugugaccggagaagucuuuuaaccucucucggcaucaguuuccuuauccagaaagagaaaagucugacuagaugauuuccauggucucuuauaaaauaauucuaggcucccuauaagcaccacugaaaaaaacuugaaaugauggcauucuuuugaacuucaugaaaacuguaugaauuaaaacuuaaauacucaagccaacaauguguuacaucaauucuguaucauccugcgcugcugguaauacaauggaaacauaucaaguguggagggaauauuuauuuaaaauauauguuuaaauugagagaaacuguccagcaauauuuuuucccuucagaguuggaauaaugauggaguuugauuugauuuuagaagaggaacaacuaaguccagcugucagaaggagggggagauuggagauccaggugucuccaauuccccuuccacgcuagcccuguacugagcacuacuguauaagcacucugggaaggugucuggaccuaggucuggcuuugggacuggacuuugaucccugauuauccaaggaucucauuuacauuugccugaaccacuccucaaaccccgugaaucccagaauuuccacauuuuuuucccagugaaaggacucaggcauuccugauagaugcgugcacaaaaaggugagugaaagugcaguacccccacccaccaggcuucaguuucugacaucugugaugucaccgcaaaugcccacuaccaccaaaacugguacuaucaaggacacccagccaacuaacauuuagaaagcaaacucuuuauuauuaaacauuaacauauuuaucgacgugugaacauucugggacaaaaucaucugcccacuucuugacgggccauuguuagaacgaauauuccaaauguucugcccauauugcauuugggggaagaaacugcucugcuaaaccaaagaaacacaaaauguaagaacuagugggcagaaucaucagcagagagcccccucacugucacaucgcccuugugaggcacucagaaaagcuacagcagucacuuacaugacaacaccaacuuucaauguauugguucacauauuuuaauuacaucuuggucccuaaagaagccugcagccagcaaacagacccaggcacgaaaaguaaaugagucucaaacugauuagcccaauaggaauuggacaaccccuuaaggggcucuagauggugaaggacacgcuguuugcccugccauucugcagcacaaaaauccaggcaggucgaagagggcggacacccucgcguggccaccagcccggagccgcagcucacacagcggccuccaaggcguuucgcaggcaguccccacagugguucuuaaagcggccgcucucgccaauaauugggagucuaauuacgcaacguucuucccgcucccauucccgcuucuucucucuuuccaacaguccgcuaacgaaccagguacuguagcugggugugucgaaaucauuuuuccccugcucccaaguuucucgguauauacgguacaaaacugcacaaaacccggcgcuaaggagcgcaggaggagcugacacuucacacauuugucaagauuacugucaggccccaccucggcgauugccacauucccgauaggcaucgcaguuguaaaauacacaaguucccuccccggcuccggacccgaaagcgucugcaggcgcugucuauaacuuugcuuuucgaugguucagucauuauuagcauuaugauugguuuuuacaaaacgcacuggaaucuuaagagucuuuuccuugcucugcugccuucaaaagacauggaaccccaggacugcuccgagggcccugggaaugugccggcugcagucucagggcucccucacuugucuugggucugagggcgcgacggugacgagaaaggggggacuacggccaggaaaggggagcagggcccaauccccuccccuagcgaucccgcagugaagggcccgggcgccgagccaggacaggcgcgauucgcucccguuuaucaaauccuuaucggugccccgaggugggaaccgcugcuuucgaccggaggauacacgguuucuggcuccagucccguaguggaaguuggaacaagagcaaaucaaccucggcagugagcccucccggccagucaccucccucccuuagcgagucgguccuccucauccucgcaccucuauaccgccgcuccgccgcugguuucccgcggcucaggcgguucagccggccgcgcguuggauuccagcuucccgcagcauagccucgccaagccgcggccaagcgcggggcuggaagcuccaggccacuggggccgcacggguggagacaggaggagaaaggggacaggcggcgagccgcacacauuugcagaaguugaggcccugccugcuucugcgcggccgcgcagagggcucgaacccucgcucggguagcgccgggcccggcuggacugggagcggccgggagagggcgagagggcagcaagaaauggccagaguugccucucacccagugccgagaggcucgcgagggcaggcgggcagaucguggcugcccuucucuguccucuucggagacagacacccggaccugccagggacauccaguguugccguccgcuuccuacacaccgaaccaucugcccccgcagggcaauccaggucacucacuaccuacucuccccagagucaaggugcggcacgaggaaguggguucuccaaccuucgguggggucuggagcccggcagcggggcgcucugaaggguccuggcuccucgguaggaucgugucccugagccgcucuccgccucccgccccccuuugcccacuugggccgcggcgcgggcacaggagcgcauuuggaaggacuccgcgaauccagagaaaaauagagacguggaugcugccccaaaaugagagaccagagaaagucgaggacaugcacccacaaacauuuccaagcgccgguggccacgguaaucugcugcggggcggcugggagauuuucaaaggcaccgcggaagcaccuccgaccuccaggccaucucccucggccuccuggccucgccgugcgcgcaaauccccgacuccuccgagccgcagaagucuccacugcaaagcugcugauccgcgcccccaaaccgggcacaugcucucccccucacagcccuccaaaccgagccucgagcuccgaagaccucucagcacucuucucccaaccacucucggucgcgccugccccgcgcagcccggcccuggccucggaccggcccccugaucggcccggacgcccgcuuaccuuuucuucuccuugucagcugucauugucgcuguggcccuuugagacguucagacgccgagcaccugggcucccuggcggguggggggcuguggcccucguccgcuccccgcggcccgggcggguggugaagguccgaggugcgcgcaggucccgagcgccccgcgcagucagguggaagguggcgcgcggcgggcuaggugcgggggcggggguggagaaaggugacugggaggaaccugcgcgcggaggcgggguccggggaaggaguggguggaggcugucagacccgaaaagaggacggagagaagggaacccaaguuccuuuuucccuggaaaaggagucacuuuucugaguuuucaaagaaaaaaaaaag

SEQ ID NO: 21552 - RNA, 140451 nt, Homo sapiens
ugcucgggggggaccugcgggcucaggcccgggagcugcggaccgagguuggcucgaugcuguucccagguacuguuguuggcuguuggugaggaaggugaagcacucaguugccuucucgggccucggcgcccccuauguacgccucccugggcucggguccggucgccccuuugcccgcuucuguaccacccucaguucucggguccuggagcaccggcggcagcaggagcugcguccggcaggagacgaagagcccgggcggcgcucguacuucuggccacugggcgagcgucuggcaggugagugaggcugcaggcauugacgucuccucccggcaaagcuuccucggcuuugccccgccgcugcucgggacccuacggugcucggcccgacucuguggcucucuucucuccaugucucacccucuccccuccccgcacuccccauucaggccuccaguuggccccuggcuuugcagguccuccauucucacgcaguggaugggggucgcgacgcccgccguccuccaccuuuccuggcugcugcuggagcuucgccccugcaaguggugccccauucgcguuaggugggugggucguccgcccuucccauuuuagucgcuuccccaucuuccucguuuggacccucuugcuuccucuaaaaguuuuaaacucucugccugggaaaauaccugauagcccggcauguggaguuacaaagaaagggcuguuauccaaaggccggugaauuuuguucacuuugaugggagaaucaaguccccaggagccuuggaugguuaggucagagucugacuccuugacccaccaaguagaggaauggugccucuguuggcaaaugauuguucaucuaaaucauucauuuuuuucggcuguaggaaaucuuuggucucugaacuguugaggugggggcgugagcuuucuagaucuagugaaagaauuggaaacuguuauauucguuuuaaaaaagaagaccuuaugcaguacauguaagacaucacuuaaugguacaagcaaggauaagugauuuauucuuuuauucaguguuagcuuaaauugccuacugacgucuuagaauuccauguuguacaagcccuuuguuucuauuuagaaaggacuaaaauggagaaaagcuuuuuaaguucaaaacuucuuaaauugcuuguauucucgauuguuguuacuguucaacccuccuuaggaguacuugauauuuucuauaugauuuagucuugugccagucucaguacucccuccuuuauuaguggagcaaggguagucagaauuacugguguaaaaaacuguccuaaauaacguaguaccuugccagagucuaagugcaaaaugugggaucaaagcgguaguggaggaaguugccauggcuaauuuuuccaucuuucccuggauggaaggguuggauaacgugucaagagccccaaaauuguagaagugagauuaaaaauauaaaugauagcuugcccuuugaaauugcaaauggguggaccuuuuuuauuaacauuaaauugagcaauaucguuuucuugaaguuaugcuagauguucuccaaaguuguuaagcacaaacuaugccugcuguauuagaauuguauguuaaaaauuuuuaacguguggguuauaaauagccuggcagauuuguuuacuuuucauucugucucauaacacauaaucuauuuuucccuuuacuguggacuuuugaccuuuuaaugcauuuuuaaaauuuagagauagaauuguucagcuuaaaagaaggaggaauauuuuuauguuugcuucuuguaugggcuaguucauucguugcuagccuucacuuuucuggaaccagagccuguguguuuuuagagcugguugucucugaauucucugcauacaguuugaaggggcaguagcaaagcagggguugcugagccccaaucaguggcucacugcuucuggcaaaaugauuuguagcucuguaucaaaaaacaucugaccacaaacucuuuaaaaccucucacuuuggcagggugugguggcucaugccuguaauuccagcacuuugggagaggccaaagcgcauggaucgcaugaguccaggaguucgagaccagccuaggcaacauggcaaagccucaucuguacaaaaaaaaauacaaaaauaagccaggcaugguggugcaugccugugauuccagcuacuugggaggcugaggcaggaggauuguuggagcccgggauguggagguugcagugagccaagauugugccauugcacuccagucugggugacaguaagacccugucuccuaacaaacaaacaaacccucucacucuuccacucuuauggaauuugguauuuuuuccuuucucucucucuuucucuuugugaaccuucuuugucucccuguucuuccaacccauuacccuaaugcugauuucauuugccucccuguguaaccaggaucccaugaucaucagcuuuuacuaagcuccuauugauggccuagaaugcuucacuuucuguagacuuaccuuucuaguccccaauccuaaauaagccucgcuagcuuuaccaguuugaccccugaaauucugagggacaucagagacagcuaugugaggauauuggucaguuuuuaugccaguuggugcucucugcugggucucuaguguuguguuccuuuucuucucauuuccucagguuuuuauagcaaauaacuuaaucucuuccuuugcugagaaaaaucucaaccaucugagguauauuuccacuucacuuuuuucaucucagugucaucucuuuauauauauauaucucagaggaagaaaugaccuucuuucuuuucaagagcaacccccucccuccagauguguccauguacccuuucccaucuuucuuucucuagaaacuguccauuuucacuuccuguccaccuucuucagccucucccucucuagccuacauagaugcuuguaucuucugccauauaagugugugugcuguucaacucuaggaggacguucuaaagcuugagucugcuaugccacuguauuucuauucuuuucuuuaaagacuuauucuuucaucccaggaagcuguuauaguaggaagaacauugacuuuugagcaagauagaacuuuugaucuggguuuuugaagucuuuuaaaaccacuuuaguagcuguguaacuguggguauguuacuauucagauuucauucuguaucuauaaaauauguuauacuuagcucacaggguggugguuaaagaaauuaauacauguuaaauguccauccaaguguuugguacauuguagaguucuuacuaaaugcuucugugcuuugcacucguacugccuuuaccauuucaccacugaaacuacuguuuuaaaaguuaucugugaccuccgaaucaccaaauccaaugacguuuccucugucauccuugguuuccuuagacccagggguccccaaaccccaggcugcagacagguaucaguccuuggcuuguuugguguuaggaacugggcagcauagcaggaggugagcagcaggggagcaagcauuaccaccugagcuccaccuccuggcagaucaguggcggcauuagauucucauaguagugccaaccuuguuuugaacugcacaugcaagggaucaggguugcauguucuuuaugagaaucuaacuaaugccugaugaucugagguggaacauuuucauccugaaaccaucccccacccaacuccugucccauggaaaaauugucuuccacaaaaccauucccuggugccaaaaagguuggggacugcugccuuagaucaguugugaaauauacugucuucuguagucauaaaacgaucuagauuucuuggcuuuucugcauuauacuuccugauucuguauuucucaggaaguuucuucacauuuuccuuuuaucaguuaggcugcaaaugggauuuaaaaaugaaagauaagcugggccauggugucucacaccuguaaucccagcaguuuuggaaggcccaagugggaggauugcuugaggggcggaguucaaggcugcagugagcuaugauugggccacugcacuucagucugggugacagaacgagaccccaucucaaaaaaacaaaaaaacccaaagagauguuuuggcucuugcaauuggcaaguacauagauagaaguggcuugaagagugcuuugucaugucaucagggcuaagcucccauuuaucugcuguucucucaacauuguccuuguguuugggcuuuagacuucccuucuaauaaaaaaaaaauugccaccaaugauguucauauuauagccccuucauuuauuuccaaagaaagagagaaggccacuucuccuagccuuuucccaagaauccuaagcucuaguuugauuaaacaaacauagaucaugcugccaaaccuguaacaauaucuuugucuagagggauggaauuauccuaaguggcuuagccaguggagugaaucuuaccugaaaauagagacugcaacacaauacggggaagggguggauccuggggaaguaaccaguguccucaagguuccauaugcuuuucacuguguucucuuggugaucauauccuuuaugauauaaaccaucauuucuguggggcuguuucuugguucuguaacucccuacuuccauuuccuccuguauaugucuaucuuauauauacuacccuaaguuuaacucauacuaaacugagucaguuugaucucuucaccaacccucaccuagugugugugugcacauauauguuuuguuguuugugagaccgacgggguuucacucugccacccagacuggcauguaguggcauaaucacaacucacuguaaccuagaccucucaggcucaagcaguccucccaucucagcccuuagccuccugaguaacuaggacuacaggugugcaucaccacacccagcccuuuuuuuuuuuuuuuuaagcgaccggggcuugcuguauuccccaggcuggugucaaacuccugggcucaagugauccaccugggauucucaaagugcugggacugcaggcaugagccacugcacccagcagcaugugcgcguuuguauuccucuucccccgauuucucuuuucuaacuaccucucucucaacaacccagucuugaaaucuuucagaaaucuugguucuucucccacugucaaucacgugucagaucuugaauauaucuuguuuaguuaggcccccaaguuguauaauacccaguuaacauugauuuaaacaguaucucgggcuaggcgcuguggcucacgccuguaaucccagcacuuggggaggcugaggcgggcggaucacuugagguuaggaguuugagaccagccuggcuaacauagugaaaccccaucucuacuaaaaauaaaaaaauuagccggguaugguggcaggcgccuguaauccccacuacucaggaggcugaggcaggagaaucacuugaacccaggaaguggagguugcagugagccaggauugcaucacugcacuccagccugggugacagagcgagacuccauagcaaaaaaaaaaaaaaaaccaguaucucacauaaaaaguccagaaauggaguauuccaugguuaguuuagcugugcuaugauuucaucaaggauucaggugcuuuccaucuuuaugcuuggcuauccuuagcaugcuuaacuuugggcucagacuuugccaucaugguugcagauggcucugcuccaggcaucacauucuccaaagacagguggaaguuuguccuuucaucucuuaauuaggcaacuaaaccguucacagaagcccucuuuccgauguccauccuggcgugccgcugcuuuaauuacgaggaggcugggaaaaugaauauguggcauuucagucuaggaagaggguaagcaaauggcugauuagaagaaaacagauggugucaaugacaguauuguauggagaaauuuaaauaaauaagaauuuucagauaauaguggcaaauuuaaaacacuguuuacaccaagaguuaauauaagcuguacauaggauuucaguguuuauuuucugagagagagucucguucagucacucaggcuggagugcaguggcuugaucucagcucagugcaaccucuaccucuuggguucagcgauucuccugccucagccucccaaguagcuggcgccugccaccacacccagcuaauuuuuguauuuuuaguagagacaggguuucgcaauguuggcuaggcuggucuugaacuccugaccucaagugauccgcccaccuuggcaucccaaagugcugggauuauaggcguuagccaccgugccgagccuauacguaagauuuugacugaacauuuaaauagucauaggugacugguuaaaaaugaauuauuauguaaaauuagaauauuucagugguauaucccaguuuguuuaagacuguguuaaguacauuuaagcauaucuguuggagcuacugcaagaaacagguauguuauauguaacaacuauugaaauagaguugugguuccccuuggggaugggagauguuuggaaauacuauauggggacauuuuugguugucacagugacugcgagguacuacucauaauuauuaaguagaggccagauacacuaauguccugugauguuuggaauggucccacaaaacagaauuguccuuucaaaaauaccaguagugccccugcacauguauacacugaaguuagcaaaugcuuugccuuuugaaagaauucagagauugaucuauauucuuacauugcaagugacagaaaacacaaaacuggcuuaaacaaaaaaagggacugaguacaucuucuaguaaacuuuagcuaagacuucauccaguggcucacaugaaaacaucaaggacuuaauuucucuuauucauucugcuccauuauuccccaugauuugguuuuauucuugggcuagcuuaucuuaauggugguaaauuacuguaguacuuucagacuucauauccucauuucacguauaguaaaaugaaaaauauuuuguauuugauuuuacaaguauuuauuuaguaucaccacuacugaaacuuucccuaaacaucuaucccuaaaaaguuuauuaucucuucuaucaugcuucagcuuuacaaucuauauaucacacucuauggguauuauuuuucugucccaugcauuacucuaccuugucuuaauuauuguauucuuaaugucuaaaugucuggaauacugucuggcauaguaguguaugauaacuguuuauggaauuagugaaugauuuugugcuuacuacagaaaggaagaagcaaguauauauaacaucuauugaaauagaguugagguaccccuuggggaugggagauguuuagaaauuuaagaacgccucauuccuucaucaguuauuuuugaauccugaauuauguacauuguacuccuaccacuaaagcauguauaugaugcucuugcaguuguuauaauagaguaugaauucguuugaaagcguuacugaauucuacuuguguuuuugucauuuucucaacaaaaccaaaaccaauuauuaauugaacaaauauuuuugaagccugcuguaggcagauaguguggcaacauugagugggaacaaaacagagccuguguugucugagcuuaaauuuuagugggggacauagucaauaaauauuauauauguacacauacacacacacaaauaacaucagguaguauauagaucuugaaauagaauaaaauagguucaggggacaggggauacuacuuuaguuugguaagagaagggcuuuuugagaagccguuugugcuaagagaccugaguguucaugagugagguggccuguaccauucuugucgagaugugaaauagaauaaaaugaggugcccaucauuuuugguuuuggaagaguuuguguauaguuggaaugaauucuuccuuaaauauuuguuauaacaugucagagaaaccaccugggcugggaguuuuccuguggaaauguuuuuuaaaauuugguauuuauuuguacauauuuaugggguacauguuauauuuugauacguguauaaaauguguaaugaucaagucgggguauuuagaguaccugucaucuugagcguuuaucauuucuuuguguugggaggaaagguuuuuaauuauuaauucaauguauuguuuuuaagccuauucaaguauucuaucuugugauuauuuuuuauaauuuuuccacuaagaauucuuuuaucuaaaauuuuaaauuuacuggcaugaaauuguuuauaauaaauauucugugguccuuuuaauggcugcaggaaaagauucccuuuucauaucugacguagguuauuuguaccuuuuccuuuuccuuauuaguuucaccagagaucaguagucuuuccagagaaccguauuuugaauuuugcuagucuguuguauguuuauuuucuguugcguuaauuucugcuucuuauuuccuucccugcugcuuuuugggguucuucggugaaguucuugaauuuucagcauuucuuguuuuuaaauauguucauaaaguuaaacauuccccucuaagcgccauuuuagcuaguucuauuacuaguuuugauacauaguauuuuuugguacauaguauuuuuauaauucacuuaagauguuuucagauuucuguuaugauuuauacuuugacuuuuggauuauuuggaaguauuauauuuuuauuucuaaacauauggagauuuuccaguuauuuuguuuuuaauuuguaaaauuacaauguaauccaagaacauacucuguuucaaaggccuguuauuucagacuuaaaauuugagaucuguauauggcccaguauauugucuuuuuuuuccucuccauuuauugagugcaggucucuguauuuuuuuuauuaggucauauuuguuaauccugcauuucaaaucuuaaguaucguaggugaucuuuuguuugcucaucaguuacuaaaaguguauguuaagaugcuccauuaugauuguggauuugaguauuucccuuguaguucucuaaucuuuuauaaauuugaggcuaugcuauuagaugcauagaaauguguaauagcuauaucuucucagugacucaacauuaucaaguuuccucuuuuauucugguaguacuugcacauuaaagucuaguuugagaugaauauaacaacgcuagcuuucucuuuauuauaguuugaucuucuuuuacuaguuauucuagaaauugcuaucuaucuuauaaaaucuaauguuaaucaauaccuuuauccuauucucagaugaugcacuuuaauucuacuuacuugcagcccuucucauauaguuauuuuuguuuguuuguuuguuguuguuguuguuuugagacagggucucgcuguguugcccaggcuggagugcaguagcgugaucuuggcucacugcaaccucugccuuccagguuaaagcaauucucgugccucagccuccugaguagcugggauuacaggcaugugccacuacgccugccuaauuuuuuuguacuuugaguagauacgggguuucaccauguuugcuaggcuggucuugaagucccggccucccagaaugcugggauuacagguaugagccaccgugcccagccccuacucauacaguuuuguugugcauuuuaauucauucuuauuuuuucucuuucuuccucauuauuguuguuguuacuguuucauacugccaauauuuuauuuaaguuaaugcaugucuuuaccaucuuuuuacuuuucguaugaucuugcacuuaagauugcuuucuuugauuuugaaggaucugaaacacacccuuuagaauguccuuuagucugcuugaaaaugucuuuauuuuaucucagucuuaaaggauauuuuugcuagguacagaauucuagguuagcagugguuacuuuauuucagcacauuucauuguuauugagaccucaacucuuugugucucaacuuuuaagauaaugugauuuuguuuggcugcuuuugagauuuuuaucuuuggcuuuggcuuucuguuuuacuaagcugugauuaggcaucggauucuuugggcugugugaauauauggauuggugucuuaucaguccuggaaguuucuuagccauuauuuuuucaaauauugucuuugcuucauauucugucuccugucauuuugggacuaguuuaguauguuaggccuucuuauccugucucuuaccucuuuucuuuuucuuuuucuuuuucuuuuuuuuuuuuuuuuuuuuuuuuuuuuugcuucuuuuugaccucaaggcauuguucuggauauugcuucagacuuaucuucaaaguucacauuuuuuuuuucaccuaugccuaaucuguuauuaacucauucaguaaauaccuaauuuagguuauuuuuuaguauagaauucuuauuugguucuuuucaaaacuguaucacuuuuuacaguuuucaauuuuaagcaaaaauauuuaaguguggccuuuauccccuugaauguaguaagcauaguuauuuuucaguuugugucugauaauuccaauguugggaagucucuaggaagcugauucaguuguguuguagaaauaaauugauguauauaauguaagaugaaguuaaucuuucucuaaagaagguuuucauuugcugucaccaagugccugggggugugagaacaucuuaaugaaauuucaaaucuuuaacuuuccugggccacccagaugaguugaaacugacuucaguccaugguuuccuucugguuccuucuuuauuucuagguugcagcccuuuagggucucagccggaagccaaugcuguuuucacugcaguccucacccuuggugggucucagacucuggcuuugguccccugugccugcaaugcaggcaacaaacaaccaagcucagccucuuaaaugcuucuuuguuggcaaacucacaaaaggcaaaagcuggggucaccuuucuggguuccugacuucuaguggauuugagcuucuuauucauuccucguuauuuugcugguuauuuggugcuguuaagaucauuuuacuaucuuaucuagcuuuuuaaauugucuuuguaaggauacuuggucugaauaaccuggucugcuguuucuacgaguguaaguccaaauauuucuuugacuaacuuguucagaaagacuggaaauuucuacauuagccauuccuuuguguuagggcuccuuugauggugcaaauuagauaccuggaaaagguagacuuuaagcuaugguugccuuuuaauuccuuuaaaguuagguuaguuccuaggacuuugcaaagcccuaagggaaggagacagaggauauuuuguaugaccggagaagcaaaaaauacuuguaugugaguagugccuuaggguaggaauuauguaagcaaauagaauguaaugugaacauuuuugaagugggacuguauggaggagggagaauguacuaaacugaggagggacugcagacaaauuugucuuuuaguauuuuuguuggaaguagguucauuuucauucuuuccuucuuuacuucuucuuucuuuucuuucuuuggacagagucuugcucuguugcccaggcuggaguacaguggcacaaucuuggcucacugcaaccucugcuuucuagguucaagcaauucuccugccucagcccuccgaguagcugggauuacaggugugcaccaccacgcccggcuaauuuuuuuuuuuaauuuuuaguagaggugggguuuuaccauguuggccaggcuugucuggaacuccugaccucaaaugauccacccaccuuggccucccagagugcugggauuacaggugugagccacugcacccagccucauuuucaauaauaauucuuuuuuuuuuuuuuuggagacagagucuuacugugucgcccaggcuggaguggcgugaucuccacucacugcaaccuccgccucccagguucaggcaauucuccugucucagccuagugaguagcuggaaugacaggugcgcaccaucacacccggcuaauuuuuguauuuuuaguagagauggaguuucaguauguuggccaggcuggucuugaacuccugaauuccugaccucaggugauccucccaccucagccucccaaaguucugggauuacaguugugcgccacugcgcccagccaauuuucaauaaaaauucuggcaaaucucucuaugccauguaggugucaugauuuuuauuuuuuauuuaauuuaaauuuuuuuuacaucucaaggacaaaauacgauuucaaaaaucuuacccacaucuauuuaaaauauagguacaauuugcguuugaauucugagauuaaaucuguugaauauggaagccaaacagauacauuagaaauucuucuaggcaaacuaagcuaugguagucuacauaaauugguguucuucugugauggaggaguguuaaaaauuuaguauaacauaccaauauauuuuuccuguauagauacuugauuugauauuagucacagccauuaauaugaaaugccauccauuucuuugugauuaaauugaugugucuauaaagaacaaaaccagcucuguuguaugaaaaccuagaauucuuauguguuuacuguuuacuuauuuuuuucucuuugcuagaagaaaauacuaagucaaagauuccuauuauaguuccuucucuuuccugcuauguuagauucaaauagcuuuuuguuuuagauuugcucacuugccuuuaaaaaacugaaggauaaaaugagguggacagagaauuuuagaacuggaagagacccuaaauaucauuaagucucucaugaacccucccguccuacccaucuccuauuuuaaacaugugaaaacagaggcccaaggaagaugggugacuugacuugccuaaaaauaugagggaauuucucuccaauagcuuuuauauucuccaugaaguaggucgucagcaaagaguggcauagguagaaaaauaggucuguuacagauuugaggagacaaaaaagacacuuagagugugggaaggcaaacuuuccaggagacauaguagcccugcuaggcaguauuggauauccuuugauguuuauaguugugaauuuaaagugaaaccagcuagcuuuguuagcugguuuucccccuuuccucuauaauaagcugcucugguacaggcacguaaaaguggaauggaauuguucagcuagaguugagauuuuaccagguaacagagggagagaagaguaagggguuugagaguuugaaagagacugguuauuguugcaucuaaagagaacaguguaaagaugaaaguaacggauggugaaaaaugaugagagcauuuuugauuggauuggagaacacaguaaguaaggugagggaauguugaauuuggagauaguauaaugaacuagaggggcaggagauacauuuuaaagacuggaaauuuggggcugggugcagugguucacaccuguaaucucagcacuuugggaagccgagguggguggaucacuugaggucaggaguucgagaccagccuggccaacauagugaaacuccaucucuaguaaaaauacaaaaauuagccaggcaugguggcgugugccuguaaucccagcuacucgagaggcugaggcaugagaaucacuugaacccggaagacggagauuguagugagcagagauugcgccacuacacucuagccuuggcaacagugagauuccaucucaaaaaauaaaaauaaaauaaaaaaauaaagacugaaaauuugauuuuugagauuuuugguuaagaauuuggagaugacgcaguuauugaugaugacaagguccugcguggaucauggaaguugguauuuggaggugaagaaguuaaggagcuaagaagccagaguguuagguggguaauccacguagacuuugaagucacugagagugaugguggggguaagaguggagaagagugcuagaggcaauagaggguacacaguuggguaucaugucagaagaucuuggguguuuaagaaaggaggagaaaugguuuggaagugauaauuggaugcaaggagcauaucuuuugccucccucuacaccaggcuuguccagucuuuuggcuuccuugggccucguuggcaaauuuuaugucuugggccacacauaaaauacacuaacacuaacaauagcugaugagcuugaaaaaaaauugcaggaaaaaaaaaucuccuaauguuuuaagaaaguuuacgaauuuguguugggcugcauucaaagccauccugggccaugcagcccuggggacaaauuugcucuagacccuucaguauccuauuccuaucuccuggccuaaaguacauaggaugugagaggaaaaaaagacccccccauugagaaagcggcacagaaaguggugucaucugauuucaacuaagauaaaucggugaagaugacauuuauugaagaguuugaaguuacaggggaguucguugauuaauuuauuguacauucaucuauuguauuuuaguacaguaguacuaaaguaauacacuguucgguuuugugaguuacauaaauuuccauacuauuauggcauuuuaaacacuguguguuucagaaaaacucuaaacccuuguuuuuccucugcucuugcaccaccacaacaaucguuaacauaguaaaagacaucugugucucaucuugggaaauuuaccaauuaaaugaauuaaaaaacagacaccugugaccaaagacguggggcuuuuuccccacacaccaauaguggaugcuaguuggguguccuccaauucauuucccacacugucuauccagaaauaccaucagaucccacagguugagggcucaggccccaagaccacccccuccuuccccccagucccaaguccuagccucuggaacuucugauuggcuucaaguuggguuucccacuacccccucuuuggagucgauuaauuugcuggagcaccucacagaacucagggaaacacuugcuuauauuuacugguuuacuauaaagcauauuacaagggaugcagaagaagagaugcacagagugagauauaggggcaggggcgcggagcuuccaugccuucucuggguguaccaaccucgaggaaccuccacguguucagcuauauggaagcugucugaacccuguccucuuggcuuuuuauggaggccucauugcauagguaugauugacaaccauguagaaauguguuuggacaaaaagugcgugaucuaagcccagcaaggccugucuguucugacucuucuuggccucucuguguagcauuucuucuuugauauggggacaggacccucucuggaaugaggguuuuugacccaaaaccagauuagagucaugccuuggguagguaaaaggaggacaggagaaggcuagagagagagauucuguuccugaggccugaagugccucaacauuauuaaaaaaaaagaggacuauaauaagcauuauaguagugaagagccaggaacuggcugggcgugguggcucacgccuguaaucccagcacuuggggaucgcuugagcucaggaguuugagaccagccugggcaacauggagaggcccugccucuacaaaaaauaaaaaaauuaguugggcaugguggugcagccuuguggugccagcuacucagaaagcugagaugggagaauugcuugagccugugaggcggagguugcagugagccaagauuaugccacugcacuccagccuggggugacagagucagaccccaucucaaaaaaaaaagaaaaagauccaggagcuguggaugaaaacauauauauauguauuucacacugugcuaaaccuguugugguauucagguuuucuuuugugggaggggaaaacaugaagagaauaguaguucaaaaauuuaaacaucugucauggucccauaggaauaauguguugaccggaaugaugaugucccagcccugcccacaaaaaaccauuuaauuuauaugcuguauuaacugccauuacuaccauguguaacauugaauaaugcuauuucuagaggaaaaugaauucaaaguuugaaauugggaugucaggaacauuucaucuccuuuuauugcucuaguauaagaguuuucuuccuuaccuuaccauuacugcccccacugcuacucuuugccaagcaauuaaaguggaaauucccugcuucuaaacuacugggagggcucuaauuuuggggggguccaggguuuaaugauuagaaaugagaacaaaauucagaugaaaaaaagagcagaguuucaggaagucagaggaugaggagcuaucuggggaauagucugaucuuuuaacggcucccuuucccuaauccuaaagcaagcacaaaauauuuuuagagcuuuaugaucucuuauuguuaguaaagaugaaaaaauaaaucagaagugagcaggcuauccuaugcuuguuauuuuuucacauguauuuuuaacaguauacauacucuucauccacucaacaaauaauuaauugcuacuagauaccugggacagugcuuguauaguuaugaagaagaaaaagcuuguuguucagaagcucauagucuaauggagagaaauagauauuaguugaguugguacuuugggagcauggagaaaaaagcaccuggcugcuuaggauagguauagacagcuucacagaauugggccuugaaguaugagagguaguucauucauauucugcagcuauuuggguaccuacuuuggaccaggcgcaauacuagaauacauuugagaauacaauuaugacauacaagagucuuguccucaaacagcuuuuagugagaaagagcaauauauacguaaucccaagugugugguaaaugagauaguugguaagcacagggaucuauggaagcauuggggugggggugggggcagaucuuacucuggaaggaggacuuagggaaggcuuuugggagaggucaucuaaauuggguccuguaaaauggguccacauuaucuaggugaaaaagcagauguaagaaccuuccaguaaaugaaaugguauagugauuugguggugagugcacagaauuccaaaugguuggaguguagcuagaguaggugaguggcgguggguaaggauggaggagugugaagagccaaggccauaaaggaccuuacauauagugcuaaugagcuuagacuuuuacuuugucacuguuugggugcuuugaaagguagaaaauacuaaucuugaagggucuuucuaacagcuggcaauuaacagauuuuuauuuuauuuuuuuuuauuuugagacagagcuugcucugucaccccaggcugaagugcaguggcacagucuuggcucaccgcaaccucugccuccuggauucaagccauucucguggccuagccuccccaguuacagacacgugccaccacacccagcuaauuuguauuuuuaguagagacagaguuucacuauguuggccaggcuguucucaaacuacugaccucaggugguccaccugccuugguccccaaaagugcuaggauuacaggcgugagccacugcacccaaccagauuauuuccuguaaguauaacuuacagcaauuuuuuuaaagguauuccaggcaguuguuaaagauuuaaacaguaagagagugccacucgguucuguuccccagaggaagucacuguuguuucuugaguguucaagcagcauauucuuaauaucagaauaguguuagaaacaaaacaguuucaaaaggagaaggaggggccgggcacaguggcucacgccuguaaucccagcacuuugggaggcugagguggauggaucccuugaguccaggaguuugagaccagccggggcaacauggugaaaccccaucucuacaaaaacauacaaaaaaaaaaaauagcugggcucaguagugcaggccuguagucccagguacuugggaggcugaguugggaggaucaccugagcccaggagguugagucugcagcaaggugugaucaugccacugcauuccagccugggcaacagugagacccuaucucaaaaaaacccaaagcaccacauaucaaaaaaauuccuuuacuauggaauucccaaguauuuuguugagaaaaucuaaguauuugaauuaaauagcagaccuucuucagaaaaagauuaggaaaaagcccuuaccguaguauaugagguacagacugguucaggaucaagauccuuauuaauagccugugucuauuugaaaugggagaguucccugaccccuguugcaggaugugcaacaggggaguggcucaucuguucaggccaccguccaugcucaaaccccuuaugggagggggagcacacagacgggcaggugcagaagccggggcaagugccccugggcuccggcccccuggcagcauccaggggugggagccugcagcuccugaagcccaagugggcauguguuacagugagccccuuuagccuugcagacgacuuaaguguuaaccagcuaaguacccuccugguacccagguccuugucuggcauccaggaagauucagguuguacacggacuugaaggaugaaugcauggguuuuaucgaguuguggagguggcucucagugagauggauggggagcuggaagggggauggagugggaagaugaucuuccccuggaguuuggcuauccaguaggcaauuuccucucugaccauccccagccaaacuccucucggcguucaaacauuccuuuucuuuucucugcugugcuguuuugcuguucuucugcuucuccauuugucuccuuguggagcaggggguuugggguuuuuaaugggcacaggauaaggggacauggcagaccagaaggcaucuuuugggugcaaaaaaaggaaugccucuuccuauuuagggcugcagguuuccaggcuuggagguggggccuuugcuggagagcuacccuccucuacccaguauuucccuguuuccuguccguaucauguugagaggguauuugaauguggaaugaaauuuauuccaauucuuaaaccuuucugcuuguauaaaagguguaugacacuuaagauaauucaccugaccuuggaguacuugggagggaaaguuuaaaaagacuuauaaaguaaauaugaaguuucaguuuuaaaacauugaucuauuuugaaaaagggaauuacauuuauuagauuguccugauuuucuuuucucucuucucucugagaacauaauauuaaauaggcauuaugaacgccuauauuaggugacucauucuccuaaugcuuaaaaugagucuauaauauauauuagauacuauuagguuggugcaaaaauaauugcgguuuuugccauugaaaguaaugguaaaaacgcaauuacuuuugcaccaaccuacucuuagggguagucaggugaucaagagguuuccaauuugauugacauaguccaguaaugcuagauagauuuuuuuuuuuucauuuuacuuaauaguaaguugggacccuugcaaacacuuaucuucggacauucagagugaaauaauuuuauagucuauacuuuuaaaaaauucagcauguagcaagaccaaggaaagacuuucaaaaaggaagaaaaugguauagcauuaggcaaugccaucugcaguuauuaaauaugauauuuuaaaagcuuauauuuucucuuucaagguaagaauuugguaauauugguauaagaacaaaagucuuuugacccaaggcuuugguuucaaguucuaaaugccauuacuaugcccuauauuuauucuuucauaaacacccaauuuuguuuuuaacaucaguauugagauuuuucuuaucaauuaugauauauuuucagggcugauuuguguguuauaaacugauuuaucagguaaucugggcauuuuaggacaucuuaaauauuaaauaaaugaucauuuugaucuuguuuucuugggaaaaagacuuuaaaaaaaucauccuaugugcuacucuuucuugaauccacaugcauaagcauuuggugcuguuuugguaaccuucagucacuaagcuucucagugguaaaaugauaucuuuaugaauacaguuuguauuguaaaauuguacuuuugggggcggucuuauagcuguuuuagguuuuaaguagaggucaaaguauuaaaaaaaauugaagaagacauacuuaaauauacaggcaagcauaaaaccuuguuuuaaacauuuaacuuaaaaaaaaaaaucagaauuuuaucccuccauaggaaaggauaguuuaaaaugagcauguccaacccacagcuuugaaugcggcccaacacaaauucauaaacugucuuaaaacauuaugagauuuuuuugcaauuuuuuuuuuuuaagcucaucagcugucgauaguguuacuguguuuuuuguuguuguuguuuugagacagagucucucucuguugcucaggcuggagugcaguguugugaucucagcucacugcagccuccaccuccuggguucaagcgauuccccugccucaaccuccugaguagcugggauuacaggcgcccaccaccaugccugccuauuguuuuuuuguauuuuuaguagagacgggguuucaccauguuggccaggcugcucuugaacuccugaccucaaaugauccgcccaccucagccucccaaagugcugggaauacaggcgugagccaccgugcccgaccaguguauuuuauauguggcucaagacaauucuuccaguguugcucagggaagccaaaauauuggacaucccuggaaaacacugcauaccuugaaauugaaguuuuaaccgauuaggacauguuaagaauuuagaaaaauaaaguucuuacgcacaguuuuuucuaaaucuuuuguuaauuggguaaaaugguugccagaggugauuguguuuuuuuuuuguuuugucaacaucauagaauuuauaaacuuuuuuauaaagaguaugacuuaguuuuuuuuuuccugcaaucauauuuuccaguugaaaaagcuuuuggccauuacauucagcuauaaauuaguaacagugugcauaugauuucugauuauuuuuccucuugagccagaacuagaaacugguccuguaauaucuguggaucuuguucuaauuauauaucccuuuuuauuugaaauacuuaguauuuucauugccuauauggugaauucugaguuuuuuaaccuaacacacaauauugaaaucucugcccugaaaaauuccuaaacauccuugaagucuaguucuguuacuacuuucucucugaaaucuuuuuugauuaccuagcuggaaacgaucuaaucucccauucuuuaacaguacauucccuuguauuaaaacuucuucuguaaaugucuuaguccucuucuagauuauaaauugucuuacucauuauuguaucaucuacauucauacauugaacaaaaagcaccaagcacuguuauagaugcgagggaaagagcagugcaggagaaucuugguucuugucuucaugggauuuauauuccacuuuggaaaacaaugaugagagagacagaaaauuaaauaaauacauagauagagcuuuucagaucucaaaugcuuagaaugugaaacuccaucaugugguagaaagugugaggauagcaccagugcguugauaaggugaucauggaaggugugaucuuugaaaauuugacauuuuugccaaaaccugaaugacaugaaggacuagucauuugaagauuuggaagcagaauuuuugaggcugaacgaaagguaguucuaaggcauaagaaagagguaggugaggaaggacaggagaagugauaagaaucagaucuagauuaugcagaguuguaaaccaagguaaagaauuuaaaauuuauucugauuacacugggaagccaaugaacaguuugaaguuuuuaagggcucaugucauuacauugggucuacccaggauaaucucaugauuuuaaggucagcuaacuaauaaacuuaauuuuaucugccaaguuccuuuuaccauauaauguaguauauucacuagaguaacaccagagggcaagucuucagggccuaaaugcugccacauuuugcaugcauaaguuuuauuuaaucuaauauauauuuaguaucuuacaagggcagugaaacagaacuaacuuaggguagcugaguuguugagucaucacaguuuuucugauuuauuuugccuuuacuaauaugcccacuccuuggcauuaccucuuauuugcuaaugcccauacgauaaccccaaacucuguuucucuuuaguuauuuaacuaaauuaacauaaagaugucuccugcauuuaaagaaauuuuguuccagauauuuuccagagagaucuguauuuucucauggauaaaaauuuauggguggauucauuguagauucuaaaaggacauuuucaaaucuguuugaguuuucuuauuuuuaccuauucugauuauaauaaauccauucauucaauaaauauuuaucaaguaccuacugcugcagagccagcuacuauauaguaagcaucagaaugauaacaguugaacaaguaacuuuuuaugagggaugaggcuugaaaaaguacaagcugcucugaaagguaccuuagugaaggaaauugcugcugagacauggaggaugaggcaauauagucagcauuggcuuugaaggcggacugccauuucacuguugggugaauuuggauacuuuuuaaaauuucuuugagccucaauuuuccaugcaugugaauagugauaccuuuaucucuauagaaguuuuguuagauugaauauaugaaaaugccuaacguaauguuugccacugguuuagaagcauauuuaucaugaaacugaugaaguuuagugaaccuaauugcauggcccuuucuaaggcccuugcaggagcagcccuagcaaucuugaauuaauuuguguuuuucuuaaggacccucccacccagcugccccuuuauuauaggcugcuggucaccacaaaaucugaaucugccuuuggccacagguuaagugagaaauguuaauuucucucuccucuaauguugugacuucaguuagugucgaaccuagaaguacuuaacuuaaaaaaaauggaaagaaauuauauauauuagguuguaggaauuuuauaaaauucagaaaaaccgaaauucuuguaauuccuagggaggaaacaugauguuuuaucucucucugcuuuucucuguguacauacgcaauuuauuuuuuaaaagcuaguuuauaucauauuaaacagacaauauucugcauuuucacauaauauauggauuauauaauuauauaucauauaauuauauuuuacaacguaauuuuaaucaucuuauaaaugugccaaaaguauaauuaaccaagcuguuguuaguaauuguugagguuuuuucuaacauuucaguaguacaaguaaugccaaauuacaaaucuuuguagggguaucuguacauaggauaauuucuuuuaauugggcuugcuugaguauaagaauugccuuuguccauuuucugcuacuauaacaaaauaccugagacuggguaauuuauaaugaacagaaauuuauugguucauaguuauaggagcugagacguccaagagcauggcaccagcaucuggugagggccuucuuauugugucaucccaagguggaaggaggaaggacaggagacggccagagcaagcaagggaucaaauuuguagccucaggcuuuuuaauaaaacacauuaauccauuacugaggguggaacgugaauaccucccauuaggcugcagcucccaacacuguugcauuggggauuaaauuuccgacacaggcuuuugggggacauacucaaaucgugguaaacauuuuaaagacuuauauguccucacugacccuacaauauuauuuuaaaauaucauugccuauuuuuauaguacucuuguguuuauuucuauuucuuugaucauuugauauacuaaaacauucuucuggguuuuuuugguuuuguuuuguuuuguuuuagacagagucuugcucuguugcccaggcugcagugcaguggcgugaucucuguucacugcagccucugccucccgggcucaagugauucuugugccucagcaucccgaguaucugggacuacaggcaugugccaccucgccuggcuaaguuuuguauuuuuaguagagacaggguuucgccauguuggccaggcuggucucaaacuccuggccucaagugaucugcccaccuuggccucccaaagugcugggguuacaggcaugagccauugcacaugaccagaacauuuuucuauguauuuauuaguccuucauauuuuuucucauguuaauugccaguacuuaugcaagauaccgggaaagcuuuuugacaggaagaaguaaguuucuuucuccuguaagcaaguccugaggcuguauaacacuccaaauuaaaaggcuauuucaaaaugguuucccuacuguagugcagugggaacuucgagagcagaaucuaaaggagugcuugguguuucucaucccuggcagcacauaccaaagcuugggcacuacccacagauucuuucuugguguuuuaaaagcuccucggaguacuaaagggauucugcaguguaacaacuaagcucagaaacuuagucccguggcugcaucacaacauuuguuuuuccauauacaggggccagaguuuuaacuuagaauauuccguuuccucaguagaagguuauauuuuacaauaauauuauuuaacaauugcucuacuauuauuccgugagggcaucuuaauugaaugcccuuugcggguuaauuuaaaaucacuuuuuaaaauaauguuuaaugaacaccuauguagaaaacauugugauauacaccaugagauaugagacaaaaucaggugagggcucuucccuugggauuuuaauagucaggaaugggauaagagguguauacacacagguacaaaauguguuugugccauaaaagauguaggaacaaugaagggaaaaggagaugaauugauucuagguggguugcuggauuacuucaugggaauuuauguuuaagccaaaccaugauuugggccaguagagcaauuaaucauccuuuacuuuaaaaaauuguuucaguuuauaaagcuuguucauaauacauaaugauccuuauuacagcucugcaagauaagucaguuauucccauuuuauagaugaaggaguagucaagccuuagaaaaguuaaaugacuuuuccagcguuaucaagcuacaaagugaaagauucagaacuugaaccuaagucuucaaucuccauaugcuggagccuucuaaaguaucucaguagaguagcgaagagcuauaugaguaagaaacuauaaguuuuagaaagggcugauaguuaauuuuauuauuaggauggaaguucugaaauaguuggagauaaagcuauaguauggucagcagaauaauggcucccuacaaaugucugcuuccuaguccccagaaucuaugaauauguuagguuaugugacaaaagggaauuaaaauggcuaaugagguaacuuuaaaauaggaagaucauccuggauuauugacgugggccaaauguaagggucuuuaaagagguuacuuaagaguggaagagggaggcagaaaaaugagagucagagaaggagauuugagaaggggcaaggucaguccugcagaaugagaaagacucaguccaccauugcuugcucugaagauggaagugaagugcuaugaaccauaaaauacaguggaucuguagaagccagaaaggauaaggaaacagauucccccuuagagccucuagaaagaagugcagcccugcagacaccuugguuuuagccuagugagacccauuuuagacuucugaccuacaaaacuguaaguuaucaaauguguguuuuaagacacuaaauuugugguaauuuguuuuggcagccauaggacauuuaauacgccuaggaacuauuuuauuguaggaagacuaauuaacaugaccucagggcacuccaugacuaaacuccaaacugucucuguuccacugucagcaguagaaagacauggaauguucuugagcaaaagugugaagaacuauuuugguguuugcugauuagagaggauauuggugagaggaaaauuaauuaagauucuauuagaugcuaggaacacuucuuuugagacucacuccuugagguaacauagaacauacugguaagucuugcccguagaagacuaugaauauaucucccaguccuguguggcugcucacgucuguaaucacagcaccuugcgaggccaaggcaggaggaucaccugagguuaggaguucgagguuacagggagcugugcuuaugccacugcacuccagccugggugacagagcaagaccucgucccugaaaaaaugggagaugguuagguggauggauagacagacagacauauagauaaagauagacacgugggucaagaucucccacuuaguuuauacaucacugaaaaucucauugccauuguaacauuucaccucguucucguaucccaugaaaaauacagaaccaguuaggcacacaucuaacuuaucucuucuuaggcuuuuccaucguaccauaacuaacuauaagauccgaacacugaaagguuucuaaaucugagcuuuauuugaugccuuaguaccuguagaaguuaaauuuauacuaguaacuguuuuuucaaugcauaauuauuauuuugaaagaaaaaaaaagcuuguugauaucuguaggcauaacucuauucuaugucuaaggucuucgguaaagagagacgauuaaguuuaucaguaaagcaccagagucaauuaaggcgacugaaaggagcacuaauuuuaauucauuuuacacuaguuaauauugucaauauucuucuugucaguuuuuuaaaccaaaagucuuaaauuaggccaaaagugccuagguaaaaauggaauggaaaggguuuucuuguguguguguguguguuuuuuuuuuuuuuugagauagagucuugcuuugucacugaggcuggaguacaguggugugaucucggcucacugcagcccccaccucccagguccaagagauucucaugccucagccucccaaguagcuggggaauguaauauuuaagacauuaagaauccuauuaauccuauuuagucauuuuuuuuuguagcugcagaagguucagaaggguuuuuuaaguugaauuauauguucauauuuacaacauuuacauaugaaaccauuuacuaaaagcaaugaagcugguuauaacaaacacugauacugaaaauaagagauauguuugucagugcggucuuuaaacaguguuacacaauuuauuucuguuucauuuugaucagaaaaaauauauauaucuuuugagacauggucucuguugcacaggcuggaguacaauggcgagaucucggcucacugcaaccucugccuccuggguucaagugauccucccaccucagccucuagaguagcuaggaccacaggcgcgugucaccacagcuggcuaauuuuuuuguauucuugguagaaaugagguuucgccauguugcccaugcuggucuccaacuccugagcucaagugaacuggccaccucggccucccaaauuccugggauuauaggcaugagccacugcacccugcccagaaaauauuuuuaaugcauacauauauauauauauauauguauauguaguguaaauaacaucuucaaucaaauagagauggcaggagcuuuauucugagcuaugugcaaacuugauaagacaagguaaugcuucaguaauuuuccaugcugaaauuuggcccaguauacuuugauuauauaucuauauuuaauuauaguuuuaaaauagcuaagcaguuuuaaaaauucaaauuaaacuuuuguggaaucucuaaaaauaagaaaaauauuacugaguaauuggcaacauaaaauacaaaauguuuaacuuggcuuucuuuuagauuugaagcauagugacuaaugaacauauaauggucguagcuuucuuuacaacuaugucauuuaagucacugaugaauaucuaugauacaugcaguaaaaauuuagacaaacauuuuggcuacaaacugguuuacuaaauaauagcuuguaucauagucugagucaagaguaauaggcuuacaauugugucuuaggguacuaagaaguucuuuugaggaccuuuuaaaagguauucuuuguuuugaaagacuguuuuccuucuggaaguucuaggccuuaugagaaauuaccuauucugaauuugucacaaaaaaugacuuguaaauaaguccugugcagugaaucaugugcuuucaguaagaggauuuugaaagccuuuuguaaaaugaagucauucucaaaagagaguuauuuagaauauaaucaaauugauuuacaugcuuuuauuuauuucaaauaugaagggaaauuguuucuaaauauauuuaaacuuuuaauagaacaguaguaugccaucaguguggaaauaacucacuuguuaaauaaauauuugggguguauuugcuguauaucaggcauuguaacacagggacuaaugaaagagaaaaaaaacaaagcacgaaaggacagcagaaauagcuccauaaucucacuuuccaggaauaaccucuauggacauuuuguugugugucuauugcuuuucuaauauauacauuuuuuaaucaaauggaauugccucaaauaugcuauuuaauagcuugcuucuuuucauacuauuugaaaauuaagaaacgauuauaauaugcuucauuuaaaaacuuuaaguuuaggccgggcacaguggcucacgcauguaaucccaguacuuggagggaccgaggugggcggaucacaaggucaggagauugagaccauccuggccagcauggugaaaccccgucucuacuaaaaauacaaaacuuagcugggcaugauggcacgugccuguagucccagcuacuugggaggcugaggcaggagaaucgcuugaacccgggagguggagguugcagugagcggagauugcaccacugcacucgccuggugacagagcaagacucuaucucaaaaaacaaacaaagaaaacuugaaguauaguauccuuuuaaauuuuaaauagauaauagaaacugguuuccccccauuuaaaccagaauuuaaguuuaacuuuauauauucuugacaguuuggauuuuguccuucaaccucauaaaauugggaauuuaagcaucaccugguucgauuuaaaugcaauguagaauuugcauuaaaauacuacauuaaagccucagauuuguaguagcuaacagcacuucuauguaugugucagggacugcucuaaauacuucauauauauuaacuccucuauucuguacuucuguucccguuuuauacagcaggaaauugaaacacugagagguuaaguaacuaaaguuacagagcuagagugacaggaguaaagcuucaacucaggcaacccagacuuccagaguucugaucuccacuacuaagcugcuagcauagcuuuucugguaacuauuuuuaauucaaauauaauucgagugaucuaucuaacaagucaucacucugacaacucagugacuuguaauguaaaauuauucauuguaauucauuuaauauuauuguuucucugugcugcaaaaaucauagcaaucgagauguaauuuauuacucucccucccaccuccggcaucuugugcuaauccuucugcccugcggaccucccccgacucuuuacuaugcgugucaacugccaucaacuuccuugcuugcuggggacuggggccgcgagggcauacccccgagggguacggggcuagggcuaggcaggcugugcgguugggcggggcccugugccccacugcggagugcgggucgggaagcggagagagaagcagcuguguaauccgcuggaugcggaccagggcgcuccccauucccgucgggagcccgccgauuggcugggugugggcgcacgugaccgacauguggcuguauuggugcagcccgccagggugucacuggagacagaauggaggugcugccggacucggaaaugggguaggugcuggagccaccauggccaggcuugcugcggggggaggggggaaggugguuuucccucgcacugucuuaaaccgauggccuuuccuuggcacaggguccacugcagcaugccaaacgaggaggcaggggcgucguccccccgccccccacugcagcacuggagauggauuuccuguacuucggauccaggguuuuugacagaagaggaagaagggggagggguagaaguguuaaggggagucugcugagaaaagcuguuuuugaagccagaagggguuuuuguuuuuauaaugccauuugacagaguggaauaacaguaucuaaggaaacggguagaggacaacaaagaauggagcauauucauggcgaggagcaaaagcucuaccccauugaaaggcuucuuuuccucccuggcgacaaggacacaugcauugguggccaaaagagagaggagacaaaaccgcugcagauggcugaugugaaucuaguggaaagagcuacuggggaugagagaaagaggaggaggcagguacugcagagcgugaguggugguguugguuggugaaauacuggucaccaguagugugccugcuuuuguaaaacaucuaaguaaacucccugugaacaggguggcaaacagauaccagugucuuuguuaguuacaaaaugcagugguaguggcuuuuugcggacgacugcagcagugcuuuuucucccucuguuaggccgaaaagacaacugcagaggaauaagaaaccuugcagcaaaugcugggguagaagcccauuuacaagaagccauaguuuauaaaugcagccugaacagcagaaaaaaaauuacuguuuuuuaaaguaggaauaaugucaggcuaugaauguuuugucauuggaauguauuggacacuuugauucuacaucacgaaagugaugcucaaauucuuugauuuaacauaaauccuauacgaaaucuuaauaaauuauguaugaaacaguggaucuuuucuuuuguuagugaagcuuuuaugccauuaauuaggucauucaagagcaaaccacuuuacaacguaaauuacuuugucaaaaauuauggugaacaaauuuuuguaggccuaauauuuaagaccuauaguuaaguaauuuuauauuucucuuugguugcuuuuagauaacacugaauaaauauuuaagauauuaauucagugugcaaauauuuuaaauuaaagcaacauggcuuuucuucuagauguauuucuguuuagugaguacucaugagauauacucuugauauaaaguguuuuucauugagcuuuuuuuuccuuuaccuaaauguaaaagccuaucuuuaugcauacuuauaguagccagccugccacaccuccccacucccugaacaaggauggcaguggcuuuguaaagcccuccagggucagugacagugucucuuaaauaauguuuauguaauagaaagucuuaagaugaccuauuauauuguuucaguaauauuuucaagauaaugcggaauugggcuggcuuagauaaauaagacuacauaaguuuuucacugauaaauuuaaauaguucuuuaaaaaauuauuucugcuuuaagaauuacuugaucauggauaucaggguuaauaguacuuaggagccgggcgugguggcccaugccuguaauacaagcuaaacaggaggcugagggaagcugaggcaggaggaucacuugagccuuggcguucaagaccagccugggcaaccaagcaagacccuaucucaaaaaaaaguacuuagagucucuuuuuuaaaaucugauggaaacuauggcuagaacuaaagaugucacauuaaaauuccaaaugacauuuaacagcuaauauuacucaguucuuugaauuccauuagcauaguguuugagagucuauaaaacuauuauuuuuacauaaauuaccuuuuaccauuuuaacagcucauuguagcauuauuuuuauuuuaaauguuagagacuccuauucaaguauguugugacuuuauccaaggucaaauauuguauaacaauguaaagaacuuaagucuucuauuuuauucuaauucuauaaaacuauaaugccuuuuauuacauacauacaaaauaauauauaacagagguaauuugaaaaacaguguaagucacugacaaauuauucaaaaaaugaaaaggcaauccuacuugguuguggauuuuuaucuacaauauaagaaugcuuuaaaaaauaccuggugacuaagcaaauggagaagcagcaguuuucauaaugacauucauaaacgacuuuuuaaagaucgucuuauuaaucauaugaacacauuuaaguagaacaguguuagauugagauguuuuucugaauuaaauaagaaauaaagaacuaaaguuuauuucauuccucuuguaguauaucuaaucuaugacugaccuauuggcuuuaguggucuuugaaauuauucacugcucugauauggccugaauugugcuguuuaaggaauuuaaaauuaaauauucauaaauguuuuaugaacugaauuuaagcuauugaaguuuuuguuuuuuguguuuuuuuuucuuuuuuuuuuuuuuuuuuugagacagggucucacuuugucaacccaggcuggcgugcaguagcaaacauggcucacuugcagcuucaaccucgcaggcucaagugaugcucccacuucagcccuccagguagcagggacuacaggcacauaccaccgugcacagcuaauuuuuauauuuuuuguagagaugggguuucaccauguugcccaggguggucucgaacucgugagcucaaaugauccucccaccucagccucccaaagugcugggauuuacaggugugagccaccaugaaguuuuuccauuugcauuaauugcucuguagauuuuaccauuuuugucuguuuuauaaacuguuacucauuuuaugaaauuuaaccaaucuuuuauacuuguauauguuuaaaugaucuuuuauacuuguauauguuuaaauguucucuucaauuuugaucucccuucucccccuuuucuuguauuagaaucugaaaccuaccuaugcagcacauaaaaugggauagaguauuaugguucagaaaagauggguaauaguuuaggaaauauauucacuacauauuuauuaggauaccuucuaaauaucaucuuugaaaaaugcuggagucaaauaagacacguaaacuaaucucuaagaaaacucaugguagaauuaugugaaauuucauuacaaguuaaacacugcuuuggcuacuccuaggauauuuaaagauuuauauaaucuaagauauccucuaauuuagaagaauaugguggauugcuguuugaaacacugcuuuuucauaaaaucugcuuagagucacagagaauuuuugaaaacuaaauuacuuuugaaguacuaaguaucuugaauguacaaugagaacauuaggugaauagguauguucucaaaaguugacuuuguaaaucaaaucauacaucaucaguugauacaagguaagccuucuccccuuuauucucacacccugcacccacucuucuuguguguuuaauaugcauaaauucuugagaaauagcaucauuuugugagucuguuuuuuacaguuaaugagauuuuuaaaaaaauuuuauugugauaaauauacauaaaauuuaccaucuuaagcacuuuuaauuguacaguucuguggcauuaaguucauucacauuguugugcaaccaucaccaccacccaucucuagaaauuuuuaaucuucccuaauuaaaacucugugcacauuaaacacuaacaugccauuuuccccuccccccaacccuuggcaaccaccacuccacuuuuugucucaaagaauuugacuauucugggaaccucuaauaagaaaaaccauuuaauauuuauucuuuugcaccuggcuuauuucacuuagcauaaugucucgaagguucauccauacuguagccaugugucagaauuucuuuccuuuuuaggucuaaaugauguuccauugcauguauaugccacauuuuguucauucaucugucaguggacacuucagguuguuuccaccuuuugucuaucaugaauaaugcuacuaugaacgugggugugcaagugucugcuuggguuuuacuuuuuuuguguguacucaaaccuguguuuuuaauuuacauaauuuuugaacauuauuaacucaauacuguuuuuaagaucuauccauuuuacuuuauguccaucuaguuugugaugcuaacucugcucuauaguauucuauaguaccuaucacuguuccuccagugaaggccguaaguuuucuccaaaucccguuaaccacaaacaccuuuaugauauacauucuuauacauaucuccuuggacuauguuauuuauguauuucuguauaacaaauuguaccaaaacuuaguggcuuaaacaguuucuguggggcaagaauucaggaaugucuuaguuggauggucugacugaggcaggaucucuuaugaaguagcagucacgaugucagucacagauacagucaucugaagggcuugacuagacugacggaucuucuuccaagauggcuaacucacauagucucaguuuuucauuggcuauuggcaagagaccucaguuccuugucacgugggccucuccauggggcugcuugaaugucuucaugacauagcagcuggcuucccucaaugauucuaacagaaaggccauuuaugaccuagacucagaagccacacaccauugcuucugcuguauucucuuuauuagauaugagucacuaaguccagcccaccaaagagaggaauuaggauccaccucuuaaaggaguagggucaaagaauuuaugauauauuuuaagaucauuacaucgaccagugaaacaguuucacuggauuuaucccuaggagagggaucacuggauaauaagggcauuguuuccuauugcuguuguaacaaauuaacacaaacuuagugguuuaagagaacacaaauguauuaucuugcaguccuggagaucagacacgguuuucacuggaccaaaaucaagauaucaguggcucugcgucuccucuagagauucuauugaagaauccauuuucuugcuuuucuucagcuucuugcauuccuugucucauggccucuuucuccaucuucagugccagcagcauucuaaaucucucucugaaucugacccucugcugcucuugucacauauucuucucugacccuucugccuccuucuuaaaagaaccuuugugauuacauuggguccacccagauaauccaggaaaaucagcuucaagaucuuuaacuuaaucacaucugcaaaguuccuuuagccacauaagguaacacauucauaaguuuuggggacuaggauuuggccaucuuuguggggccauacacaggcauacucaucugguucuccauuuuuuuuaagcugaaggauuuuuuuaguuauuuuuacuuuugcgaauguguguuacuuucuuuugguaauuucagauuuucauuuaccaaguuuauuuaaagcauaguauaauauauaaugaucaccaagaugguaagcagauauucauuguucaauuagauucuugauuuuaucaucacuuaauuuauaucaguguaucagcuacuucugacauagucuguaauagaaacugagaaacguuaaagcaacacagccuuauuaaauuucucuuuguaucuuuuagacucguuauaacaccaguucugugggcgcuuuguugaaacuugaucugucauugucuuaccagucauugaacuuagggccacucuaauccaguaugaccucaucucaaacuugauccauuuaugaagacucuguccucaaauaaggucacauuugacaugacauuuuuugguguuuuuuuguuuguugguuuuuuucccucuguugcgcaggcuagaguagcuucugggcucaagcaguccucccaacugagccucccaaguagcuaggauuacaaacaugugccaccacagcugacuaauuuuuaauuuuuuuuucauaaggagagagucucacuauauugcacaggcuggucucgaacuccugucuacaagugauccucccaccucagccucccagagugcugggauuacaggugugagccacugugcucacaccuguaacauaucuuuuuaugaaacacaguucaacccauaacacucccuuaauacuugguaccuugugaauaauaagauaccuaaauaugguaccuuguggauaacaaggcauauugucuuacuuuuuuuauggaaaagucaucuuggacauucucugaacuugugcccucucuuucuguugucugcccucuguggcugauaaugcacccuuucuguucauucuuacguguauauuugucuuuuauauggcugucgcugaguaaagcauuuugggaauuacaaaagcuaaguauuagauauagaccuugucuucaagauauuuaugcuccagcugggaagacaaaacaccccaagguaaaauggaauaauuugagaaguuaggccaaauuguauaguauuuacuguucagccagcaggaagauucauuauuggcuagagacaucaggaagguuuuguguaagaaacugagcugggccuuaaaggaugaggauauauuauaacagcagaggaaaaaaggaugugguauucagaaaggggaggagguauaaacaaaaauauaaagguaagaaauaguuuguagaggaaagugaggagagacuuacuugaggaagguuaucuuggaacuuaauaggaaauaaguuuugaagguagacuauuaucagauauaauagauugugaacaccagacagaaguuauacagucuuugagagcaugagcauuaaaaacaaguacagauuugaauucuggcauaggcucuugauauguguucuuagggaaguuaucuacuguuuuggaguuccauuuuucuuaacucaaaaaugaguaacaccuaccucauaggugguugugaggauuaaaugaguuaauauauagaaagcauuuacauuacgugagauauuguaaguacuaaauagauaucaggcuuucugaauuucacauaucaaauacauaaaaaauaagggcauauauaggauuuaaauaauaugcuggucaguuauagaacuuuauauacuuuuccuuuuaaaacauuuuuaguaaaauuuuuaugaaaauuagucaaggcaaaccuuuaaaaauuuucagaugguaacaauuuuauaagcaauagucuuccauuaaucuaauaagcaauguaucaaugacaauaaaaagaugacucaaaaagccuuauauaccuaacaauugagacagaucuuugaaguauccccuagaucaaagaggaaaucaagauggaagucaugaguuaucuggaaauaaagaggggaacacuucauacuaaaacuuguggaauguagauaaggcuguacuaagagaaaaauugauguccuuaaaauuuauauuauuaaggaugaaacgaauaagugaauguuuaaguaaaguaaggaaauaaaugaauuaauauucacuuuauuauuauuauuauuauuauuauuauuuuuugagacggagucucacucugucgccgaggcuggagugcaguguugcaaucucggcucacagcaaccuccaccucaagcgauucuccugucuuagcgacccccccaccccacaccauagcugggacuacaggcgggugccaccacgcccagcuaauuuuuguauuguuaguagagacaggauuucaccauguuggccaggcuggucucaaacuccugaccuugaccugccucgcaaaguauggggauuacacgcgugagccaccacgccagccuuucacuuuaaauaacuauuaaaaauaacaaaguaaaccaaaggaaaauaagaggauauaauuaguaaagauaaagaaauugauaaaauagaaaauaaaguaguggaaaguauguguugauguuuuuguuuguuuugguaaacaccaauaaaauaaaugaaacccuaaaaaguuuaaaggaauaaaaggcaaacagaacaucagugagaaaagauaccuucagauaaagaauuuuuaaaugacagaauauauacaacucugacaauacauuugaaaaacuagaggaaagaaauaguuuacuagugaacuauuaaugaauaaaauuaauacaagauggagaaagcauuaaaagaguaaaucacagaagaaacuuuaaaauacuuuaaaaaaaucuuagcucuaaaauggcaccucuuuugaguauccgucacuuugauaagaaaaaagaaaaaaggcaccuucugauuugaauucuagcugacuuucaaagaauagacacuauucaaacuauuccagaccauauaaaaagaugagauagcauaagcuuaauugaaaaccuuauuucaaaauacuauaaaaauuuaaaacuauacauuuucucuuuaaaaauucuaagugaaauauggaaaaaucaacaggcucguaaaagcauaaaacaugaacaacugggguuuauuucaggaauggaggauaggucaacauucaaaaaucuuauaacugacugcaucaagaaauuaaaagagaaacgauaugauuauacaaaaaagugcuauuuacguucagcaaccacuacuaacaaaaacuuuaaacucaaaggaaaaugccuaaacauguuuaaaaaauuuacugaaaucugaguaagaauauuaaauagugaaauaauaugccauucuuauuaaaaucgagaauaagauaguuuauucgacauuuuaaaguuucaagcuaacaauaaaacgugaaaaagaagugagguacaaaugcaggaaagaagagucacaaguaucaucacuuacagauuauaugauugcauacccagaaaauccacuggaaacccuauuggaauucauagaaucauuugauaagguggccacacaaggguuaugaguuaaauagaauuaguagcuuuuauauauacuagcaauauuuguuuuucuuucuuucuuuuauuaagagaaggggucacacugcauuacccaagcuggucucacucaagugauccuccagccccagccuuccaaagugcuuggauuacaggcaugagccaccacaccuggccauuagcaguauucgaugugggguggugguggucauucacagcaacucaaauagccaaaagccuagggauaaauuugaugugaaagauacagaggcauaggaccuuuuucuugaggggggaaaacccuggaaaauuugauugcagaggcuaaauuauucaugagauauaguaagacuuaguauggaaaugugagccucucucaaauuaauauaaauauaguuacaguucuaaguaugagaauugagcuauaagaaauacguuuccauucaguggaaaagaaaugguuuguuuaauagugcugauguaauugcacuguuuauuacuacuuucaguuauccauaugaaacacaauaaaguuagaccacuacacucaugccauacacagcaauaaaaaugccuuaugaauuaaagaucuaaauguaaaguaaaauuucuuauucaagcuagugaauuaaucucccaaauuuaucaccucuuucgccuaagaccccauuaaagugauaguaaaaacaaaauaaagaugggagcuuacaaugccauaaagaguaagagacauucaaauugacauuguaacaaguuucuggaagaugaagaaaucgugggaauuaaaauggaucacugaaaagaaaucaaggauucuaagacuuccuaguucucuguucuuuccaacauggcagguuggaaauuuaguauuuaaaaguaaaauacuaauuuuaguauuaggaauuucucaauggccuuugaaauuauuuggguuaccuugggguguuugaaaacccaaauuaggaaauuaugcuuuagaccaccuguuuuuguaaauuaaguuuuauuagagcaugggcaugcccaucuauuuauguguuuggggcugcuuuugugcuacagcuacaaagucaaguaguugcaacagaaaucauacgacccacaaagccuuauaauauuuauuaucuggcccuuacagaaaaugcuugccaacccccgcuccuggucguugggaugggcaucuugagaccugcccacacgugguaugggcuuggauaggucuagccaguguuauguagcuauuuacagaauguaagcaaaggaaaguguggggaaagaauauggcaaacagaaaacugaauaucaccaccuaauggggccuuaguagggaagagaaagagaaauagaaaaggguuguuaaagagaaaauuaaaauggaugaggugaauucugcuuggaauuuaaaacuuuuugguauauuauugauuuuguaucuggcaagccuaaaauuuuuauauuucuaagauguuucuauuuuguuucuuuccaaugauaacacuuucucuuuuuuaaauuuuacugugugaauuaggacuuccaggauuauguugacuggaaguguggauaguagacaucuuauuccugauuuuaaagagaaugucuguaacauuucacuaugaagaaugaaguuuauagcuggguguggagcgccuguaaucccagcaguuugggagguggaggcgggcggaucacuugaggucaggaguuugagaccagccuggccaacagguaaaaccccaucucuguaaucccagcuacucgggaggcugagggaugagaauugcuugaaccugggagguuacagugagcccagaucaugccacugcacuccagccugggcaacagagcaagacuccaucuauuuaaaaaacaaaaaaaagaaugagguuuacaaaauuagcugggcauguuggcuugugucuguagucccaguuacucuagaggcugaagcaggaggguuacuugagacuugagccagggaggucaaggcugcgguaagccuaggugacagaguaaaacccugucucagaaaaaaagaaugaaguuugcuuuagcucugacaguuucccuccuauuuccagguuuuuauggaaaguuuuuucuuugucuaagaugguuuuucuuuaguauuuuaauguagcgagugacacauauaaaugaucuuauauugcacucuacucgcauuccuggaauaaacucagcuuuguucugcuguaguuucuuuacuguauguuauuguauucugcuuccugauaaucucguuuagauuuuucaaaucaacauuuguaaauauuagcuuaugauuauucuuuuucacacaaucuuugaccuguaugucaugguuagauuggcuucauggaaugcauuggaaaauauuugcuauuuuuccauccuuagaagcauuuguauaagauuggaaugauuuguuccuuaaaaguuugguagaagguguuuguaaaaccauucagauacgguauuuugaaggauuuggaggaggaggggaaagauauuaauacuuacugcuccaauuuuuuuuuuuuuuuuuuuuuuugauauggagucuugcucugucacccaggcuggagugcaguggcaugaucuuggcuuacugcaacaaccuccaccucccguguucaagcgauucaccugccucagccuccggaggcgcugggacuacaggcacaugccaccaugcccggcuaauuuuuguauuuuuaguagaggcgggguuucaccauguuggccagauggucucgaucuccugaccucgugauccacccgccuuggccucccaaagugcugggauuacaggcaugagccaccacgccugguccaauuuuuuaauaguuguagaacuauuaagguuuuucuguugcuucuugaaucaauucccccucccuagaaucuuuaauauguuuggagguuguuuucuuuuuccugucucuaaucauacuuaguuguuuuuuuuuuuuuaaauccaacuuuuggaugguuuucuuuuucucuuuuuuuuuuuguuuuuuuuuuuugagauggagucuugcucugucucccuggcuggagugcaguggcgcgaucucggcucacugcauccuccaccucccagguucaagcuagucucucaccucagccucccaaguagcugagauuacaggcauaugccaccacgccuggcuaauuuuuguauuuuuaguagagaucggguuucaccauguuggccagacuggucuugaacuccugaccucaagugauccgcccgcuucagccucccaaagugcugggauuacaagcaugagccaccgccaccuggccaaugcuuugcuuuucaaacucuucaaaggguauguaauaaaaaggaaggcuuaccaccagacaccauaccuugauucuauaagcagugacuguauuuuuguauguucuuuaagugauauuuuuuauccuuaugcacuccuuuauuuuuacuggaagaggagggaccacaugaggcauuagugaugagcauucuuuuuuuuuuucuuggcuuuugccuguuuuuuauguuuguuuguuuuguuuuucaucaaccucauuuuuacaucagccucauucuucuuaauaccaauguaguauuucacuguacagaugugcauuauuuauuuuaacguaguugugcuuuuauagcaaauagaaacuuucccauuuguuugaaguacccuaagaaucuccuuuauuacuccuagucuaguaacggacaucauuacuuuagagaacucuacuuggcccucugugugucuuacacccauuaaacaaauuaaaauuaaaauguuccauaccauccuuugaagaggguguacaccauuuaaauaucuuuacuuaaaaaaauaaaagucugcucucauaagcaaugaaauguuuuucaaacauuuaaaucucuguuccuuuuugcaaguuauccuaguguguuguaugaggaauagaugcaguuuuuucuuuuuccucauggcuguccuauuucccagcaccacuuuaaauuccaucuuuuuacaaguauugagaugcuacuuuaaucauauacugaauuuauauauauuuacuucuggauuuuaaacauuguguucucgugguugaucuauucauguacugguauuguagcuuuuuaaaaaacuuuuaauuuuaaauaacuuuggacuuacagaagaguuggaaaaauaguacagagaguuucuauauaccuuuuacagauuccccagaugauuaacaucuuauauaucuguacuacaauuaucaaaacaaaaaaacuaaucuauugguacaauauaguuaacuacauuuauaugguuuuaauuauaaaggcuuuguacaauauuuuaauauguuguugguuuacucccugcucuucuuucauauuuucaauuuuuuaaaugucuagcugcagaaaauaaacaaaagcuuuauauaguauuuuuacugggacuguaaaauuuauaaguuagcuuagggagaaauggcauuuuuauguugcugaaucuugguauaccagaauaagaaacgucuuuccauuuguugaagucuacuuuucuaucuuucucauauauguuuuggacucuuuuuguaguuuaugcccagauauuugcauuuuuuauuguaaaugggaucuuuucuuucauuuaucuucugucugguuucucuccccuauaaaugaaugauuucuguauauuuuguacuauacuguauugccaaauuauauuauuauaauaauauuucaucgaugcuuuuguauauuccagguauauaauuguguuaucugugaauaauguucccuuucuaauuuuuuucuaauuuuauucauuaauuuguguugacuaauauuaugacuaauagaaugguacccugacuguaggacuauauccaguguuuccacauuaaguaugcuguuggccuugggguugauagaucauguuaaagaaauguucuuuuuuauucaguauuuucaacaagaauggguauuaaauuuguaaagugucuuuuccucaucuuuggcaugaacauaugauuuuuucccauaucuauuauguuaaaugauauaauuaauuuucuaauagugacuuuuucauuguaaauuauauuuuucaucucuuuugggaucaguucugauagauuauaucuucuaguaaauuauuuuggguuuucaaauuuguuugcauagaguugagcagagucaucuuuuaugauucuuuugcuuuccugccuucuuauucauauuuuccucauuucaucuaaaaaugcuggaaaauauaucuuuguuuuuccaugaaaacaaaacaauaaaagcagcuccauuaauguaaaaaagaagugaucucaaacuucugaaaauaauaauccuccacauuuaauucugauuaucuuuugccagccugaaauuuuuugcuuccuugcuuuaauuucuuacauuacuuguaaauuuauuuucuaaugaacauuugaauaaaagucuagauaauaguccuugugcuuucuucuccccuaccccacacuuacaaggugcagcagugucuuuaguggucaucuuaacugcagaaaaacaaauugagagguuugcaugcucucaguaaagugaaagauugggagguuuuccccauuucaugguguguggcagcuguaaugugaucacacaaguuucaaauuugaaaaauguuuuaaagauauauuugguaugcaauucguguaauugcaaaaaaggcauuccaaaguaaauuuaugacuucacaaauuuuguaugacuucacaaguuuuggauuagggagguauggcugcagcauccuaaaacaauauaagguuggguauucuuccaugaaacuuguuauuuuuuccauaaaguuagauucuuucuagagcagaaagaacuuuaaugauugggaaucuggaguuaagggaaaaaaagaugauuaaaaguuuaauuguucaucugaagaguugauuuuuuuauuccuguaauaaaggguacuuuuagcagucucugcucaucuugcccauccggcucuuuuugugguuguguaagguuauaacuucugugucucaguaaacuugugcaugcccauuuuuuucucuguuacuaccuuuucucuuauuuuguuuuauuauuuugauguaaaauuaccuguuaauuuuauuugaaaugagaaauuuuaagguucacauuauucaaauucugucagaucccuaccucugucauaugguuuauaaugugcuggguauuuucagaccugcuuauuaaaaagauguaaaacaaaauaaugaucacuccuguggauuuuuccuuuauuuuugagaugucuccuuuggcugcauuacuucuucaccccuugcccauugaucagaggaggggucuuaacuaugggugaacccuauaucuuacugaagagguuauguuacauguauauuuucauaauauaacuuacauuuacauaguacuuuuauuuuuagcauaccuuuuuuuauuaauccuaauaauaucacuguaaguuauguugaagcagauuguaaguguucauuuacaaauugugaaaugaauuaaaaugaaagggcaaagauuaaaucaugaccaggccugaaauuaacacacaagacucaauuuuuuucaaccaaagacuuuuguaggugaucccugccugcaggacuccccuuccuccucagaugucauuggauuguaccagguuuacuguagauucuagccguuguagaacuaacuagaucuaagaugaguccccugauuuccuuugguagagucuuccaauugcugaacuccaauauugucgugacuagccaguguuacaaccugucugccuuauuuuguguaauggauuucauauuacagaggcauuuuuuuaaugucaagauguuuaaguauugcuuaagugcaaacuacuuaauacuuuuuagcuauuaaguaauuaagauaggcaggauuuuauuuguuccaaaaugauuugaccuaaacuaaaaagagaauguggaucuccugaaucuuacuugguuaaucuuaauauaacuccuagcauucuauaauucuuccuaaaguccucuuaccuggcuaucuuuuguaucuucuuugucucuccucuucuuucccagucauaauaacugccagacucugcuucauuucucuuugacagucucuacuccuaaggucauccauucucuuuagguaucuuuuggccucaguuugagcacagcagaucccaagaccacauaugccauagcauaggcuauuauagucaaccuuuugaauaaaugugauugaacuuuauguuaguaauucuuauuuaccaucuuccuaucaaaaaggcuuaaagucuucauuuaaugcucuccuucauguccauuuuguuaaaugauugccuuuuaaugacaucuuagaacuucagaacuauuucaccauggaggauguguaagauuagccuuuuaucaaauaaaaagugugaaauggaauauguaaucucauuaauccauucuggcucuaaaauucugugacuaucagauaaaauucagaaauaaaauaguauuacuaauauaaauaaauuuuuaucauaauuauauuuccuaaguuuugccuguaagaauggguaaaauaucuuuaaaaccuugaagaaauuauuacuugauagaaaguuuaauccaucugugagaaggcaaauguauucagacacaacuaaaguucucucuucuauuuuaauuucauuuaucuugaacuaagacuccacuguuucauccucuuagaugcugcuacuugaacaauauuguuuugagaccaaaaacuagcauauuaacacaauucuucuuaaacgucuuaagaguuuuguuuccuuuaccccuuucuuuaaaaacaagcagccacuaaauuuuuuaguagugaauuucaaaauccuuuuuaaccuuauagguccaaggguagccaaggauggcugcagcuucauaugaucaguuguuaaagcaaguugaggcacugaagauggagaacucaaaucuucgacaagagcuagaagauaauuccaaucaucuuacaaaacuggaaacugaggcaucuaauaugaagguaucaagacugugacuuuuaauuguaguuuauccauuuuuauucaguauucccucuuguaaacuugagguaagacacuuuacuuaaaaguguauuuuaaauuaagcaauaauauguaaacucuuucuugcaaaaguuagcauuuauauuuuuaaauaagauauauugaauucauucagugaaucauauaaagaaaauaaguguaaaacuccaauggcuaguuaguucuuaguucuuuuuaagauuaaagagaagagaccaaauauagcaucacuguacugaggcaagguuuucuguguaguucauagaaacuagccucaugauuuuagaauaugccuugaauauuaaguguagccuuccuccccaacucccucagaucuugccaccccuuaagugcugcagugauaggugaucaagaaaaucaggauacccuacugggaagagccaugaacugaaagucaguaccugguucuaucccuggcuuucccacaaacugagcuauaugaccucuguauauucuucagaacuuaaguugucuuauuuggcaaguacaggcaucacacuagucuagaugauuuccauggcaccuucaagcccuaaaauuggcuugccaaauaguacugaaaaguucugaucaccuccaagacagguuagaaaaucgucuauaguggggaaaauguucugguuucaaaauaauugagguuaaaacuuuagccauuuuaauucccacuuaggcagauucucuucugacugaauuuaauaacuucauagaauuggacauuaucaacaaaaauauuacuuccaccgggugugauggcucaggccuguaaucccagcucuuagugaggcagaggcaggaggauagcuugagccaaggagcucgagaccugccugggcaauauagcaagaccccauucucaaaaaaaaaaaaaaauuacuuccuuuauaaaaaaaaaaaucuuccugcuuuguguuguuucucccucuuggcuauuuuaacauuugaguuccugguccaguucuuccugucuguucacuacucuuauuccuuacuaauuuccuauucuauccuaguuuuuuuccuaugcauuucaagguuucccuuauucuccagacuuuugugugucacugagguaacuguuucugcuucucuuuuacccuuuauauucaguaucaucacagcucaaccuuugcucauguguccuauucucuuuuuccaucccucuaucaaucuuuucuacucuaauuagccucuucugugguaaaacuguccccagcaaugacagacauccaauauaccuacuucaaaucccuugggaaauaagguagacuauaaacaaacauuuuauucuuuccacaaacuaugggugaccuaaaaagacuugcauuaguugccuaacagguuaaaaaagaguaguuugguauuuuaacauugaucaacacauuacauuucaaaucauuauacuuggcauguguuuuuaaaaguuuuaaaauacagaauuaaaauauucuuucaucuacuuuaguaugguauauuucgcagagaacuccuccuggcaggccuguuuagauaguacaugucuguuuuguaguguagaacucugagaucucuuuuuuaaaguuuguuuaauuccuuaagcaauucaaaacucauauuugagagacaauguaacuuacccuuagauccaucuccacacugaaguggaaugucucucagagugacaauagaagucacacccucaaauuucuacaguggaauaucuaguugaucauuuauaugugugguauaauacaaguugaguaucccuuacccaaaauugcuucaggccagaaguguuuuggauuuuauauuuuuucagauuuuuaaauacuuguauuauacuucuugagcauuccuaauucgaaaauccaaaaucugaaaugcuccauugagcauuucguuugagugucauguuggugcucagaaagcucaagacuuuggagcauuucagacuucaaauuuucggauuuagaaugcucaaccuauauacaucaggaauaguggcacuucagauauaccugaaaccaaccauaaauuuuauuuuacucagcaugugcuucaacagacaucuugugaauccauuaacauauuuccuuagaauuggacaugugguaccauaacaauuacagcccuguaaugaaauuauaucucuuuuuaagguuuuaugcugugaaagagcauaaaccaugagcuauuuauuuugucuuagaauauuguuuuguguagacacuuuugaaaccauuggcacuuccuacuguggauuaaaauuaauccacacaaugguuauuucucccaaaaucacuugcuagacuuuguaauaccuuauauaaacucgaaucacguuuccuguucauuaaucucuuuacccccaaaaaaggcaaaaggaggcugggcaccguggcucauaccuauaauccuagcacuuucggaggccaagcagaaagauuguuugagcucaggaauuugagaccagccugggcaacauggcaagacucuguuucugcaaaaaaauacaaaaauuagccagguguggcguauaucuguggucccagcuacuuggaaggcugaggugggaagauuguacuccagccugggcaaaagagccagaccuggucugucugaaaaacaaaaacaaaaacaaaacaaaaaacagcaaaaaguaggucuccuccaaccggauuacuuaaagucuaaaauuuauguaguaguaccaucuaguggcaaaagaggacacugcuuugcuauuugauuauaugugucuuuguagcagccagggaaauaaguguuuauggguuagggaaaugugaacacuguauauuaaggaaauauuuauuuuuaaguauaaugauauuauuguguuuguguuuagaaagaauccuuguuuaaauauacauauugaaauauuuacaaagaaguuguaugaugccugagcuuuauuuuaaaaauaagucugaggcagagggguggaaauagaggaaguggauauggguguagaugagauaaaacugaccaugaauugauaauuauugaugugggauaugaagguacauggggcuuuguuauaauuuucugcauacuuagguauauguuugaaauuuuuuguaaugaaaauaaaauagagauuacauggaauuuagaugauaugaaaucagauaaaugcagaauuauagcuaaucuuaaaaaaaguuguguaguguauuuuuuacuccauggcuagagcccuccccccaacuuguuuuuuuuguuuguuuguuuuuuguuuuuuguuuuuuguuuugagacgaagucucacacugucgccugggcucuggugugcaguggggcaaucucggcuugcugcagccuccgccucccggguucaagcgguucuccugccucagcuucccaaguagcugggacuacgggugugcaccaccacgcccggcuaauuuuuauauuuuuaguacagacgggguuucacuauguuggcuaggcuggucucgaacuccugaccucgugauccaccgccucggccucccaaagugcugggauuacaggcaugagccaccacgccuggcccccuccccacaacuuuuuuuuagauggaguuucguucuugucgcccaggcuggagugcaguggcacaauuuuggcucacugcagccuccaccuccugggcucccagaguagcugggauuacaggucccuaccgccacgcccggcuaauuuuuguauuuuaguagagacggaguuuugccauguuugccaggcuggucucaaacuccugaccucaggugauccacccgccucggccucucaaaguacuggaauuacaggcaugagucaccgcacccagccuaccuagagcucuuuaauugacuuuaaaauacugaguauagcaacaagguaaauauggcauuuuagagauaaaaagcugaaagauggcaugguguaggaagaauuaucuauaggcaaguuauugaagcauuuacaucuuuguuguaguuugacaaaauuuaauauuuauaaauuggucuauaaacuguaaaacaauauacauguaaaguauaucuuuucagaaaguaaggaaaaaccgagaucaacauuucagaauguauuuugaagauguaauuaucaaguguacuuauaucugguaaugaaaagcaucuuuaauuaugauauacugaaauaaauaaaagugggucaaguagcagccucccugaaaugacaaaguugcucauagauaaauaucacugguauaaccacagcagauuucauuucuaaugaauaauuuucuuucuuucuuucuuucuuuuuuuuuuuuuuuuuuuugagaccgagucuugcucugucaccaggcuggagugcagugacaugaucuuggcugucugcaaccuccgccucccggguucaagcuaaucuccugccucagccucccgaguagcugggacuacaggcgugcaccaccacgcccagcuaauuuuuguauuuuuaguagagaugggguuucgccauguuagccaggauguucucaauuucuugaccuugugauccuccugccucggccuccaaagugcugggauuacaggcgugagccaccgugcccagccuaaugaauaauuuucuaauguuucuaaaauguuaaaauacuucuaagacaaugugugauuauauaguguaauuaaucuuuuaaaacugagcuuccagaauuuuaaaauacaaaugaauauucucuccuucaaaauuacauauguauuuaaaagcugccacuucucaaagaacuuuuugaaacauuuuuuuuuggaacugcuuugcaauuguauuccauuuucuuuuaaaaacucuucaaaaucaagggccucuucuagguuguaugcaguaugcagcccccaagaaaucugucccacucaaaaacuagaaaacacuggauaaaauacaaaaaucauacuuuuaaggacacuggaggacuguggaaucaucaagcucuuuauuaacuauaauucuuaggaagaaagaacccuuucuagauaagcugagauuacugguaauuuucuuccugggguauauugauucuggguacagauugagauucaucauuggcacaagcaggaggacuucacugggagaaagaaacucuugaggacuuucugcaggacuagguaugaaagaaaaugaaaucguuggcagccuugacaaacaugagggcagauguagagauacuagcauuuagaggagcucuaaaugcauggcucauuuuuaccaugagauauuggccgagucuuguagugcaggagacuugggauagacuagaaacgcagaauguuagcaggcgaaguccugcuagagggagagacauguuacuuucauaccacaggucuccucaagucauuugccagauuuuaaauuuuguagagcaggagauuaaagaccugaguuuacaaccuccaagagaaacaacauuuaaggcuagagaguuaagugcuaccagagaauaaggcugaacuggaaaggcaaagugaaauaucccauauuccugcaauguuuaggaaagaccuauuagagggagaccuaccuaguauaucaaacaugacugguuuuccauucaagauaaaugucagauuuugauacuguauaggguaagaaguuaacugcugaggagauggagaacuuucauauuuucuaucugaauauagagagacacacucaaggaacugggaaaaccaaaccaguuaguugugaacuuaaaauugcaacuaggucucaauccauuuuuuuuuuuuuucaagacagagucucgcucugucgcccagucuggagugcaguggcacagucuuggcucacuacaagcuccaccucccagguucacaccauucuucugccucagccucccaaguagcugggacuacaggcaccugccaccaugccuggcuaauuuuuuguauuuuuaguagagacgggguuucacuguguuagccaggauggucuugaucuccugaccucgugauccaccugacucggccucccaaagugcugagauuacaggugugagccaccacccccagcgggucccaauccauuuuuaguugcuaauuggauugaggagaucagaccccaacaauggaaaaggcagacucucuagaggaaaauacuaucaaucaucuuaagucucuuuuguucuuguauacacaguuggcauacagucaaacguuauaugaaaugcagagaaacuggaagauuacugauaaucaagggaacaaauagguaauaggagcaaacucagaugauccacauguugcaguuaguagucaaggauuuuaacauaaguauuauaaaugucuugaaaaaaagaaaaaugaacagauagaaaauuuugacagagaauuggagucuauaauuaaaaggaaucaaauagauauucuagaacugaaaaauauauuugaaauuaacauuggaugggcuuaacagcaggcugaacacugaauuagugaacuagugagaagacagaauuagugaacuugaaaaaagaucaguagaaaauauucaaacugaagcacagagaaaaaaauggaaaaaacaaaaaagacaaaacaauggcuucuagaagaaaacauagguaauagcuucuuguccugggaguaggcaaagaugucuuaaacagaaugccaaagcaccauauauagaaagaaauuugauagaccucauuaaaacuaagaacucuuguucaucaaaagacucgagugugcuucuagaagaaaacauaggauaaucuuaucuauguggccuugggugggcaaaauuucuuaggacacacaaaagacuaaacauaaaaauguauaagauaaacuucaucaaaauuaaaaaccugugcuuuucagaagacuucauuaagaaaaugaaaaaguaagccauagaggagaaaauauuugcaauacauauaucugaccaaaggcucaguucagaauauauuaaguaauuccuucagaauauauaaaucccacaaaccaguaacaaaaagacaauccaguuuuuaaaaugugacccagggacuugaaaagacaauucaaaaagaaagauaaauggcagauaaguccaugaaaagggauucagcaucauuuggcaucagggaaaugcaaagacuauuucacuccuacucaaaugacugauguuuaaaagacugaucacaccaaauguggagcauuggaaugcucaggcauugcugagagaaguauuaaaaaccauuuuggcaguuuccuuuaaaauuaaacccuaugacucaguguuugcacuccuagaaauguacucaagagaagugagggcaaguguccacuaaacgguacaagaauguucauagugacauucuaaauaauagccugcagacugguaacagcccagaugccccuuuaagaggagaaaggauagauaaauugggcuguauuuauacaguggacugcuacauacuauacaacauuuaaaaacaaugaacugauaaggcaacagcauggacagauuucacagauacuauguugaacaaaaaaagugagacacaaaauacuuauguacugugugauuccauuuauaugaaggucaagagcaugccaaacucuucugauaaagaagccagaauagugguuaccucuaggaaaugaagauugguaaaaggagcuugagggaacccucuggggugcuagaaauguauuuucaccuagauagugauuacaugggugugaaaauucacuggauauuuaggauuaguguauuuuacauauguguguugugccucaauaaaacaggaaaaaaauuacuugaggucaguuuuuauuguggaauagccauaaacuguucacagcaaacuaguaaauaauguaggucauauuggaugguaucaucuuaaggcaaaguaacuggaugugacuguaaauuuacacagauuuuguugaugagguucauaacucaaagcacuuacaaaaguaauuuaacacaucauuggaguaaguuaguagcuuuccaaggugacuacuuugggaaucuuuuuaaaaauuguuugaccuuaaaucuuauuuaccuuuaugcuuauagcuaucaauagauuucuaacaauguguacagaaauuuuuaaaaauagaacuuuauuacaaguugaguauauucacuauuuuauuaaauuaggaaguguggacaaaaaaaaucaaaaucaacuauuuuuuuuuaaauuuaaaucccaucaccagagguaaaaguaaccuuugauaguauauauauauauucuuuucucuauacauuuaugcaaacuugcauuugaugacaucauauuuugcagguuuuuuuuuucuguguaauuuauugucaucuuacgucagauuauguauuuuacaguugcauaguauuccauuguagguacagcuaaaaaaugcuaugguuuauuuaauacuuauuguuggacaucugaauuuauauggcuuuuuaauuucuuuuuuuaguauuuuaaguuuuuauuauuucuuuuuaaaaagaccauuaauguaccauuaguuuugaaaaaauuagauguauguccaaugauguacgaaggauuuuuuauuuuuaaacuuuuaaaucuuuguaacuuuucuaaaaacaaguaggauuuuuucuaauacauauuguuuaaaaaguaugacacaacaaguaaaaaagaaauugcuuguaauuucagucuccauagaauaacacuguuaacauuuuaaugauucugcuuucagcaucagcuucaccugagaacuuguucaaaaugcagauuuucagccucuaccccaggcuuacugaaucgacagucuauguuuuaacaaggucuucaggugauucugauccaugcugacgcuugagaacacuacuguaggcuuuggagaagaaucuuacaaagagagaccugaucggccgggcgcgguggcucacgccuguaaucccagcacuuugggaggcugacgcgggcggauggugaugucaggagaucgagaccauccuggcuaacacggugaaaccccgucucuacuauacuaaaaaaaaaaaaaaaaaauuagccgggcgugguggcgggagccuguagucccagcuacuggggaggcugaggcaggagaauggcgugaacuugggaggcggagcuuucagugagccgagauugcgccacugcucuccagccugggcgacagagcgagacuccgucucaaaaaaaaaaaaaaaaaagagaccugaucacagcugugccuuaaaaaggcugcucugacagcucugugcaagguugagccacuugggaaauuauuuucauaguuuagguaggguuaauaacaagauaguggcaguaagaauaugaaagagauagcuguaagagagcuaauagagguagaaucaccagaaauccauaacugggaaugugaaggaagaggugcuaaggauuugagcuggaggagaaagagaaggcuaaugccauuuaacugagagaauacaaggcaaagaauaggcuuuauugguacaaaauguuaguucaguucuggacauuuagauguaugguaccugucauacagauguaaagcauccaucaguugguuggaaaagugagucugaaguuugcaagugaaguuaggauucgagacaugucauuggaaauuaacugcucaaggguaguuguugaauugugagaccggaagccugagaaauaaggauaagauuaaaaaaggauuauugaaggacuaaaacaguagcaauggauggaaagagaauuggaauccuggaaaaaucacagguagucuccaaugagaguucuuaaauggaagagauggugcccugaaguuuauaguagacauuuugaugggcauauucaaauucaguaaaggaaguuaucacugagcaaauuuguuuucuauuccacaaauguaaaacacucuggaauauuuugaaaauaauacagucaccuucaugcccccacaucuacuuaccaaagccuuucaaacuccaacauagucuauuauuuugaaggucagauacuaaggcuauuuauuaaaaggaauucugggguuugggggcgauuucuuuguuucuguuuuuuuagcugaggucucacucugucccccaggcuggagugcaguggugagacuguggcucacugcagccucaaacuucugggcucaagugauucuccugccucagccucccaaguagcugggacuacaggcacaugccaccacucaugguuuuuguuuguuuguuuuuuuaauuuuguagggacagagucucgcuauguuguucaggcuggucucaaacuccuggacucaagugaccuuccugccuuagccucccaaagcguugagguuacaggcaugagccaccaugaaugcuuacaaugucacugucaagauaaaucagugaaaccgucuuugcuccagucacucacuuuuugacagguuuuccuuuuaauguauuuacagauuacuuuucuuauaggggaacguuccauuuaguuacaaaguugcaaauguucaaauauuuugucuugcauucaggaaaccugauuggccaaagaacuaugcuaggagcuagaauggaaugccucaguaaauggaaaauaauauaaauuauuauuaaguagcaugcaauaagagccaaaguucacaaauguaauggcagaaaaacugguagaaaaugaaaauuuccaacauucuuugagaaaaaaugaucaagaaagggauuacaugggaaagaagaaaagcaucaaaagucaagaaguagugaacauacagucauuugaauguaugcuaauuguaaauuaguauacuagcagaauauacuuaaaugugguauauaaaagcuugaauguugaaguuguuaaauagauuauguguuaauuugguguuuuuuauggucauguuggugcacgcuuaagagacauggauucuaaacacauaaguagcuuuuguaacuugagcaagucucugggucucacuuguuuuaucugaaaaaugagaauaauuugcauuguugguuuuuagguuugaaauaaugaauguaucuuaaauguguuucuaauaccuugcacagagacuccccauaaucaccauuaucucaaaauaucacuauuauuauuuggccaugauuuauuuauuaauaaugaauaauagguaauauauauaaggugcgugcuuugagagugaucugaauuuuuuucucagcauacuuaaaugucaagaaauacagaaucaugucuugaaguuauuuagaauuucauguuaauauauuguguucuuuuuaacaggaaguacuuaaacaacuacaaggaaguauugaagaugaagcuauggcuucuucuggacagauugauuuauuagagcgucuuaaagguagauuuuaaaaagguguuuuaaaauaauuuuuuaagcucaaauugucaucuuuagguguguagauccaaguacagcuucucucgauuuggguguugguaucaguuuucuugguauguuagccuuacccucaggauguaauuguuaaaguacaaauaaauaaaaaauguauuugugugucauuucuucaguuaaacauuuaacuggcuuugaaugaacuauuuuaaaucccucccuuaaauaauuuucggcucuuuguaaagcuuguugcuauucugccagucacuaaauagggcuuuaguauucuauaugccauagacuugagccuacuguuucauuggaagaaguauugucuucuucauucaggauagaaauacuuuaaccuuuucacauauauaaguugauuauaauucauuuuuagcaguuuuaaaaggauaucuuucucauucuguugcuugaaaauuccagugucagaacagagaaagugcuugauaauaauugaagccagacagagaaauuacuuuuggauucuaaaauauuauuuagaggaagucuaaggaaguacauuuuaucuaauuuuccuuuaacacacuccuuauuuuuacccugacccaaguggacuuuucagggaaaguccuaaauaauuuuuguuuucagucauguauauuugugguuaaaauguaaaccuaauauuucacuuuaaaauaauauaacauuaagaauauuuuagacugcuuaaagcaauuguuguauaaaaacuuguuucuauuuuauuuagagcuuaacuuagauagcaguaauuucccuggaguaaaacugcggucaaaaaugucccuccguucuuauggaagccgggaaggaucuguaucaagccguucuggagagugcaguccuguuccuauggguucauuuccaagaagaggguuuguaaauggaagcagagaaaguacuggauauuuagaagaacuugagaaagagagguaacuuuucuucauauaguaaacauugccuuguguacuccaguuuauuguuauuuuguaauauaauauuuaaauugugaauuuauaguaggugauagcuaacacuuagagcauuuugcauuuuuaaacucaaagauagcauguuauugauugcacuuacauuaaaucuaaaaauauaaacaaggccguuuccugggauucugaagaccuauuuugucacuuauuuuguuuuuuuguuuguuuuuugggguuuauuuugagacagggugucacugugucucccaggcuggaguguaguggcaugaucucggcucacugcaaccuccaccuccuggguucaagcgguucuugugccucagccacccaaguagcugaaacuauagacgccuaccaccacgccuggcuaauuuuuguauuuuugguagagacgggguuucuucauguuggccaagcugguuaucacuuaaauacuuugacuacucuguacauugaguaauacacauaauuauuauauuuauacguaguuaaaauguguaacuugccagauacuuuggcccacaccuguaaucccagcuacucuggaggcugaggcgguaggauugcuugaggccaggaguucaggacuagccugggugacauaguaagacucuuucuuuuuuuuuuuuuuuuugagaugcaguuucacuuuuguugcccaggcuggauugcaauggcacaaucucggcucacugcaaccucugccucccagguucaagcgauucuucugcuucagucucccaaguagcugggauuacaggcaugugccaccacgccuggcuaauuuuauauuuugaguagagacaguguuucaccauguuggucaggcuagucucaaacucaugaccuuaggugauuccccccugccucggccuucuaaagugcugggauuacaggcaugaggcacuacacuuggccaagacucugucucuuuaccaaaaaaaaaaaaagaaaaaaaguaguaacuggauuuuuauugaauuucugauuaucuauugaaguauauucaguaacuacuagauucaguaaaagaugacucuuuucauuauggaaggcccacuacaaguggccacaaaugaaauacuucuuuuuuuuuuuuuuuuuacuuuauaaauaauaauuguacauuucaugggguacauagugauguuucuacacauauaauuuauugcaaucagguuagcauaucugucaucucagacauuuauuauuucuucguguuaggaacauucacugucuaccaucuagcuauuugaaacuauguaauauuguuaacugugcucauccuaugguagcguagaacacagcccuguacaguagcguagaacacaguccuguacaguagcguagaacacaguccuguacaguagcguagaacacaguccuguacaguagcguagaacacaguccuguacaguagcguagaacacagucuuauacaguaguguagaacacaguccuauacaguaguguagaacacuagaacuuauuccuccuaucuagcuguaauuuuauauucuuuaacaaaucucucuuuaucucuucuuucccucuguguuuccuagccucuaguauuuacuuuuuacuucuguuaguaaaaaguaaauuuuucuuuuuuuucuucuuuuuuuuuuuuuuuuuuuugagauaagagucuuccugucgcccaggcuagagugcaguggcgcaaucuuggcuccugcaaccuccaccuccuagguucaagcaauucucaugucucagccucccggguagcugggauuacaggcacgccccaccgcguccggcuaauuuuuguauuuuuaguagagaugggauuucaccauguuggccaggcuggucucgaucuccugaccucaggugaucugccugccuuggccucccaaaguuuugggauuacaggcaugagccacugcgccuggccaacaaaacauuucuuaauguauaaguuuuaauaccugaaaaaaaauugcuugauguauggaaugaguucugauuuuucacagcuaguguauuaauucuucucuuccuaaaguuaacauuaucucacugcagauaccaaaauauagaucauuaucaggaacuucgucaaauguuuuauguccccuaaaagauuccuuaaugcacauauuaaggaauaucuuuauuaucuuuauauuucuaaaaguucuauuagacauucagaaaaugguaaaauauauaaaagcuucauauuaucucugugaccuugguuaagucauuaaauuuuuguaccauuuucuucuguaagauaaagauaugguucuacuuuguggcauuguugugaaaauugaauauuaguauauaggaaaugcccagcauaucucccugagaggcagaagaccuuuuauaacuuucucuccaguuucauauaugcccauuuauaaaaauagggauaauuaucuggacgagaaaugauguuucacugucuuuuauuucuuaaguuuacauaagucucuguuucauacauugauccuagacuauugaaacaccaucuugaaaaauaaggagugaacuuggguccauaaucuuccaucucuuuuuccccuuugagcucuauuaagaggcagagggcaugcauacuaaccuuuccuuacuugcuuucuuuuccuuacuuugcuuuauguaggcaaaguccugauuuuauuagcagagagagggaauuucagagaaaaauauuaauuuuugaaauaaguuuuacugcaaauacuaguaaaccuaacaaauacagcuguaagugguaaggaauacuuguaauaaaaauguucuuaguuucugucuugacauuauuucuugcuagucuuccagaguucuuugcaucuaaaucuaggaaaagcuuauuucucuguucaaagacuuaaaugcaaugauccccauguuuuauuuauuauauaauaccacuguaaguaacuuuaagcuaguauucugacuuuuaacuccaaguggaaaauacauuucuuuuuaaaaauauuuaaaggugcuuuagccuuuucuguuguuacuguagaaaagacgucuuguuuuuguuuucguuuuucucccaaaauauggcccaacuucuaauucaggcuuuauuacacucuauaaaaaguugcuuuaucuggagagaaagagguaucaacaugguguuguuagaagguucucaacucucacugaucauuaguaucacuaguuuagcuuuauaaagcaucauaaaugaaaaguaucaguauuccuuugcuauguucagucucauuucccaugagauaguuacuucuauaacucuaaauaauauguuuauauugcuaguauuggacaugacuuacugacucaccacucugaaagaugaagauuuguuaaauucacucaauuauccauccaguuuuuaauucuguaccaauucuuuggucgaauuuguauacauauacacauaagcaaauacacauacauauauauaaguucuauuucuuguucuuuccugugagugacugugucuacugaagccccgcuguauaagauuuggcaacuguguguuuaccuuuauuuuguuaagacuguuaacaguuacaucauacuauauauauuuaagucuucauguuuuuuuauucuguaaauuaagcauaauguugaugugaaauaaguggguuuuuuuaggacucuguagucguuggacacugugagucaguaguaugccagaauuaauuuuugcucccuauugauagaauaucauacucuuugugcuguuuaaaggaagaugaugcuauuuggacugugucuuucuuauauagcucuuuguuuuugucucaaguuucuaauugccuuucuuuuauguuuucgggagcagaaacuugugccuuuaugauaauaugaggaucuaguuucauuuuauucauaaauaaauuuuuauuggagccaaugaauuuuucugaucuaauuuguaccauuugcuuccugagccugcuacaagacugucauaccacuguugucauuaugcuucccauuuaggucuaauauguuuggguguucuugacucuugcuguguuggagagagauaaauugauuucuugcuugugugauaguauacuuauuuugcucucacacuugauugauaguucagguagguuuagguucaaacucauuuuucuucauuaucaagguaccaaugagaaauuugauaccagucugaaucuuauuccuuuguagauggccauuuuuccucuuuggaagcuuuugaauguuuugguaugcauauuuuccucauucaucaugcugaauauuuacuguacccuuuugaucuggaaauuuauuuauucagcuuuuuucuguuauauuacuucuuugaugauuuuccccuuuaguuuuuucuguucuuucuuucuagaccuucuuaaagucauaguuuauaucuucuuccuuuaucuguacuccucaagauaaaugcuagaaguugguuaagccaggacuuaaacccagcuuguagcuuuauaagcuggguuuugaaccucaguuuucuaguuaguaaagugaucaugagaauaacgaccucaaaggauaucaugaggauuaaauuagauuuuuuuaaaguccuuagcacuaugcccaguacauacagcauucaauaauguuaggaauuguugcugucauguucacuauuaauuuauuuaacaaauauuuauugaaugcuaauacaaaugugccaugcucuucuaggugacccccaguaagguagaggacuaagaagacaugagauuuaugugaaaaagcauuuuuaaagaagaccauuggcaaucacaaaauaggccuuuaguacacuaaacccuaaugacucugccuguucugagucuagccuuaguuucaguucugagccuuaugaacugcuguugugugagucacaaggucaacuaccauaauuuaaucacuugcuaucauuuuagcugaagacacuauaaccuuggcuuccccagaguauuuuacuacagguuaaucuuaaacuugauaguagcaaauugucccuagugucccuaaccucccccuuacuucaacacugccacugacauuggccugucaauuuaagcacuuuuaaugcccagcucuuuuuuuuuuuuuuuuuuaagacgaaaucucacucugucaccuaggcuggagugcaguggcacgaucuuggcucacugcaaccuccgccucccugauucaagagauucucaugccucagccucccaagcagcuaggacuaugaguaucugccacagcgcccagcuaauuucuguauuuuuaguagagacgggguuucaccauguuggccaggcuggucucgaacuccugacuucaagugauccaccugccucagccucccaaaguacugggauuacaggcgugacccgccgugccuggccccaacucuuauuucauaaguucauuuauuaggaaguaauggaggaaauaguagcaucaccaucuauuuuauucuuuuucccaccuuggaccugguagguccugcagguccucacuagggaaaacugaaaaauagaauuaaaucucaucuuuaugggaguugugguacccagcugugaauggaguucaggcuuucugcagugcuuucuccuguuccuguugucagaaaucggagggagagagcagcuugucuuuagugugccuuuucugagggaugcuacaucauaagcaggggcuuccuuucuucccaaucaguccaucacuauuaagguugccacauaagaacaaaagcuuauuucuuauuuuuuaaguugcuucucaguaaaggaaaauacauuuuagcaagaacagaaccuuccacauacucacuacuaagauucauucccauauuuccuaagaaacaauaaucaagcagaacuuuuaaaguaauaguaucagaguggggaacgucucucuguaugaccaaacuccagaaucuguaauagaaaauaucuacaaaucggacugcauggaaaucaaaauuuucuacauggcaaaacguuacaguugacccuugaacaauucagggauuggcguacccacccacuacgugcagucaaaaauauauauauaacuuuugacugcccgaaaacuuuacugauugccugucuauugaccugaagccuuacugauaacauaaacagucaaguaacaaauauuuuguauguuauauguauuauauacuauguuaaguuagagaaaacauguuauuaagaaaaucauaaugaaguggaagggaauucuuguauaaguggacccaugcaguucacacccauauucaagggucaacugaguaaaaaauguuaaaaagacaagugucaaguucagaaaauuauaugcagcccaacaacugacaaagcacuaucauuuuuaauauagaaaagguccuacaaauaagaaaaaucacagaaaaggaaauacaaaugguuuauaaacuugaacaaaauguuuaaucucacucauaguaagagaaaucaaauuaaaaccagugauacaccauuuaaaaaaacuagacaugaaaaagcaaaaaguugaauuaaacacuuaaauuggugaugaugguagcauacauugguauaacaucucacaagggcaguaaguuaaaaauuuauauauucuaggaauuucuuuuauauaaaugaguguauauguauuaaaugagguauagguauaaggcuauucaaugcagcauuguuuauaauaacaaaagauuagaaaagccuuaaguacccuccaacuaagaguugguuguaguguaucccuacauagauuuaugaauacuagggaauucuuggaauauuauguagcuaacaaaaaaaauaccuaguauagauugagcaucccaaaucuggaaauagaaaauucuccaaaauccuaaaguuuuugaguaacaugaugcucaaaggaaaugcuaauuagagcauuuuuggauuugagaugcccaacugguaaguauaauagaaauauuccaaaauccaaaaacacuucuagucacaaucauuuugaauaagggauacucaaccugugccuauuuguguucugcaagaucgauuuuuuuuuuuuuuuuuuuuggaaaggaguccauugcccaggcuggaaugcagugguaugaucucagcucacugcagccuuggccuccugggcucaagugauucucccagcucaaccucccaaguagcugggacuacagguaugcaccaccacaccuggcuaguuuuuguauuuuuuuguagagaugggauuuugggguuuggguuuucaucauguugcccaggcugguauugaacuccugagcucaagugauccaccugccucggcuucccuaaguauuggcauuacaggcaugugccaccacaccuggcccccaggaucaauuuuuaagugaaaaaaaguugcaggacaacauacacuauaauaauaugcuacaauuuauauuuaaaauguacauauaaguaugcacauauguccuuguauuuuuauagaauagcucuagaaguauaccuaagaaaauuauaacagugguagcucuggcaaagagccacgugaaaagagauaaauuauauacuuuuuguaccucuugaguuuuaucccuguaacacucuuacugugcauuuauguuuauaaugcucagguauacaguuucuuaguacagauugcuauggagaacaccaucauuugguguucagauuccaaacuaagaaguuuuucuccgucauaacuuccucuuauuucaaaaugacaguauauuucuuauuauuuuggcugcugugaagcugaaagccacaucaguguccaaaguaauagcuucuuauauucuggguuuguuuucugggcaucauugcugcuuuucuuauuuccuuuacuauacuuuuuauucuuauauuaauuuugaguuuuguuauauguguaucuuuuaccuaucauuauauucuuagacuauaaauaugaagaaagccuuuggugaaguguaaguauucuuuuaaggaugauuaccaguuuauuuagaaaaaaaguucuuuuuaauacucuaauuuuaaugacuguaauauucuaaguccuaccuuuaaaaauugaaaucaauguaaauuuuuugaguaauucauuauuagcacuuuagguagagaaguuugcaauaacaacugauguaaguauugcucuucugcagucuuuauuagcauuguuuaaacguaccuuuuuuuaaaaaaaaaaaaauaggucauugcuucuugcugaucuugacaaagaagaaaaggaaaaagacugguauuacgcucaacuucagaaucucacuaaaagaauagauagucuuccuuuaacugaaaauguaaguaacuuggcaguacaacuuauuugaaacuuuaauaacuugauauuuuaaaguaccuagguaauccauuaaaauucaggauaacugaauuuauaguuauuuguaaauugcaauauguuuuacccaacuuuaggccugaauauauaauaguuaaugaauuuuuguugguaaagaugauaaaacuuuauugugcucaaauguuuuauuuaaagcucuuauuuagaaaaucuauaaaguuugaauucuagaggaccucaggguucaacuaggcaacuaguuuuuuaacuccguguauugaauugccaaacauacucuauagaaauauuuaucaccaucugccuauuuuuuguacuguguugcaggaaucaugccaaauaguuuuugcaauaaaaauaucucugaaaauauucuagauauaaaugccaauagcuauagcacggauauuagcauuuuugcaagcacuaaagcugguuuguuuuguccaccaguauucacaauaaauuaacaguaugcaguugaauaacauucugauuuacuacaaaggguuauuuuucuuggccucugcugaaccaguaaaacauauacugaaaagaucgaaccugcauauaaugaauguguuggaguaaagaaaaaacaugcaagucaauaguuuagauuacagaaguuuguucaccgauuuaugacagcagguccuaaacugccaacaucucuaaccaucugauuagguuuccaugagccaagucuuagauauuccaugaaucauaaccuuuuagucaguguaacacagggauuucaacuuuuuguuaagaaaugacucaacaugguggaggcuuaugccuguaaccccagcacuuugggaggcugagaaagguggaucacuuaaggccaggaguucgagaccagccuggucaacauggugaaacucugucucuacuaaaguaaauacaaaaauuagccagacaugguggugcaugccuguaaucucagcuacuugggaggcugaggcaggaaaagcacuugaaccugggaggcagagguugcaaugauccaaguucaugccacugcacuccauccagccugggugacagagcaagacuccaucucaaaacaaaaagaaaaaauaaaaaaaaaaauaaaugacucacuagaggaaucuuuaaguguccauuuaacugucuuguuuagcuaauuaaaauacacuaggauuugucugguuuccucaucuggauguugcuagcaaugguaacauuuuucauuuuagaaauuuugcaaaccauugcauuuauagauaugaauucugauauggcugcuuuaaaauuauccaauuuaaauuguccaauuaaaaucauucauuuaacuugaaauguaugacuuaaggaaauuuuucaauuuaacuugaagugauuuauuuuucuuagauuguucagaaugauggcauuucagaaacauuggauuaccugugauuuuuguuuugguaaauguuuaaaaacaauaaaaaaggaaaacauuuacgugugcauuuucuuuauacacacacacacacgaaaaaaaaacaaguaagaaacccagaaugguccuuaggcauaugagaacagaaguucugauugaguaauggcuauggaaauuuccccuaauauauuuagaaaagcuguucucucaugcaguggauauaauauaccaugguaucuaauuuuucuuucugaugaaggaagcaacuacagaaagcuuuuauuuauuuguucaaagugaccagugcaauuaaugcaaaagaaaauccacagcaacucucccaauacuacuuucaaaacaaacauaccaaacuugauuuucauuaaaauguaguuauuucuucacacuaguaaaucaaaaaccaagacccauauaaaacagggcgaacaauuacugugcuucaucuucuggacaagaaugccaaguuaguuucucuuuuauaagcaauuacauuuugaggacccuucauauuugccucuuuugccagcagcaacucugccuaaucugaauccuuccauuucaugagaaacagcaguucuccacugcugucuguggcaccaauuacuccuucaggaucaagacaucuggcaaagccuuuuaguuugucagcagcaucccuucucuucuuugauuuacugucaucagauucacugucagauaaagauuuucuguuugugccaucuuuuucuugacuaguuuuuugagaauuaagaaaugcuucaauuaacccugaaccaucuaaauuuucuuuagguucccaaguguugucaacaucuguaaaucccuuccgcuuaaggaaauaucccacuuuccuauucacuacacgucagucuaguacauuuuccaucacagauucuuccggcucugccucuucaucuuuuuuacucuuuccauucuguuuguuuccuauuuuuugcaauguaguuuuauuggaggccauuuuuuauugcagacuugaggagcugauauucaccaccuccaagcugcucuggguuauaggucugcaguguucuguaaaaaaaaaauucuaauccugucagccucucccucuccaugucaaugauuuuauucaugggauggcacauauaagaauauuucucaaauacauuuauaguggcugcgucagcagcacauauccuaaaacuggaaugaggcagaggaguuuagcauggcccuugcucaaggaugacauggaaauugaugaaguauucuauauuuaaaaaaaaaaaaaaagaaaauuauauaaucucaaacaagacuacauauuuuagcuauuauccauaaauauuucacguaacuuauuuuuuuuuuuuuugagauggagucucgcucugucgcccaggcuggaaugcaguggcgcaaucucagcucacugcaaccucugacucccagguucaagcgauucuccugccucagccucccaaguagcugggacuacagcaugccaccauguccagcuaauuuuuuguacuuuuaguagagacaagguuuugauguguuagccaggauguucuugauauccugaccucgugauccacccaccuuggucucccaaaguguugggauuacaggugugagccacugcgcccagccacauguaauuuuuuaaaagaaaauagacuaauuaaaauauaacguacucucuuagcuuagauuuuucauuuucuacuacuacuuugagagaccaaaauagacaaaaagguaaaaacugaaagagagaaaaccguuuugaaaacauguagcuagccagguuuccugaguggacguuggcugacaggagguggaacuggaagcuuaagugcucauucuccuagaauaaucauucaggguuuugagagagaaaggaucccuuuuucugagagggcccuuaacauguuaacacuuaacagugcuccugggaauuaaggagcacagauaaugagagaacaguuauuguuagccugugaggauuaggaauuuugggggauuuguugggacuauaacuuaugaagaaaaauaccaaaguguaguuuugcuuaccguuaauuuuggucauuagagaauauacaaaaauccagaaucccacugucuacaugaagucagguucaggaaagagcuuaaauguacaugacaacucaagaguauuugguuacuaucugaaacaaagaucaguugucaaguuaauuauucucuacuaauuuauuaaguagaucacauuuauuuaauaugauauauaagacauuaucaggcaccauuggcaacaucagcaaauuuaaacucugcuuguauuuuauaaguauuuuuuauuuucacaaauuuugcauuuauguugggaagccaagcuaaugaacacuuuauguggaaauaccuacuuaucaaaacauuacugaaaacaucagaucuaaaccacauuauugcaacauacugugucauguucaauuuuuuuuuuuugcagagaggguuugggaaguggaggacuaauaaguggaguuacaacuggcucaguaggaauaagaaauaacaugcagacuauuucaucucuauugcaacccauaauuuggguaugccuaagggaaugcauucugcauaugaaugucaucuguauguugcaaagggaaaagggugagaacuaaucuaacuacaacugacaacacaauuuggaguucuuggaccagaaugccauucugagucagauauaugucauauacaguuuucuaagggcacacagaaaaucuauaacauugccugauucccuucauggcccauuauaagucuguuaccuaucauuuuauuuaaucagcuuuuauugccuuuugggcauggguuuauauguuucauuaccuuguccuuuuaaaauccuguugcaugcuuggcaguuaucacaguccuuggaauuuuaauuaaaggguuaauaaauuuuugaaugaguuauuacccauucugaagaaguaccucuuuuuguuucaacuuugcuuuacuuuugaauuuuuaccaaagucuguguugacuuuaucuacucuauuuaugauuaucuuucuuacauguaggcuuuuucuugucccauauuccucauuugauuaaugaaaaaguucucucaacuuaaucuguauguauaugguaauccuuaccuuaaguugaaguaugagcuuaagaaugauggacuuguuucuugauauuucuauguuguccacguuaauaugcuaguauuuaauaauuaaaaguagugccucuucaguagagaagagucauaaggcaacugaauuuaaccucacucuaacuggaccaauuauauauuuuaagugaaauaggccaaucuaauuaaagccacuugugacuuuggcaaauaaguguuugaauuccacgucacaucagggauccagauugagucugacaccuauaaucaaauuuaaacacuccuuggaguaaaaaauaauuuucucaugcaccaugacugacguauuugcuuauucauuuucuuuauugguucuuauaugcuuuuuugcuuuuacugauuaacguaaauacaagauauugauacuuuuuuauuauuugugguuuuaguuuuccuuacaaacagauaugaccagaaggcaauuggaauaugaagcaaggcaaaucagaguugcgauggaagaacaacuagguaccugccaggauauggaaaaacgagcacagguaaguuacuuguuucuaagugauaaaacagcgaagagcuauuaggaauaaaaugaauuacagcucuguuaauauugauuaaauuuuauuaaagacauaaggcuguguuuauuuuggcucuauuucaaaauaagauuuaucauggcugcugagcaacauaaucaauauucacauaguugugucuuuaccauauucauuuccccugguacuguucuguucugccuuggaauuauaagggagagacagaguuagaugguggucuuccgguagcuaaugacuagcuucaguucuccuuugaaauuuuuacuucuuguaaucuuagacuguauaaaggcauucagaacaugucacugcucuucaaauugugcacuuaaaaaacccucauucaaggauaauaggaaggaaacaaagagaauuuuaggagagaugaaguaaguuguauggagaacauucccauauuucuacccucaaugucaagaaagaguauuagcuagcuuugcuauuaaguauuuuuauauauuauugaauauagccuuuuuauauucaaacaaguuuaugacugacuaauguuuuaaagcccugaagaggccuugccaauugccuuaucuguuucaaaacuagcguggguuguuguuuucuuuuuuaacuuuugggacaaauugggaggaaaacauuuaaagauuuucuuuaaguaaauauagcaaauaaaagcagagaccaacauuuacaugguagugauacacauacauuuuguauucuauaaaacauauuaaauaguuuuaaaauggcuacuguaggauauuuuacauuccuugaaguauagucuuuauuuuuuuugugacacuuccuaaacauaaugauuuuuuuuuuuuuuucuugagucucacccuguugcccaggcugaagugcaauggcaugaucucaccugcaacuuccgccuccugggcucaagcaaugcuccugccucagccaccugaguagcugggauuacaggcgugcgccaccaugcccagcuaguuuuuguuucgccauguuugccaggcuggucuugaacugcugaccucaagugauccaccggccucagccucccaaagugcuaggauuuagagucaucaugcccaguguauuaguuuguuuucaggcuucugauaaauacauacccgagacugggcaguuuacaaaagaaagagguuuaagggacuuaacaguucuacguggcuggggaauccucacaaucaugguggaaggcaaggaggaacaagucaugucuuacauggguggcagcaggcaaagagagagagacugacagggaaacucccauuuuuaaaaccaucagaucucgugagaauuauuuacuaucacaagaacagcacaggagagacccacccccauaauuuaauuaucucccacugggucccucccacaacacaugggagcugcaagaugagauuuggguggggacacagccaaaccauaucacccagccuaaacauaauguauauucuaucuguuuuggaguaugguggaaggcuaaggugcuacuaaaacaccaguaccauacuacauuucauaguccauacauguuaguuucauagugaagguuaagaucauaaugagguugggggcuuaacuaguguuugugugcaugugcauguauguguacauguuaguuauaauacguguauauaucauuuuuucuuaccuucccucuugccccuaucccagucagaaagauucgugacuuaaaugucaaaaguaaaacuuuaaaccuuucaguagaaaauauacauaaguauguuucugauauuagaguaggaaaguauuucuuaagaaagacuuaaaacgcuaaugauaaaagaccaauaaguuuacuguauuaaaauuaagaauuuaucuucaacagguaccugaaagaaagugaaaagauaacuuacaaauugggagaagauauuuauuaccauauaacuggcaaagaacuaaaaucaagaauauauaaauaacuucuaaaaauacauugcauuuuacauuuagauuuaaauuuuagauuuucauggaauuauuuuaaaauguuagguuuauuuguuucaaaaaaacaaguauuacuuugguuuauaugaauuugcauuuuuagaacaugaauauaugggauacuguagacauaaguuaguuuuucugugucuguuaaugugagcuuuuuuuuagagagagagauccuaaaagaacaagaugugaugguaguuguaaaaauucuugugcuauauaaauauaaguagguguauuccagacauuuuauaucccugaggagagguuaacuugaguucuuucuuggccauuuuguucacauaagcgcugauacugucauucuuacuuuauucuggaaugccguauccuucauuuugguaguuaauauucuaaggaaauuuuauucuguauuuugagaaacauacguguucauuuauucuggaaauaguuauaugaagguuaagguuaaagaaauuguaaacaagauaaaaaggcaaauaauggaaauguugguagaauauauaagagauuuaauaucccuacucuacaaggaucaccuacaaaucaauugaaaauggucaaccaugccaggcauggugauucacaccuguaauucuagcacuuugagaggcugaggcagaaggaucacuugagcccaggaguucgagaccagccugagcaagauagcaagacccugccucuaccaaaaaaaaaaaaaaaaaagcugaguaugauggugcacaucuguagaccuaguuacuugggaggcugaggcugaggaggaucccuugagcccaggaguucaaggcugcagugagcuacaaucucaccacugcacucaaaaaaaaaaaaaaaaaaagagaaagaaaggaaagaaaagaaaagaaagaaaacagauaaccaaauagcaaaauagucagaagaugugaauaguuccaucagaaaauuaaguucaagugucuaauaaacaauugugaaaagaugcuuaaacaucacuacacaucagggaaauguaauauaaaguaagguacuauuuuuuuuuugccuaucagcugcccgaaacuuuauaauuuuugaugacaugcaguauuagcaagggugugaaaguaaaaacaucaucuaccuuuaaaucuuuuuuguuugcuuuguuuuuucuuuuugagacacagucuugcucugucacacaggcuggagugcagugguuugauuucgccuuacugcaacccccaccuccuggcuucaagcgauucucaugccugagccuccugaguagcugggacuauaguugugugccaccacgcccagcuaauuuuuguauuuuuaguagaaacaggguuucaccauauuggucaggcuggucuugaacucuuggccucaagugaucugccugccuugaccucccaaagugcugggauuacaggcaugagccacugcacccagccaacauugucugcccuguucuuuuaagaauaaauugauacauuuuuggaggacaauuuggcauuauuugccaaaauuaaaaugccugugcucuaugaccguguguuucuauaggacuucuaggaauauguugcguacagaaauacuuacuuuagggcagaauguagauacauauuuuaaauuauuaaaugaauaguaugcaagcuauuauaaaauaccauacugagaauagugggaauaugguagccaaagcacuccuuucccuccuaacucccugcuugggugauucagcaagugaaacaagaacggcccuggaagaggagaucucaggagggucugaggcuaugagaaaaaauaugggaucucauuugcaaggggaaggaguaaauaagaauuccaaauaaaauaagaauagaaugaaaguuuuuaaacauaaguauuaccacaaaccagaagcaaaccuuauauuaagaaaauagugacugagugaaauagcucaggccuguaaucccagcacuuugggaggcugacgcaagaggaucacaaguuagcaguaguguuggcacacaacuguaaucccagcugccuuaaggaaugcugaggugguaggauugcuugagcuuaggaauuagagguugcagugagcuaugaucaugccacugcacuccaaccugggugaccgagcaagacccugucuugaaaaagaaaacagaaauaaugagguaaucauuguugcuaucauuaauauguuugaguagcuugccgucaucacuauuauuuaacuuuguuugacaggcuugacuaaugcaaguagaaaaaacaaaauaaguguuaugaauccuacacuauuuuugaacuagaaaggaagagauuaaauaauuauuuguaaaugauguggugguuugccuagaaaagcuauacaaaaugaacuaaaaaguauuuaaacuaguaagagaauuuaguaagguaacucaaguuaagauacauacaaaaaucagcaauaacuaccaguuaaagguggaaauggggguaggaggaccuguucacaguaacaggaaacuuuaaaguaacuagaaaaagccugcauaaagaaaaacauaaaauuguugaaggacacuaaauuuuuuggaaccuagaaaaaugauuauaaaguuuauaaugcaagaauuuccaaaaacauuuaugaaagaacgcauaauugaagauuuaccuuaccauuuguuaaaaucuauugugaagauguuguaauaaucacaguaugauaauagcacaggaauaaauuuaggcaaaugauagagacuagaaagagguacaggaauauuuacaaccuuuauaugacagaaguuacauuauaaauuuuggagaaauugauaaauuacucaauaaauuauauagguacaaccaaugaccuguucagaagaugagaaauuaaacccuuaccucacaucuuaagaaaaguuauagguugauuagcuauucaaaugugaaaaauaaaucuaaaauuaauagaauaaaauacaggcaagagaucuucuuaaauaugaauggaaacucaaaagcaauaaagaggaaggaaaguugggauuuaucucauaacauuuuaaaucauucauugcacaaaagauaaauuagaaaaauacuuauaacacauaaaggggaaaaugguaauaucucuaaaauauaagaauuccuacaaaugaauaagaaaaagacaacccuguguuuuuguuuuguucagagaggggguuuugcugguugcccaggcuguagugcaguggccauucacaggagcaaucauaauacacuacagccucaaacggcucuagcaacccuccuuccucagccucccacauaguugggacuuuaggcguguacaucgcaccugccuaacccauguuuuuuaauggacagaggauguaauaaggcaguucauuaaaaagauggcaaaugaccaguaaaacacagaugacuaguaaauaauuuaggaaaacucaaaauccacuugugccuaccuaugugagauuguuagucuccagguaccucuuaacugcaugguuauuuauuuacucuuacuuguucaguguguauuuggucaccuaguauggugguacuuacccuuccauaggcauguaagcaaagguuggaaaagugcacaucaguuuguuaauagagcuuacuacugggaugugggaauugguggggugaagguguaaguacaccucuauauugccauaauugaugauacuguuuaauguaguuuaucuccucccuaguugauggacacuuaaguugauucuaauuuuucaguuaaaaacagcacauguacccuaaaacuuaaaguauuaaaaaagaaaacagcucugauaaacauacuuauucaugucuuguaaacaaacaugcaagaguuucucuaggugaggagucagcaaucuuuuucuuagaaggccacauaguaaauauuuagguuuuguggaccauauggucucuuuugcaacuacucaacccugccuuuuucuuuuucuuuuuuuuuuuuuuuuuuugagucagagucuuacucugucaccuaggcuggaguacagucaugcaauuuugucucacugcaaccuccgccucuaagguucaaacgauucuugugccucaggcucccaaguagcuggaauuacaggcaugugccaccacgccuggcuaauuuuuguauuuuuaguagagacgggguuucacuauguugcccagucuggccucgaacuccugaccucaggugauccaccugccucagccucccaaaauguugagauuacaggcgugagccaccacucucggccucaaccgugccuuuuaacaagaaagcaaccauagauaauuuaugaacacaaaugggcauggcuguguuucaguaaaacuuaauuuauaaaaacagauggcuuaguaggcccuaguuugcugacuguugcccuagcauauauaucuaaaagcauaauuacuggucauaagguaugaguguuuugaaugaguguuugccaaauugcucuuaaaguaaucuuuuuaguuuacauuccuaauaguaguaugugacaauucuuguuucuguaugucuucuccaucacuugugagucagaauuuaucauuaacaaucaguggguagugaaacauuuugucaucuuaaacuuuguauuuuccugagcuacugaaguugaaucucgaaaauauuuauuagauuuugggguuuucuuucuaaguuacuuccucauaucccuugcucauucccuacuguuaaaugucuuguuuucauuuguuugagagauguuuuaauauccucuugauaccaauccuuuguagauaauauacaucucaauuccuccccaccaaaucuguuaucuguauuagccucauaacaaaaauaaacuuuuaugauagagcuaaauuaguuauauugccagauuuauacaucuuuuccuguacugaagucguaaagguaaucuucuauuagcuccuuaauucaucuugaguuugcuauuauguauguuguggaggcaggaaucuaacuuauauguauauuacuuauauauguguguauguguauuauacaugcacaugauuuauacauguguguauauauaguuauguauagucauacauacauauauuuauguuguuaacugaauuucucauuaucauguauuggauaccgcacuaguuccucaucgaugaguaaugucaucucuuaucacauaacaaguuuauauaugcuggauauuucuggacuuucuucuguuaguccacuuuagcuucuccaugccugcacugauaccacauuuuuuauuugcugcaguuuuauaaaucuugauauccaguugggugaaucguucuuuguuuuuaaaaauguaguauucugccuuauuacucuugucauguaaacuuuaaugucagcuucuaauucagauaaaagcuucaugggcuuuugauuagaauuacauuaaauuuauagauuaaggagaagucagaccuucauaauauuuagucuugguugaaaggauggacucuggaaccagaccuucuauauucaaaucccagaccugccacuuagcaacaccaugauccuagguaaauucucugccucaguuuucuugucaguacaauacagauagugauaaacuguaaaaugugaggauuaaaugaguugauauauguaaaagcacucagaaccuggcacauaguaagcaaauuauuagguauucuuacuaauuuuauaucucucuauucauuuaggcuuuauuuuauauccuucaauaagguuuugucaaauucuucacaggggucuuacauaucauuuaaaaaaguuauuccuagauauguuacaguuuuuguugcuauuauaagugagaauuucuuuaauuauauuacuaaauuacauuuaagugaaaaguauccagcagucuuccugaaauauuuuauuauaucaucgccgguuuaagauucuauacacugucauauuguucgcaaauaaugacaguuuguuuauccuuuccaguccuuacagcguuuuuucuuuuguuguauuguguaagaacucuaauacaucuuugaauggaaacaaugauaguggucuucuuuuucuugucuugacuuuaaagggaauucuucuaaaauuucacaguuaaguguguuguuuacacaguuaaguguacccuuuaucaaguuaagggauuuaccuucuauucuaauuuguggagaguuauccugaaucuguauuacuacugcaguuuuuaaaaaucacuuuuuucuaaagucauaucaaguccauacuccugaacaguuuguuauuaaauauaacuucacaaauauucuugucauauagaaaaaggaaagaaauacuuagugguuaagcauccuaauccaaaaauccaaauugugaagugcugcagugagcauuuccuuugagcaccaugugggugcuccaaaaguuuccuguuuuggagcauuuuggguuuuggauuuuuguauuagguauagggauuaggaauacucaagguguaguggcuucuucuauuuucauauuagaaacagaagcacaaggaaugucaugucagaaaccauccaccucacuggacaucaagacauagacaugaccucaguauuuagugagauacuggcaauauggaaauguaguguaaaacggagaggagugggagauauaauuuccuauuuucauccucuaaauauuaaaaauuuuuauuuaggccuauauugauggaagggagcuaauuauauagaaacugauuauauagaaaaggaggaaacaaucaaauuuagaaauccaguaauuuuauguagcuuggcuauuucucuaaagcuaggaaguacuugccaccugguuauggaaaugaucacucaucuuugcaauaucuuuagaaaacuagcaaaaguacagguacuucuucagaugguuuucauacugugaauuggacaugguaagauuuguuacuuaaagaauauuuuuuuuuuuuucuauuuuuuugagacagucuggcucugucucccaggcuggagggcaguggcacgauaucgcucacugcaaccuccgccucccaggcucaagccauccucccuccucagcuucccaagucacugggacuacaggcguaugcccucaugccuggcuaauuuuuguauuuuuuguagagacgggguuucaccauguucccuaggcuggucucaaacuccugagcuuaagcagucugcccaccuuggccucccagugugccgggauuacaggccugagccacggugccuggccugagaauauuuuuuuaccuuaaguuuacuacuuucagaaucaugauagagacucagcuuaguuauauuguuaaaaagaaagaaaagagggagaaaauuaagauagauuaauuugggacugugagcacagcuucuuguuuuauuuggguuuuuuuugggggguggggguuguuuuuguuuuuguuuugagacggagucucacucucgcccaggcuggagugcuguagcaugaucucagcucacugcaaccucugccuccuggguucgagcgauucuccugccuuagccucccgaguagcugggauuacaggcacgcgucacccaugccuggcuaauuucuuuuuguauuuuuaguagagacgggguuucacuguguuggccagaguggucucaaucuucugaccuagugauccaucugccucggccuccugaagugcugggauugcaggcgugagccaccgugcccggcagcgaacacaacuugaguuuucuguucuuuguuuaucauaagacuggaugauagcaguaaacauuuuuacuaugguaguaagaaaagcaugaaggcauuguauuuaaguaaaacuagaugugaucaaagaguaaguuuuauaacugcauguauuuaaagcuaauugccauaguacuuuuauuauuuaucuguugggggugauauuuguuccgaaauauuuuauugauggagaacauaacugaaaaauguuuggaaauacuccaucuagcuucuaacacacacacaccccuuauugaaacaguuuacuuuuauaauauaauuuuugauuucucaauauuaggaugucaauaacuauagaauuauuacagaaaaugguacaacauugucaguacuuguuuuuaaaacauauguguuugauuugucauaaacuagcuuuaugagacauuugcaaagucuuuauucauaagugaguuguuuuuuccacuuccacuaguauucauaaaaguuaaaaugaagucuagcuuaaaaaacacacacacacacacacaauauauuccccacauuguuuccauuccaugugguucaaucuguaguuacugcuuugugaccaguugauggucuccauauaguggaaaagcaaaagcucuauccucuuuaugauccuaguguuggagaaaaaauaauguuuagccacaguuagguacuuggaaaggcugaaaaauacuacuaacuuaugacagaaguaacuuuggggaagaguugggccuacuguuuaaaccagggguccccagcccccaggccacgagcaagcauuaccaccugagcccugccuccugccaccaucaguggcugcauuaggagcaugaacccgcuugugaacugcacaugugagggaucuagguugcgggcuccuuaugagaaucuuaucuaaugccugaggaccugagguggagcaguuuuauccugagacuuccccugccccagucaguagacaaauuucuuccacgaaaccagucccuggugccaaaaagguuggggacccugauauuuauuaaaacaaaucagauguucuuucccuuuacugguauacuauguuuauauaaauuuauuauauuguauuaaugucucgauuaauauaaaagauuaaaugcagguguaauuuucucuuuguugaaauauuuuuugagaauaaauuuucacaauguguauugugucaauuuucauaauucaugcaacauacaauuugauauaugacuuguauuuccaguuuuacuaagcagaucuagacaucuguugaauaaaguccaguguauuacaaaaaauugaacugacccagggccgggcacaguggcucacgccuguaagcccacagcacuuugggaagccgaggcaggcggaucacaaggucaggacuucgagaccagccuggccaguauggugaaaccccaucgcuacuaaaaauacaaaaauuagcugggcgugguggugcgcgccuguagucccagcuacucgggagccugaggcaaaagaaucacuugaacccggaaggcggagguugcggugagcugagauuaugccacugcacuccagccagggcaacagagcgagacucugucucgaaaaaaaaagaaaaaaagaaaagaaaaauugaacugaccccaauuuguuauuaaagggugaauauauuuauaugucuagcuuuuuaaaugagaaugauuugacauaacccugagcuuuuaagugguagccauaguaugauuauuucuauuaauauuauuaauaaaaacauaacuaauuagguuucuuguuuuauuuuagcgaagaauagccagaauucagcaaaucgaaaaggacauacuucguauacgacagcuuuuacagucccaagcaacagaagcagagguuaguaaauugccuuucuuguuuguggguauaaaaauagguaguuauucugagaaaagaaaacauguauaauuuaaugugacaccauugaaauauagauguucuuucagagaauuuaaauaccguaauuuuuuucgugaaauuaaauuaucaaagauuuggacuauuuugauuuuaucuaacuuuuaggcaguuaaaauuuauaaaacuguaaauauagauaccuuacuuuagcugucaguuuacauauaaucaaauaguuaacuuaauuuggcuacuauccaguaaguaaacuuuuuuauagauaauccauaguaagaauugauaauacacauuuaccuguguuuacuccagaaaccccauuaaagugauaguaaaaggauacaaugaaagaggcauuaagaccagggaaggugaccacaguaaaauccguggagcuggaaagcagguaaacaagugauaacauucuagcauaucagagaggguugacccauaaggcagcaauaggaaugaaaagucaugaagcaacuagauaccucugggugugagaguaaaaaaggguuaaaagcaggaagauauuugaaaaucuguuaagaagcagauggacuuuccagaaccucccuacaacccuguacagcuaggugacugcuccuuuccaaucccagcaaaagaugagagcuuucuccucugaagagguggagaggguaaacaaagggucuuugguuaggggucaaccuuguuuaauugaacgugaggguaucauacgaaacacugaauuacaugaaaauuuaccuacugaaugcugaaacccccacuggcauccaggcuuauaaucuccaggcaaguuucuggaaggaacuucuauaaggaaugugacuaacccugauucugcugagagaacauuaaaaagggagaaaaaaaaucagaagaaugugacuaacccaagaaaaaaaacuuaaagagacuuacauggaaaaauucacccaacaaaacaacccaccuagaucacccuauaggguaauauaguugacaaaauccauucuucaggcauagagcuucauuuaacuuuuucauagauagcccgcucuuaaauaugaguggacacuaacuaccagacaguauagaucauucuaggaagguucaauauccaaauaaaaggaguuccaaaaagaaaauggagaaacuggagacaggaaauuagagaaauaaaucaaaauuucucagaaauuuuaacaaggggcuuaguuuuccaaaaaauuggucucuccaguaucuaacaucauguauaagaauaauccuacacuaagacacaucaugaggaaauuucaaaucacuggggauaaaaagaauauucuaacaaccuucuggagaaggaagagaaaacaaauuucacauaaaggaacaggaaugcaaaugccuuuacauuuguaaauaacagcacuggaaacugggaaguaggguaggcauuucuuaaaacuuuucuuuuuuuaagagacguggaacuaagucucuuaaaaaaaaaaaaaagguaggaugaucuagcuggguuguuuuguuggugaauccugccauguaaguaagucucuuuaaaaaguuucugucacccaggcuggagugcaguggcgcaaucucggcucacugcaaccucugcuuccuggguucaagugaucuucccaccucagcccccgaguagcucaugugccaccaugccugacuaauuuuuguauuuuuuguagagacgagguuuugccauguugcccaggcuggucucgaacuccugagcucaagcaaucugccugucuuggccuuccaaagugugggauuacaggcgugagccacugcgccugaccccuguuaaaccuuuuaaaagaaaauaugugcagcuauguuuugaccccaguucuuugacaccacuguauauccuccaguuggguucaauuuugauccuaacuacccagaguuagagucagcuccacaaguaaaagacaaagucagucacaagacuguccacuucaaacgccagccacaaguuuugggugucccuaagccaccaggacugcugccaagcugucuauaaauuccaccccgugugcgugugcugugguaccauuccauucucacacuaacuacccagaguuagcacagccccaacagguuaagagccgacuccuucacaagacugcucccaccucagaugccagccacaaauguugaguaucuccaagccacucacauuucugcccaguguguuacaaauuccaggcuuccacauccccuucacguucaguaauucauuagaauggcucacaacucacugaaagugcuauacuuaggauuaacaguuuuauuauaaggauacagaucaagaauggccaaaugaagagacauauggggcaaggccuaaggaagggguguaggaauggggaugggggugcagagauuucaugcuuucuccuaguggaaucuaggcaugucacucuucuagcacuucauuguuuuguuuuuguuuuuguuugagacagagucucgcucuguagcccaggcuggagugcaguggcgugaucuuggcacacugcaaccuccgccuccuggguucaagcgauucuccugccucagccucccuaguagcugggauuguaggugucugccaccaugccuggcuaauauuuuguauuuuuaguagagaugggguuucaccauauuggccaggcugggcuugaacuccugaccucaugaucugcccgccucggccucccaaaguguuaggauuacaggcauaagccaccguucccagccuuuuccagcacuucaguguauucaccaaucagaaagcugcacugaguuuugguauccauaauuuuuauugaaauuuuauucuguaggcaugauuaauuaaauaauuggccacaugaggauuaaacucgauuuccagccuccuucucuuccuggagguccgucuggcccaaaguucuaacucucuuaucacauggugacagccacccaucuuuuugcuaucugguggccuacccugaguugccucauuagcauaacacacaccccuaucacucgagaaauuccaaggguauuugaagcucucucagguacaaaugaacaaagaccagcuauauuuuuuauuauaccauucuagccuuuaaucaaaguguuaaauuugagaguggaauaaagacacuuuuagauaggcaaagugucaaauacguuuuucucaugcacccuuuucuggaaccuauuaaaggauauacucaagugaaaucgaaauguaaagcaagaaaaaugaauuuuuucaacucaagacccaggggauauaauacaagagaaagagaugagugaaacuacagaguaaagaugaagggacauccugagauaaaugguaaagaaagcaaccaguccauauugaaacuauugagaggauuccaggagagauuaaguccaagaagaugaaaucagcagaauaccugcgguuucugaauguauugaagggaaaggaaauuuacacaguaggagagaagcugagcaucagucauauguacccagaaacccaaaugaacaaaaaauaaagauaaccuuuaacuccauggacaacaggaaguuguaaaggaaggugauuauaguauaccaucugccagcuaugauuagaauuucauagucaaaguaauguaaauaguggaaaauuuguguaacaauaaaguggaacugaaaugaagcauucaacugaaaaaugcagaacuagccauugaagcagguuauuuggagaucggagggggugaguauccccccuuccccaaaaacucagcugaaagagauuagaaagaaagaguucuuucaaaaaacauuuucauccaugucuggcuuuuuuaauaucugaggaacuuuggauuuaguacaucugaaucugaaauauguagaaacuuauuugcuaaguagacaguuuaaguacaaugugauagucauaauccuaaaagcaguuuaacaugacugucuuaagcaaauauaagucaaauauuugcaauuuaaagaauguguucauuuuugcaauggacucuuuuuuuaccuggcccuuggaaagggccaggaaaaaaagcaguauuuuuuugcuccuuuucaguucuguugguauugauguauguagcauucuacuuauuaugaccuuuuuggcuuucuacugaaguuuuuaugugucuuucauccuuaagcaaauuuguuuuggucuauuuuuuaaauuauuuuuaaauaggcaguguuuuguuuuuaauugaauagcuuuaguuacaguuaguucuuucccccccaucuuucuuguauucugauuauuacuguuuugcugcaucuaacagguuuugauauuucuaaaucaauagucacauuuuuuucuaguugauugaaucuuuuauuuauguaauauaaaauagcccucuauuuuauuuaaugcuguucaccuucaauuucauuguaguaccauuuauuaauaguaauccucauuuuccaguacuguuacaaguuucagguuggaaacuuguuuguguuucuuguaucuguucaaaacuuuuuauucauauuauuggauuuagggcagacugucugcuacuaugauccaaccucuuauugcuuccuuuuguuaugauaauaguuacaucaguugcauuauucugauaguuuguaaauguaagccaaaggaaggugccauuucacauuuaagaaagaacaaaaccacuuuuuacaauuuugccguuugugguuuguuuauugcauuauuuuauucuucuaauguaaguuagagggagaagcuagaagauggagaaaauuggggauuggacacuugcaaauuaguucauagagcaguagauaugagaaagggaaaagcuucugccaaauaauuucucuaucaugaagcauauuucuuauagcauuuucuuuggcuaccuguauuauaacucugguuuaaggucuagaugcuggacgugauuuaagucuacuaauuauuacacaugauucaaaacucagaaguuacauaaagguaugugaggcaaccagugcugugacuuucuuguguguucuuccagacauaguuuauuuauuaacaagcaaguacauuggguggaaugggagcugugaggacaaugcagugugucuuaaaagauaauagcaaaugaagaauacuuacuaaagucacaguauucuugcaacucauuaauaaagauaaauacaacucaccuuuuaagugggcaaaagauuuaaauaggcauuucaccacagaagguauauauaggaauggcaaauaaguacaugaaaauaugcucaaucauuaaggaaaugcaaaucaaagcccaagugagauacugcuucacacccauuaugauggcuuuaaucauaaaggcaauaauaagcauugacgaagauguggagaagcaggaucccucauugcuggugggaauuuaaauaguacagccaccauuuuaaaacaguugagugauuccucaaaauauuaaacauauaguuaugugacucagcaaucuuacuccuagguaucuggccaagagaaaugaaaauauauguguacacaaagacuuagacuuguauguucauucacuagcagcauuuuuucauaauagccucaaaggagaagcagugcaaauguguaucaacuagugaauaaauaaacaaaauuuguuauaucccuucaguggaauauuauucagcaauuaaaaguaaguuacugaugcagaauuuauaacauggaugaaccuccagaacaugcuaaguaaaauaagccagagauauaaguccauuuauaucaaauguccagaaaaggcaaaauuucuaaagacaaaaaguacauuagugguugucugacuguaaguggaaaugaggauuaacuguaaauggacagcaggaauuuuauuggaaugaugaaaauguucuaaaacuggauuacagcugugcuugauaaaucuaaaagucauuuaauugaacacuuaaaauggauggauuuugugauauuuaaauaccucaccaaaauuuuuuuucaaguucuaucaccuagaguagaaaaccuuggagaaguuguaaagcaacuauggaaaugaggaaacuaguuagaauuaaucuuucauaauagugaacaaccacuucuuuugucuucaguguaucgaagcgugcaggcaggccuguagccuaggaucagugaaagaauaaaaaaaaguaauuaggaaagaggagggaggaaagaaaaugaagauaguaaauguuaaaugguaguuuggguuggaauugccuggguuggaauuccagcucugacucugccauuuacuagauaugugacugaaaacaaguuacuuauauucucugugccuccaucucuuuaucuauaaaauggggauaauggccgggcacuguggcucaugccuguaaucccagcacuuugggaaacugaggugggcagaucaccugaggucaggaguucaagaccaaccuaaccaacauggugaaacccugucucuacuaaaaauacaaaacauaaccagcaugguggugggcgccuguaaucccagcuacuugggaggcugaggcaugagaaucguuugagccgagauugcgccauugcacuccagccugggugacagggcgagacucugucucaaaaaaaaaaaaaaaaaaaaaggcacuuuaauauuacucaacauauucaaaacauaauuaaugaucuguuccuccuaagcccucuuuacuaccccaccuugcagcaaaaaaccuucauccucccucaguauuaccuaucucugugaggaguagcaccaucauuauugaauugugugagcuaaggaauguaggaguaauacuccacaccagaccucuuccuccacuccccauauccugucagcgaacccgaucagauuuaccucuaugucuccacuucuuuuaucucugucacugcuucccuagugcauagugccacugucucacacuuauauuaauacauuagccuccuaacuggucuuuccuauguuuccucccuacuuagaccauuuaaaauuugacuuaaaaaauaaaauuuacuugcaacuuuauccauuaauauauuaguauuaauuaugugggggcaaucaugcaguggccucacuguaacuugcaaguagaaaaggcaagaaugccaucuaagaaucgcagaaaaaggcauuaaaauuuaaauuuuuuuaucauauucuuuuuguucuacuuuccuccuuauuuuuggugcuucauccacaccaugauucguugacacgcuaaaacaagccacacucccuccuacccuggguccucugcaugugaucuguuuuacccagaacacucauccucuacuccuccccuuugccuaguuaacuccuauuuacucuucaagucuuuacucaaacagcacuucccaagagagcucuuccaaaccuccagaguauaucauaucucucuguuauauauauuuacagcaccuuguacccuucuuucauggcauuugucaauuuuaccuuuauuauuucugucauuauuugacagugucccugacuaaacuguaagguccaagagagcauagaacaaugucuaguuuugcuagcacuguauuccccagcaucuauugcaaguaacuaacauaguagauggucaguaauuuucuuuaaauauguugacaucuucacuuacguuagugucaaaucuuuguggucuuagauucauuuugucucuagguugacuuuauguauguauaucuauucuuguggauuccauuaaauucuauagcaugauuuucagaugguacuaauuauucuuauauuucuggauuacugagugcuaccucacuuuugccagcauauaacugauacuaguuuauugauggaaauguugcauauaaauuaaauuuuuaagucacauuuuuuaaaugaucuaggaaagcuugauguuuaaagaaauuacguuaggaaucauuuuguaauuuaauuauccacuguuaggucagauuuuuaauguauaauuuuuauuuuagauauuuuuuuccuagaacaagcauauagguguuucuauaaaugaccgugagaaauucuuuuauuucuuuaauuuuguggugguauuuuuauaaagugacugcuuugugcuagggauaaucuaucuugaaaugacugcuuuuacuggauguaaucugucauuuuaauuuccuguuaacagauggugguugcauuagaaaaggcuuuggguuuuauucauaucagaagcuaagagccuaucauuuuauuucaccuaacuuuuauuagaagauauacauauauauauauauauucuaugugaaaauauaccuaaguagaagauauuuguaagcuuagguaauaguuuaacuguuguauuugcagcuccauuaaaugucagaaucauguguccuugcagaaaagauaguuauuuguucuacuuggguuauguuccugauaguaaugugagcgcagcugguagaggauggcauuccugugagucucagaaaauccuuugucucgugcagcucuaaugcucaagggacacacuucacuuuccccuuaccgagauagucgaccgccaaucguacuggagguuaugaaguguaauacacaguuccaugccuuuaucagucuguauaauugaugcauucagagcuuuaaagcaaaaaaagaaaaaaagccuugggcuaagaaagccuacaccauuuuugcauguacugauguuaacuccaucuuaacagaggucaucucagaacaagcaugaaaccggcucacaugaugcugagcggcagaaugaaggucaaggagugggagaaaucaacauggcaacuucugguaauggucagguaaauaaauuauuuuaucauauuuuuuaaaauuauuuaaauaucagaaaaguaugaagcaagaugguucuaagaaugaucuauaaaucuuaccuauuuucuuaguccugaaugcauauuuccagaagcauucaguaccaaugugcugucauuucucuuuauuauaucagcaauaaugcuguaaggauuuucuagaucuauuucuauagcuauagauuguguguuuauguuuuagucuaaaaugauugugaguaguuuuuuuuaauaacucuaagcugcauuuugauuauguauaugauuugaccuaguuauuuuugcuugccuugaauagguuugcucuuucacuaagaccuucaauguaaagacauuuuuaugguuuuuuuuaaaguuauaaaggcuuuauuuccuguuguacuuaaagauuauauaaaucuagaaauccaagucuuacugaaaaagauaauuguaaugcacacaaaaaaguaaggcaacauggccuaauuaugcuuaauauuaccacaucauuuucagcaaaauuaugaaaguaaacuuuuuuuuuuuacauacagaacuguuauuuguuaugcuaccauccguuaucuuauuagauuuuuauugaaauacagugcaauaggacagaauuuuucuuuaggguguucuguauucuccaaauuuucuucaaugaauauuuuuagaguguaaaugaaugacuuuuuaaaaacagaauuucacuaaauuguucuuaaagguaauuuuucuacuguugauacagaaaauuuucuuagucucucuagguuacuuuugauaguauuguuuuuaagaauaugcuucuauuaguucauuaaaauguaaagcuuaaaaugucuuauuaaguauuuaaauuuauuuuacugaguuaaaacaaacauacuucauucaguauuacuaguuagcauuauauuggaaaacaagugguaaauuaggacaaaggcaaucauguuuaaacagcacauuugaguuauguaucugucuuuuguuuagggaauuaguugcaacauuuauauauuccuacacauauguagaaggaagaaaaauuuaauccuauaugacagaaaaaaauauuuacauaggaauagaucuacucguagugcuuugggucaucuuccaauuauuauguacuuuggaaaccuuaccuauccaguaagcuggcuaugauaaauuggauccauauuacacuuacuacaucaaaauaaauucuaaguagauuagauuuaaugucaaaaugaaaaucauuaaaaauauaaaaagauuagaagaaaauguggguagcguuuuuauaaucaugauguaggugggagacccauaaagaaaggauugauagauuucacguuacagcaugagacuucaguaugccaggaaaucauagcgagauuccaaaacaaacaaccaagaucacauuauuugcaaacauuuaugacguguaaaaaguuaaaauucaagaugcaaaaaacaguauuuauauaccagcuauuuaaagaguaucuuaaaaugguuccaagccaucguagaaguaaaaaaauaaauaauaauuuuaaaaauaaaauuaaaaugggcaaaggauaugaacaggaaauaaaagaagaaauuaaaaugacuuguaaacauggaaagauggucaacuuuacuaaucaugauauauaaauacaaauuaaaacuaaagucagauuucgugggggggccauuuaguuggcaaaaaucaauaacacucaguaauggugagcaaacaggcauucucauauguugcuuuuaauuguaugacaugaaacaggcuuucuggagagcaauuuugucaaaugcaucuagcauuauuuauaaugugccuguugugaagcucaucacuacaacaucuaagauuuuuugcuaaugagauaaucagucaagagugaucagacauguuugaagagauucaucauaauacuaacaauagcaaaaaguuagaaauaaccuaaauggacauugaucguaaaaugguuaaauuauuagucagcuguagauuaguuaaguggcucuggagucaacaaaccugggaaaucacacucccucacuaacuagcuuaguaacaaaaagucucugagcuuuaguguuuccucuuuaguaaaauaagaugaugauaaaaccucuaccucauagaacaguugggagaguuaaaugcaagauacccuuaacacagucccuggcauauugucagagcuuaguaaaagguaaccgauucuguuguuaacaaguguuaauaauuaucuuuaaauuaacaaauaugccagauacuguguuggacucuagaauugauaauugaaaaggacagacaguccuuggccucauggaaccuauauggugcauccaugcaaauauuaaaaaugauaaauuacaucucuauuuauguaaagaucuaauuuuuagccuucaauuguugccuuuucuaguauauccuucauauuauaaucaguuauucuucuaaaacaugaaucugauuauaucacuuauuuguuuaaaccuuucaguggcuacucaccucccauauauuagaauccagauucuucauguugcuuacucuuccaagaguaucucacaauauuugcccacauuucucaccacucccucaacuucaacuucuucaguuccuugaguauguccaggccuuccacaggacauuccuuuggucuaaaacugucuucugcuucaguucauauuauauguuuuacucauccuuccccaccguuuaaaugucacuucuuccuggacauuuuccuugucuccaccuaccuggaauaaauaaaguacucuuugauacgcuguauuccugcucucauagugcuuagcacaauuuaucauugguuuaauugucuuccuuccuucuuaaaguccuuuaagccacaccugcuccucacuguaugccagccaacuaauauguaccuggcagagagcauuuauguugaauauuaauaaauauuauugacuuagguaauuauaacuuuuuuuuuggagacagagucucgcucugucagcaggcuggagugcaauggugggaucucagcucacuauaaccuccaccuccuagguucaagcaauucugccucagccucccgaguagcugggacuacaggugugugccaccacaccaagcuaauuuuuguauuuuuaguagauacagggucucauuguguuggccaggauagucucaaucucuugaccucgugauccucccgccucggccucccaaauugcugggauaacaggcgugagccacugcgcccggccaauuacaacuuuuuuaauuuaaaaauagcaaguaugcugggcaugguggcucacaccuauaaucccaacacuuagggaggccaagcgggaaggauugcuucaggguagaaguucgaguucaaccugggcaacauagggagacuuugccucugcaaaaaaaaauaaaaauuagccgugugugguagucccagcuacuugggaggccgugugggaggaucacuugagccugggaggucaaggcugcagugggcuaugaucaugccacugcauuccagccuggguaacaaggcaaaaaauauuuuuuuuaauuuuuauuuuuugucuaaaaaauaaaaaaaaaaacuuaaaagcaaguaaguaugaucucauuauacauauguauaauguguguauaugcauagagaaaugugugggagaauguucuuuaaacuguuaucaauaguuaucucugaguguugggauuuuuguggguuuuacuuauucuuuugugugucguuuuauuuuuuguaaugaacauguauuacuauaauuuauaacacccaaaacccauuuucauuuugggaaaauagaagaaagcacugucuugauuuccguuguaugguaguuuagguugccauacuucagaguccuaccaugacauacaucaugucauuuaugucaguauagggauggcagaggaaaagaucuauugaaaauaguaaaucagggcccgguauucauuccuccuuuaagugaugaacucugauagugcugugaauucagagguaaacauaaguauguuuguuuagcaguagcaaucauagacuugcccaccauauugguguuuguaugacacuaaugcugcuaauacuaucugguuacuuucagucacuguuuuaaaacaauauugcagcuauucccagauccugauguagaugugugaccuguaucugugggacugugauuuguuauuccaaaaguccuuucaucuaaauaggaucuauacacaugaucgccucuugggguuuauuaguuuguuuuguuuuauuauuugcucaaaagacaaaagccaccaacacuaguugaaaaugaaaaucagucucugacuuucucaggaucacaguagcaugcucugccaaaguucuguccuagaguaauucucuucaccaccacgugggaauguauucuaccgcuucucucaccugguuuccugcccacaaucauucucuuugaaaaauccuucauuggcuucccuugauucuuagaaaaaugauaaccauuuauugugacccagguaaccuggccccuaccuaucuugucagcuuuaugucacaucuugcucucacaccuccacacuggccuucucucaguaccucauauuuacugggccuucuccuaccacagccugugcacaucuauaccuguuccauguaguguuuguuucaucccauuuugcucaguuaacaccaguucaugugugucugagcuuaagcaccaguuucucagagaggcucgaacagaucaaaucucacuaccauaggcugucacagcauguuccucucguuugaagacuacuacauuugcaguuuuacauuaauuugugugaugacuugauuaauauuuguguuucccccacuagacuguaagcuccagaaaggcagggauucuaucuaguuuuguuauuuucauacccacacagucccugauaaauaguagauaacaauaaauaugugguguguguaauaucccugcuaaagaaaggguuucuugaucuguuuuuaaucucucauggaaguuaaauggaaggaaaagcuuaggaguaaauuauacaggccagaucccugcuugcuuagcauauaacuauguguauaauuuauuuauuaguugguucucaacuuuauuuauuuauuuauuuauuuauuuauuuauuuauuuauugagauagggucucacucugucacuguacaccacugcacaguggugcaaucucggcucauugcaaccucugccucccaggcucaagccauucuuccacugucauucuuggauaguugggaccacaggugcacaccacugugccuggcuaauuuuuuaauuuuuuuauagagauaggaucucacuauauuguccaggcugguuuugaauucccaagcucaagcaauccuccagcauuggccucccaaagugcuacgauuggcugggcauggugcucacacauguaaucccagcacuuugggaggcugagaugaguggaucacuugaggucaggaguucgagaccagccuggccaacauggugaaaccccaucucuacuaaaaauacaaaaauuagccaggcaugguggcgugcaucuguaaucccagcuacuugggaggcugaggcaggaaaaucucuugaaccuaggaggcugagguugcagugaguugagauuguaccacugcacucuagccugggugacagagcaagacucuaucucaaggaaaaaaaaaaaaaaaacguaaaaccaaagugcuggaacuacaggcgugcaccaccaugcccagccuguggaaaguguugaccaaauaucuucuguauaucagaguguuucuauggcaauuacaguuugacaguuuacugugguaauuguauuuuagggaguucuggguuuuuguaauuuguuauuuggggaauuuaagaaauuaguuuuuccaguacccuuuauucuuuuuauacguuacauuguuacuugugaaucagccauauauaauuuuuauauaaacaauauuuuuauacuauacaacuuacucuugucauuuaauaauacuuugagauaucuuuuccuaucuauaugugguuuauagauauggaaguuuuuaauccauuuuucuuucacuauuuuuucuuuuuuucaagcaaccuaagcuuuucuauuugaaauuuagaaccaggucucugguaauagccaguauauaauaauaaagcucaauuaaaagugggaaaaagauggaaugauagaaaaacccacucuacugccacugguuuuuaaaacuuuuucuuauggaaaauuuuaaacauuuacaaagacaauaauguagugauucauaucgacauguaaccuauucaccuuaaccucccauuuuauuuuuuaagaagauuccaggcaucaucaucacuucuucccuguuucacuguguauuuacaaaagauaaaaguacuuauuaaaaauacauaacuggccaggugugguggcucacaccuguaaucucagcauuuccagaggccggggugagcggaucacuugaggucaggaguucaagaccagccuggccaacauggugaaacccugucucuacugaaaauacaaaaauuagccagaugugguggcgcacacguguagucccagcuacucgggaagcugaggcaggagaaucacuugaauccaggaggcagagguugcagggagccgagaucgcaccacugcacuccacccugggcaagagagcgagacucugccucaaaaaaauaaaaaaauuaaaaaauaaauaacugcaguggcauuauuacaucuccaaagacucuaacaguaauuguuuaauagcaucauuuauccagucaguauucaaacuugcaguuguuucauaaaugucuuuuucacaguuuauuugccucaggguccagauaagguccaugaauaggaauuaguauaucucugauaucuguucuaaucuguauguuccuucuuuuuguuuuacggccauuuaguuauugaagaacuaaaguuguuuuucuuuuuucuuuaugguuuucugggguuuuguuuuuguuuuuguuuuuuuagucaggaucucacucucgccuggacuagagugcaguggcaaagcucacugcagccuugaacuccugggcuuaagcgauccucucgaguagcuggugcuauaggcacucaccaccaugcccuaggccucccucuguuccccaggcuggucuugaacucaaacugaucucaagcaguccuccugccucagccuccugaguugcugggauuacagguuugagccaucaugccuggcuuccaaauguuuuuuuuauagagugucccauacucuagauuuugcugaugacuccccaugauauacuucaacauguuucuuuaucaucuguauguccuauaaauugguagauuucaguaucugagaauauucaagaaguagaaucagucaagcuuagggauuggauaugaguguuuagggggaaggagaagucgagaauuacucgcagguuucuguuaggcagcuagaaggguagugaugcaauuuaguaauaaugcuagaugagaaggagguuugugagagaaaauaaugagucuaguuuuggaaaaauguuaaguuuaacuuuaaagauguuaggucugagacaucaaagcagaaaugcaccugggugcaguagcucaugccuguaaucccagcacuuugggaagcaaaggcagguggaucacuugaacccaagaguuugagaccagucucagcaacauaaggagacccugucucuacaaaaaauacaaaaaaaaaaaaaaauuaggcgugguggcaugugccugaggucccagcuacuugggagguugagguggcugacccuggaaggucaagacugcaguaagcugaaaucauggcacuguacuccagccuaggcaacagagugagacccugucucaaaaaaauaaaauaaacacacaaaguagaaaugugagguaggcuauuagauuuggaauugagaggaaagguaaagaauugguaauuaaagguauuaaagauuuuuacauccccaaugaguauacagugagaagaugaauaccuagccuaaaauuccaaagcaguagaauaauauuguuacaacaaagagggaacaguuaacaguuuccaccauugccaugaggacuaaaaaaucaccuuggguuucaccaaaaaaaaaaaaaaaaaaguucauugcugaucuugucaaaugcaauuccuugggccuucuuuccuacuauauuauauuggagugaguugaaguuaaauggaagguuaaaaaguagaagagagcagucaggcgugauggcucacgccuguaauccagcacuuugggaggccgagaugggcggaucacgaggucaggagcuuaagaccauccuggccuuggugaaacccugucucuacuaaaaauacaaaaauuagcugggcguggcagcgcgugccuguaaucccagcuacucgggaggcugaggcaggagaaucgcuugaacccaggagggagagguugcagugagcugagauccuuccacugcacuccagccuggugacagagcaagacuccgucucaaaaaaaaaaguagaagagagcaauuuuagcuaacuguaaagaugucuagaugugaacugcccaagagagaaaagaucguuaacugauacagacuauaaguuugagagaaaauuuauuucuguuuuuaagauagaaaagaugaggauguuugaaugcugaugggaaggagccaguagagaagagaguugaagaucccuaagaucaaagagaaauggagagagaaaggauccagagcacaucuaaagggauggaccuuagauaggaggaggggaacucugaugucacagcaaaagguggcgauggauauauacgcagguaauuuuaagguucugguuagcaagaaguugaggaaauuuugucuguuggcuauuuuuucuauaaaguagaagguaaaguuauaugcaguaagagaagaagagccacaguuuuauaugauacaaaaugaggcauaucaaaaauagccaaagaaaggagagcugacaagggaaacaaaaagauggcaguuauagcacggagagucuagguguauuggugaccauaaauguauaucgacagcauccuaaagaguuacguaaguuucucacaugcucaaauuucucuaaugcugccuggcacuucaugucaggguguagagaaaacagacaguuggauucaucugugauugcaauguuuccagacaaaugggguggaauaagugcagggcaaagcuguuaaaagcuagcaagagaauuaugaaagugauaaccacaagaaauccaaccugaaauacaugcuggauuugcuagucauuucaaggaagcaguaucuuacuugcggucaggaguuugagaccagccuggccaacauggugaaacccugucucuacuaaaaauacaaaacuuagccaggagugguggcacaugccuguaaucccagcuacucuggaggcugaagcaggagaaucacuugaaccugggagccagaguugguagugagcugagaucacgccacugcacuccagccugggcaacacagcaaaacuccaucucacacacacacacacaaaaaaagaaccaacaucuuagagaaaguugaagaccaggaaauaaaaggagcaugaaguaaaauguugaggauguauggauauuuauaaagcauugaauguggaugguacaggaaaguuggauaggaaaaaggacagugggaaauagugucucacacauuuggacacugagugucaggaaugauacagcgagugcuucuaucuuuggacaaugagcaaagcugauucaagggaugugcaaucaugacugacuuagcaggucuugagguugugagaaaguucaucacacucaaguuuauucagaauuuaguuuugaguugggugggaaacaauucuuaggaaguuauuaaucauuucuuguggauagggagacucuagucccuccgaaagaaguuggcucaggucuagccuuaauaaaacgcccaagaaagacucucauggaccaaguucuaggcucauagagaauacgaguauguguaccucuugguaucuccuaauaauaaauacaucuaaauuucuacugagacagauuggugaaugaagagugucucaaaauccaggagcuauauaggaagauaacuaagacugaagcuuagaaaagauuuguugucuacacugaaaugaaugucagaaacauguuuuauuguggaaacagguuuucccuuguuucauaauuaaaccuccuguuuucuuuuguuucaaguaguacauuaguuagcuauugcugcauaacaaauugcccccaaaacuuaacagcauuaguagacauuuauauuugcuucuauggaucagaaauccuggugcagcugagcugccugucucugguucagggucucccacaagacuuaaggguauuggcugggguugcagucaucuccacacauaaccaggggaggaucugcuucuaaguucacuuacggcuauugaaggccucagauccucauuggaugucagccagagagacaucaguuccuuguuacaugggccucaccaagggcaguucacagcauaguaacgcuucccucagagggaacaagagaggugcccaagauggaagacacgucuuuguaaccuuaucuugagagugcuucucaucaccucuauagcauuuuauucacuagaagcaagucacuaaaucuagccaagacuaaaggggaagggauuacaaaaacgcgugaauaccaggaggcaaagaucuaucuuagaggcuaccuacaaacaguaaaaauauuuagacaucuuccaagauuguguguuugcuucaggguaaagacucauuucccuucuauagaccaagaaaaagguuccuugucugaauuuacuaaaaaagccccaacuauccuccuuagccugagucucagucccucagaucuauccuuuauuaguuagaaccagaguaagcuccuuauguucagauuuauuuguaguucugccuccccuuccucuccacacacacacaaacacaacuauaccauauucuucugacccuugcuuaugccucugccuuugccugggcugcccuguggcuaaucccccucauucuuuuuauuaacuaaauuacuccucaugguucaaguccaaauucagaugccacuuuuucaggaaccaagacugaauuguguaucuuccuguguguucauauaguuucugucaaagcacuuacccacacguauuuucauguucagcuccucaucuagauuguguguguagugugggugagaaugucuuauucauuuauauuccuggugacuaauauacuaccuggaaaguagcaggggcucaggcaauauuuguugcuugguugcauguggauuuaaagaccauuccagaagcagucaauagcugguggcaguggaaagagauguaagaugagucuuuccuugaugccucuuuucccuucccuaaggaggauuacuaauuaguuuuguccuagaagugucccuagucagcauaaagaguccagacccacaaaggaaguagagacuggaaaggggagccacucuggacucugaacuaguauucucaguccaaccccagacuucccuaugcgaguaugaauaaguggauuaucuugccuuuauauggggacacauuuuuuaaaaccucucaaguuaggauuuuuuaaagaucacuuuuauugaagaaagauuaguaugugauaaaauguacccauuuuaaguguacaguugaaugaguuuugacaaauguaguuuucucuuuaaaaugcugaucuaaaauagcuaauuauugugaacgaugaucuaaaauaguuuugugcacuagucaggaaaaccucaccuuggcuuauaacaugacuuauacagaaguucuaagcagcccucauaaaaauuaacuuuggaguauuaccuauuuaaggacuuuaugaaacaaauuuauaacaaauuugaacaaggaauuuauuacgaauucagaaaucucuguaugagcccuuaauuauugcuugauuaaaauccugacgaaucacuuaggaauacauuguuaacaguuuucuauguugucuaccaaaguggaaguuaucuggcaaacaguuuacguugcuagcuaacagggaagaaaaguuucuaauacgucaccauagcugggcucauuggcucgugccuguagucccggcuacucuggaggcugaggugagaggaucacuugagccaaagaauucagagccagccugggcaacauagugaaaccuugucucuaaaaaaaaaaaaagaaaaaagaaaaaaaaaucaccaaaagugaaauuuaugcacaaaaggaaguuauaagguguguugguuccagaauucuccccuuguacccucuagaguaggaggugccaucucacaguccucaaaaccuauuacucccauugugguuuucucuuuaccuucuucaauuagccagagccuguauaucugaaagacaauucgaaugauguccugcaucuugacauucuuacggauuuuacuaauagcuccucauuuauuuauaauucaacaaauauucuguggauaccuacuaagcuuaagaccacccuugguacuaagaaugcagcagcgaacagaauaaaguuucuguccucaaauaacuuacauuuuagcuuuccauucugcaagguugagaacugcaaaagaaugccugcaaauauugcugacacuauucuuacagucauuuccuuaauuauuaaugaauggauuuagcuguggccuauauuuugauaggucccaguuauuuaucugcaaccccaccuccuguccagaguugcauccuuuguuuucaggugcccauuggggauucuuacuggaugucagauucaaagugagcucaguucccccaaugaaagccaucauuuauuucuggguuuccgauauccauuacgagcaucauuacuuacccauuuauccaagcuugacaccuccaaguuguccucgacucccagccccucuuuacucacauccagucaaguuacucaagccaguuaauuugaccuucaguucaagccaauuaauuugaauauccuucaagagcauccccacuucucuauucucacugccuuaguuugugcccucagaaccacucaacugcugaaaauacccucucccucauuuccuaccugugaucucuccgugcuguuuuuaagacguaauucugauuguaccauucuccugccugaaguccagugacuccacagcuugacagcaacaucuuugaaaugacaugagauacuuaaugauuuaacccaaccuuuaucucuaaccauacaccuuguguucuguccacauuacauuggaacacuccacgcucuccguauuuguaccuuugcacagucuccuccgucagucuccugucacaaaaugccuaccuuaaauguuacugauuuuauacagccucuaauagucccuaugcaguaauuucuuucuuccuguuuucccucaguguuuuguucauucuucuacugcgguguuuauauuauacugcacugcagucauuuauuuuuucaugucuuuguccaguaaaaguuuuaaacagcccuuucuaaacugugagaucuuagagaacuuggacuguagcaaauucauacuuaguuuucuggcaauuuggagcauuucagaauuugaacauuccuucaaugcuuuucaucaaugaacuuaucugaaugugguuuuauuuauuuagaucuaugaaaaauuacuacccuagaauuucuucagucuuugguuaaguccauucugcaguuuaaugcucauaugcaagaaacucucuuuucuuuaguuuuucucuaaaacauacuuaguaagcguauagguaaaaaauauuuugaacaguuauaauggucauacuuuuaugauguauuuaauuguuuaucauacagacacuucauuuggaguaccuuaacaugauguuaucuguauuuaccuauagucuaaauuauaccaucuauaaugugcuuaauuuuuaggguucaacuacacgaauggaccaugaaacagccaguguuuugaguucuaguagcacacacucugcaccucgaaggcugacaagucaucugggaaccaagguaacagaagauuacaaacccuggucacuaaugccaugacuacuuugcuaagacauucuuggccaggugcaguggcucacaccuguaaucccagcauuuugggaggccaaggcagguggaucacuugaggccaggaguucaagaccagccugggcaacguggcaaaaccccaucucuacuaaaaauacaaaaauuuagccagugugguggcacacaccuguggucccagcuacucaggaggcugaggcaugagaauaguuggaacccaggaggcagagguugcagugagcugagauuacaccgcuuucuaguggagaauucugauucacagucucuugaagaaauuacauauuuuuauacaacgaagcauaaacaagggaaaaaucagguuuauaaaaagugccagauuagcuaauuuuuaauucuuuuucagucuuuacauccacuuuucugcaagaauacugaguuccagccaaacuggcucacuuccugcuuccugaacauucccugugacuuucccccucccuuccuugccugcauugguggggaccaccauaaaugucugucagaauccuagccagccuucaaaacucuucuugggcuuugcuuuuucacaaaacauuuucugauucccaagguccucuuaccuccccaugugauccaucugccucauuugaaucacuaacaauuugcaugaaccugucuuuuggaaaucaagaaauguuuuuuuacuuaucuuuugcugugucuaacagagugccugcacaugaguaaauauguauugaggugaauggaaaaauuguugaaguugaguguuauuucaugcugauaagugagcuuucuuagaguaucuuucuuagauguuagcaaauauuuuaggauuugggaauaauguuugaaaagaaaauaguuacuuuaagccggaugugguggcucacaccuguaaucccagaaauuugggaggcugagguggguggaucacuugaggccaggaguucgaaaccagccugaccaacauggugaaaccccgucucuacuaaaaauacaaaauuagccaggcaugguggcacauggcuguaaucccagcuacucgggaggcugaggcaggagaauuguuugaaccugggaggcggagguugcagugagcugagauugugccauugcacuccagccugggcaacaagagcaaaacuccauuucaaaagaaaaaaaaaagaggaaaauauaguuacuuuauuauuuuaaagucagagauuugauuuuauuuuuauuuuauuuauuuauuuauuuuuugagauggagucuugcucuguugcccaggcuguagugcaguggcacgaucuuggcucacugcaacccccaccuccaggguuuaagugauucuccugccucagccucccaaguagcugggauuacaggugcgugccaccaugcccggcuaauuuuuuguauuuuuaguagagaugggguuuugccauguuggccaggcuggucucgaacuccugaucucaggugaugcgcucaucucugccucccaaagugcugggauuagaggcaugagugaccacacccggcccaucagagauuuuaauauucacuaagaugaaaugaaauucuaauauuacuaaacgauguauuuucgauuaacucgaauuccauuaauuguuuucacagcauacucuguauacucuuucuuuacuguaaauaauauaauagcucuugggaaagguauuacugaaauaacuaauguugauuuaaguaaugauuuuagaauaaucaaugauauucucacuaugaggcuuaauccuguuuauacuucuugggaccucauaugccauucacugugccaggaguuguauguaccuuaucucugguccucuccaaaauucuaugaaguauccauauuucucuaaaugagaaaacugaagcaaaaaaaauuuuaggcauggaaauuuaauuccagaucugucuaaccucaacauguaguuuuuacuauaaagaaaaucuugaauauucaagaguaauauugugugaaaacuggcaauuagaauacuguuucuuuuugaaguaauuuaugcaugauaauauuaagacccuaguauguauuuugaaugcuagcuacuguccuauacauguauuauuuuauuucaccuuaauggagaaaaccuuguuagguagguaaauuucuccauuuugcagcucagaaaacugaggcucagagaaaucaaauagcuuaacuauaauaguaucacagcuugcuccuaagagguggagccaaaauuugaaccuagcuccgaugaaaacccauuuauccgcaguccuauacugccuuccuaaaacuuucauaucuaaagguguauguguauuuacgcaucuaaagcagcauuucuaaaccucagcacuauuggcuggauaauucuuuguugcauucuagaauguauaguaacgucccuggucucuccccacuagauuccccuaaaauacccauccuacaauugugacaaccaaaaaugucuccaagauguugucaaaugugucccgaugggggcaaaauugcccccaguugagaaccauugacuuauagagaaugaugcauucuuuauauaauagccucuacuuuuauauaauacccucuagcguuaaaaugaguggaccauggcccaggauaacugggugccacuuuccgguuucuaaucugcuucuaacuaaauacguagaauuuauugucagagaguaauuaguacuuaccaguugcuuuuuaaaaaacugacuacaaauccuggcucucacucuguaugaucauggcauuuuccuuuuuaugacaaaauguuuuuaaauuuauaaucguauaauuuuaauaauauuaucaucugacgagaauuaaugauugcugagaauuaguacuuaaaauuguugcagaaauguuuucuguuuauugcuuauagguauagauuaaaagaaauaagauaaaguuuuaaauuauguaaagauuuagauaaacuacauucucuaugugugugaaauccguuguuuuucacugauuauagucaguggauuagcaccaacuuaucuaggcaaacagcacuaacaguuuguuagugaguaugcaaaaaccuacuuuugcuuuuaauacuguauauuaccacucauacuauuuacucacauaaacaaauuggugaugauacauagauuuugaaauaacacugauuacuucauccuggaaagguuuuccgguuuuuuguuuuuuuuuuggcgggggggguuguuuuguuuuuuuagaguuauaguaaauaucccauucaucacuuaauugguuuuuggcuuuuggauauuaaagucguaauuuuguuucuaaacucauuuggcccacagguggaaaugguguauucauuguugucaaugcuugguacucaugauaaggaugauaugucgcgaacuuugcuagcuaugucuagcucccaagacagcuguauauccaugcgacagucuggaugucuuccucuccucauccagcuuuuacauggcaaugacaaagacucuguauuguugggaaauucccggggcaguaaagaggcucgggccagggccagugcagcacuccacaacaucauucacucacagccugaugacaagagaggcaggcgugaaauccgaguccuucaucuuuuggaacagauacgcgcuuacugugaaaccuguugggaguggcaggaagcucaugaaccaggcauggaccaggacaaaaauccaaguauguucucuauaguguacaucguagugcauguuucaaagcaaaugugaaauuuuuaaacagaaaacauguuuaguuaauaugcugucuuuaugacuaagaggagaaaauucauaucagccauuugugcuacucauauuuaaaagauuaagucuguauuucccuagaaaaauuuagcaaaggaaaauguuaugugcacuacuauaagaacaguaagucaagagaaauuuauacaaucauagcauaguagggccuuaguagagcuagaaagaacuugagcaauuauguugcccaucuuucacuucauagcugaagcucauuucauagaugaaagugacuuuacguaaguuccuauagccauuaguguccaaaccauaaucuuuuacauuugcauaucauuauauucaggggauacagagcagcguuacaucuguuauguuauuugcuccucacaucaaccuacugaaguaggaagggaagguauuaucaucuccauuuuacagaugaaaaaacugaggcucagaagagcuaaaggacuuaaccauggccucacaccuaguaagugguagacccaggaacagagcccagaucuccugacucucagcucggugcucuuccuacuguaccauccagcuguagacagugggccucaguugcugggagugauaauccacccagcucuucacucaggaagggacccuuagaccucagccccacucccgcaggagcagcaugggaguuaggaccuauggggauauaacuuauuucauuccuguagccaagaaccaaaagcaguaaguauguaagguaagaccuuccuuucaccugauaagaacugacacacacacacacacacacacacacacacacacgugcacuacaaguagaugauucuacuguaucagccuauugaugugaagaggagaugauacaaacaugacuuaugaaccuauagcagauuuuuuuaagcuuagguaugaaggugaauuuauuugaaaucuaaaaauguucaaggauaagaaaggccagguguggugguucaugccuguaauggcagcacuuugggaggcugagacaggaggauugcuuaagcccaggaguuaaagaccagcugggcagcacagugagacacuaucucauuuuuaaaaaauuuaaaaagcauaagaaaaaagggauugccuuucauaucuauuuguccuggggugaggggaacuaguaagauuuuacugggagaacauugccuuccuggauuguuucuuuggcuauccacaguuacguaaugacccacauuuuguacuccugauauuuguucucaaaaaauuaaauagaauaaaaugauacuucuuuugagaaguuuuuuaaaaacuuacgucaaaugaguuuugaaaccucgugcauaguauugaauguggagguacauuuucuuagucacccuuuuaaaaaauaucuguuuacugucuaguauaucuguguaacuuuuuguauuagagaucacauuuguacauagccacaugcuuuuuuucucuguuuguauugagacagggucucacacaagcgcccagacuguaaugcaguggugcgaucacaguucacugcagccucaaccucccaggcucaagcacuccuccuaccucagccuccugagaguaucugggacuacaagcaugugccaccacaacugacuaauuuuuuuuuuuuuuuuuuuugagagacgggguuuugccauguuucccaggcuggucuugaacuccuugggcucaaggaucugcucacuucagccucccaaagugcugggauuacuggugugagccacugcaccuagcaccaugugcuuuuaacccacacucaugauaguaguuuaaauagaaauuauaaacugggcuaagcacgguggcucgugccuauaauucuagcacuaugggaggcccgggcaggagcggcacuugaggccaggaguuugagacuacccugggcaacauagcaagacccuaucucuacaaaaaauuuuaaaaauuagcuagggauugugggguaugccuguaguccuagcugcuccggaagcugaggcaggaaggucaauugagcccaggaauacaaggcugcggugaaagcuaugaucauuccacucgagccugggcaacagagcaagacccuguuuuguuuuuuuuuuguuguuuuuuuaaagaaagaaagaaauuauaaacaaaauuaaaccauuuuauaccaaaauauuuuuauuauuuuguauacucaacauaauuuuaaguuauuagcuauaugaguaauagcauaaaccuccuagacuuauucuaagagacuuagucaagggcagaugagugguaaacauuuuuauggaaacaaaucccuuuauuccuauuuuuuguuccacauuuguaguauuuauucauccuuucagcaaauauuuguugauccacuaaaauuccgugaauuaggguuauauuagugaucccugcauauuuuuaaaguacaauaaacaucauugcucuucaaauaacaaagcauuaugguuuauguugauuuuauuuuucagugccagcuccuguugaacaucagaucuguccugcuguguguguucuaaugaaacuuucauuugaugaagagcauagacaugcaaugaaugaacuagguaagacaaaaauguuuuuuaaugacauagacaauuacugguggauuuuuaaaucaugguagaaauucaguauaguaaauaaagauuuuuaaucauugaugaauuaggauauaaggccaccaacuucuguuaucagcugcuuccucuguguagcaaaaaauuguacccugguuuccagcauagaaaggauccugaaucacagaaacugcuacccugucauaagcuaacuuuuucaaaaucgaagccggagauugaaaaaaaaugacaaaaugggucacucuuugucccuuuugccaaaguagacucuauaugugccagcugaugaggaugguaauuugaauuauuuugaaauguggagcugcuguauugugauugaacucagucacuuuugaugagcaucagagggaauuauuauuaagauugucauuuaucuucaugguuauugguacuuuacaggauuuucaucauaagcagccugguaucuuugaaauugguuaauauagaaaaguauuaugcuuuaagucagaaacauuucauuauaacuuuggaaugauuacuucuuuagguauguauuuucacacacuaagccuuauauaaccagcagugcacuccauuuuuuauguaaugguuuuucuuugauuucuagguucauuuuguacaugugguauuuauaaauugcaucaugcugaaccaucucaugugaacuggaucucucuagucaugccacaagcaagaaccauacgcuuaauucccauuuuaguguaauugugcccuugcuuuuugugccguuuauguuacauuauguuccagccaccacuuuauauuccuauccccucaucguuucauucgucauuuaucuuaaaagugaugaagucaugagacucuuacacagagaaccugaacagccaaaaguauugucuccuucagagucaucacuuugggaggcucugcaccuuaagauuucaggccugcccucuggccaugcuuuccuuccuagugguguagcaauuggccuaccugauucucuuuccucccccuggucuccuguggauucucaguuaaucuuaugaauucuccccucguuaauacaaucucagcauuugugaacauuuuaaauuuuuuaaaaugcuaaucauaacaggaaggggauaaaaaauaaugaauaaacaggaaaacauucaguuuuaagauaccucaaaaguuauucuguaaauguuccuguauuccaauggauuguagacuaggacugagacauuaaucaucuggauuucaaaauaaaaccuagacucaguauuuguuccucuuccuucuucagguaggaaggcuacccggggcauuucaucacaggagcuagggcaggggcuuucaggugaggagcaggauggggccucugggggugugacugcuggggacauagccacaggggauuaccuucuucucacuccucaccuccagauuugcacuggggcaaaaggaggauuaggguguguggauugcggggagauaauaguacaagacagcacaagguuuuggcaguaagggauaaggagaaaagaaaucccaaauagguaaaggggaauuccuuaguucagucagcugggauggucauuuguacauauaugaagauucuacagcuaucagucauuuaaguuugcacuuauuaguauuagaaguuuuagaauauaauuuccaugauauauguuuauugauucccuaaucuaccccagaaacugugcuaggcacuagauuuuuauaaugauuaagaccugguccuggcuuucagggaacucacaguuuauuugcauuaguguuucacaaaauaccuaaaucauaaugaucacccagaggcacucgucaaacuggauuuucuggcacuguagcaaacagaaucuccaggggaagggccuaggaaucaaugugauaaguggccuggcugauucuuauguucgggaaauuuugugaaacaccaguagaauauucuuguugagccugugauauuuauuuuagaacaaggcauuucaugcuaauggugacuaucuaaaccaaauaaaacaaaagcaauaugcuuuuuaaaauuaucagucuuucuuuuguucauaagagucuaaauuaaggauucuguugaaugucaccugagucuguuggugcucuacuaucgguaguuuuacccuauugggcaauaguccggucuauuuagaccacuguuuucuaacaggcaccaagaaaauuguagaaggacauguucaucaucuuugcauuaccaugaaacauccugauuuuucuuagagcaaccaguuuuuaauuguaucaauccagucaugaauuugcauauuuuagcaaauccauuuauagguuuaaccuaugaauucuauucugugccucaaaauucucugaaaucuuuucauuugccugaaaucaaaaagcacuuccucuuuuaucugauagucuaaauuuuuuugaauguucuuuuuuuauuagccauguucuuccugaaucuguugauaucugccacauucuuauuuaaucuuuauuuucaguaucaaauccuaagauuuuuaguuuuuccauacaagaguacucaacucuuugaucauguagugccuucuuggcaucuucuuuaggugcauuuuaucuuucuuaagaaaguaucccaguuauugucacaccaggcaagauuuuauacagacaaaaggcauaguuuguuuuguuuugguauugauccucugcuuuaaaauacucgacaucuuggggaucucauuaguauaccaggccaagucuuaaggucuucccugucaauuucaugggucaaaauucucaguucuuuuacaggcuccuuuucuuuuacccaaguguaaaaugguggaauuccuugaagcucugcccuaggcucuuuuccuuucucucuaugcuucuguuauaguuuuuguuuuuguuuucaaauuuacagcucaauuugaguuuuuucccugaguuuuagacacauuauugaacugacuaugugacaucuucccuuaggugguauuuuagacacuucuaacucaacugucacaaacugaauucguaaucuuucccaucccugaaucucuuaucuuuucccaguuuccuuuucucagaaauuccaauccaguugcucaaauuucaaaaucuuggaaaucauucacgaugccauccuuauccccugcaaauagcaacugacugcuuuaauucugcuacuuaaaaguaucuuaugucaucacucuucucuucauccccaguccaagccaccaucgucucuccuguucuacaauacuuugucuuacuucucuucccauuuccacucauagucgauuuuguucacugaaaccauaguaaucuguuuagagugugcaucuaauuauuccuuuuucugcguaaaaucuuuaauguggcacauaaagucuuaugugauccggcaucuacccauguuuauagccucauuuuguggcccucuccuugcuguuaaauauuucaggcccaggggcccuuucacaugcuguuuccuuugcuuagaacgcaucuuucuucuuccugccccacccuuguuagauacgcauucaucuggccagaccugauggcucaugccuguaaucccagcacuuugggaggccgaggcaggagaaucacuugaaccuaggaguucgcaaccagcucgggcaacauaguggcacccugucucuaccaaaauaaaaauaaaaagaaagauacacauucauccuuuacguuucaacuuaaacauuaaaagauuauuuccucagccuuuuucuuauggagccuaaucccaggucuaaguuaaguccaccuauuauaucacccugugguucuacauaguucaucuaucuuugcuccaaucuguacgcucuucauaaagacagugacugauuuuuguucacugucucuguauuuugccacuguugcaggugaauggaggaaaauuuuccuaaauaugauuuggauuuucuuuaaccaaauuaauuuucacuuaccuacauucaaacaugucugucauuccugcuaguaauaaaguuuugcauaaaucuuccuacauuuaaaucccuuggcuuggaauucuugacccacgacagaacuuuguuuuacaaacuugcagauucuucugcauauugaacuucccagaucacuuauuaaaaauauuaacguacuggcugucuugcagaugaaugaccuaauuagacuuguaguauccaagaauugccuguuuauauucaucuuuuucuuucugagucccgugaugauuaauauuugaugaauuauauuuugaauagccuccacaugcauuuuucucuuuuguucacuuccucaccauuuugcuucacuuuuuuuuuaacugcuuccuuugugucuuucccauuccuuuaccuuuguuuucuccuugacuuccuauuguuggccauugugggcauuguuuagcauuuucaguggaaagaaucaggggaaagaaaauacuaaaucuuaguauaguuaauauuugauauuaucaacgagaaguaagaaauguuuugaaaaacacaaaucaguaguuuuauauaacuuaauaaauugaacagaugaucauuuuuuguaaaaaaaaaaaaaaacaaaacuuuuuaguuuuucuucaugcacaguuucauuuaaaggcauccguauuccuaaggguaauuauuugccaaaaaaaaaaaauuaaaguaguuaggccacaguguaugacaauaaagaguguuuauaaagcccuaauaauaauaauaaguuaccuuuuucugcuuauguucacgaagaacuaguguuagaaaauagccuucuucacuguuggcaaggugcaguguauaugcaguaaauagaaaauaauuauuucgcucagcaagauaaggggcuggggguggagaaacuggcauaaaauggaauaauugucaguuguacuuuauaaauauauuauacagaaguucuuuauaacaguuuuuguagcuuauaauucuaaaggcaaauuuaaaccauauauucucauugauugaguuuuuuuuuccuaguauuuaaguuaccaacuugguaccaguuuguuuuauuuuagaugauugucuuuuuccucuugcccuuuuuaaauuagggggacuacaggccauugcagaauuauugcaaguggacugugaaauguaugggcuuacuaaugaccacuacaguauuacacuaagacgauaugcuggaauggcuuugacaaacuugacuuuuggagauguagccaacaagguauguuuuuauaacauguauuucuuaagauagcucagguaugaguuaauuuacuuucauacaaauacauuuuacugauuuucuuuuuuuucacucuccucauuaaacaaugacugauaaaaaccugugcuucacauucgcuuaucuuuacucauuuguuugucuuaugccuaaacaaaggcaaagguacaucuacagauggaacacaguagugaauuuauguaauugcauuaaaaacaccauucauaagaauauacuuguagggaucauuucugugauccauuacuagagaaguuuaacuguguagaauuaaaaaauaaaagauaaaacacuuccuaggaaugggauuaaaaaucuaaaaauucuuaagaccaaggcaaguguuacacacacauugauuccauccaaauaagaggcuuuacucuaaaaccuguugcuuaucauuucucaccacuuauucacuuuauuucucuaguuugacaaaggaagaacagauagcaaagaauuaggagaauauuugucuuuuauuuagguaaucuuauucuagauuuuuuaugagugaaguaucaguuaugauuaaaacaaaauaaugaaaacugaauuagacauuuaguagccaaaaauaaagcuuggcuucaaguugucuuuuuaaugauccucuauucuguauuuaauuuacaggcuacgcuaugcucuaugaaaggcugcaugagagcacuuguggcccaacuaaaaucugaaagugaagacuuacagcagguacuauuuagaauuucaccuguuuuucuuuuuucucuuuuucuuugaggcagggucucacucugucacccaggcuuagagggcaguugugcaaucucagcucacugcaaccucugccuccaggguucaagcaauccucccacuucagccucucgaggcugggccuacaggugcacaccaccaugccaaacgaauuuuuguauuuuuuauagagacgggguuucaccacaccugggcucaagcaaucugcccaccucagcaucucaaaaugcugggauuacaggcgugugccaccacacccagcuaauauccugauuuagauuguugcucaguauuuaguaucucauguauaaaagauaguuccauuaacacuagaaaaagaaaaauaauuauauugugguuagacuguaggaaaucuuuuuggcacuguaguagcauuuaggaggaauuuaaaaaaaaaaaaaaaaacaggaucucccucucuugcccaggcuggagugcaguggugcgauuauggcucacaguaaccucaagcuccugggauccuccugcuucagccucccaaguagcuagaacuacugcaggcgcaugccaccaugcccagcuaauuuuuaaaaaguuuucauagagacagggucucacuguguuacccagaaggucuugaacuccuggucucaggagauccuccugccucagccucccaaagugauaggauuacaggcgugagucaccacggcuagccagaauuucuuucuuaauagauuucuauucuuacugcuagcauuaaaaacaaaaaagcaacuaguaugauuuuauguauaaauuaaucuaaaauugauuaauuugcagguuauugcgaguguuuugaggaauuugucuuggcgagcagauguaaauaguaaaaagacguugcgagaaguuggaagugugaaagcauugauggaaugugcuuuagaaguuaaaaagguaccuuugaaaacauuuaguacuauaauaugaauuucauguuuggcuuuuuuuugcugccuucuuuuagccaugagauuuccuaauuucuuaccuguguauuauucaguacuauaauaugaauuucauguuuagcuuuuuuugcugccuucuuuuagccaugagauucccuaauuucuuuuuugagauggggucucuuucucucgcccaggcuggagugcaguggucugaucuuggcucacugcaaccuccgucucccauguucaagugauucuccugccucagccuccugaguagcugggauuacagugcacgccaccacucccggcuauuuguauuuuuaguagagaugggguuucaccauguugguaaggcuggucucgaacuacuccugacuuugugaucugcccaacucggccucccaaagugcugggauuauaggcgcaagccaucacgcccagccuagauucccuaauuucuuaccuguuuaucucaccaguccauaguuuuagaguaccgcaaacuccuaaaguacuaagguagaaaagauuauauaaggggauuuaauguauaucaggguuucucugccucagcacuauagacauuuuugaccagauaauucuucguuuugcuggggcugaccugugcacuguagauuguuuagcagcaucccuggccuuugccaacuggcugccaguauacccucccccuaguuaugccgaucaaaauugucuccagauacugucagaugucugugggagggaggaaggacaacgucaccaccaauuaagaaucacugguauaaguguaccuuugugcucuccaaaccucaauccccucaaauuuugauggucaacuuaucaagaggugaucagagccaagggugaggaaucaucaaauaauaauuuguuuacagaaggaaauaucuccaggcaguccaucugcuucagaaacuaggcuaaauuuaaaaagaaaaaaaaaaguaaacuugaaaucugagagggaccaagcaaguugucuuagcuagucuagguuuccuuucacccagcuaguccuccuauacccacagccuacauguucuucuucaaaacuuuccucuucagagaaggcaaaagguuuguuuuuuuuugguuuaguuaugcauuuuugguaaaguauauuauuuuguucuuggaaaacccuugaaaauuuauuagauagaaaagcauucagcuaaauuauuaguuauaaagauaauauucaaauauacuuagcaucugcauaaaaauaccuguaucacuguugaauggagagaagacauuuaagaaaagaacauggccgauaagcccuugaaaagauacuuaauaucauuaaucaucagggaauacaaauuaaaacuacaaugagauaccauuaugcauaucauauugguuaaaauuuaaaagauugaccaugcauuuucaaggauguugagcagcuggaaaucauguauucugcuagugggaauauaaaaugguauaaucacuuuggacaacauuuggcaguguuuuuaaguuaaacauacaccugccauaugacccaaccauuccacuucuaaguauuuacccaagaggagcaaaagugcugacacgaagacuuacacacaaacauccacaauaauuuaugauagucaaaaacuagaaauaacuaugucugucagcaggugaaugguaagcaaauuguggaauauuuguacaaaguaauaggauucggcugugaaaaagaaugacuauugauacaugcaguaaucuguaaugacagaaaacagauuagugguggccugggguugggaguagaagagaaggggaggauuaugagaggguaggaaacuuuuggggaugauauaaauguuuguuaucuugauuggacuggcaguuuuauggguguauacauguaugaaaaauuaucaaauuguaaacuugaaaugugugcaguuuacuguucuucaauuauauuucaauaaaguucaaaaaaauuagugcuugcacacuuaaguacuccuacucuaauaacccuguguaguuucagaaggauuuaauguguguguguauuaugagaauuugcacugcugcuaacugguucaugacuuaauucucucucaaggaccuaaacucuucuauaaauuuuuuuuuuuuuugagauggagucuugcucugcugccaggcuggagugcaguggcaggaucucggcuaacugcaaccuccaacucccugguucaagcgauuauccugccucagccucccaaguagcugggauuauaggcaugcgccaccaugcccagcuaguuuuuguauuuuuaguagagacgggguuucaccauguuggccaggauggucuucaucuccugaccucaugacccgccugccuuggccuuccaaagugcugggauuacaggcaugauauaaugcauggucaaucuuggaaaaacuagcugucagaaauuuauaauauccaguucugauuugggccuaauucugguuagcaguauuagaauuuauuuauuuuuucccucuuuuucuacauuuagugcagcagucaugaacauucuucuucucuuuuucauucaauaucaauucccucucaacuucagcuacuaaugagcaagagaaucagaacuaccuucuagcuccccugcauguuccacaucacuuuaacucacucagagcucuuacucuagagcuuuccuuuaccagcacucuguacuccguucacuuaaagcuguuggucccuuacucuugucuucuacauauucucuacuggauccuucuuuuuuauguuucaguucucuagaagaagcccaauguuuugaaaaacaaaaauuuucuguggcuucuauuacaguguuucucuuuuccaguaacaaccaaaacccugaacaaugguuuugaccaaauaccuuuguguaucagaguguuucuggggcaguuacaauuugacaguugacuuugacuugcuucauuucuaaacuggcuguacuaucuugaguuccuccuaauuuugcuucugacacaacccuucuccuugaucauagaaucuagauuuguagauuuauuuaaguuuuucuauucuaccuucaccuguauuuuauacuuuuuggucacucacuuuugcuguuacuacuuguauuaauaaccucuaauuauuuauuuugugucuucuaauuugaacuauaaaaacauuuuugaaacaaaaccucuggcccuugacauguagccccacagagaggaacuuuuguauuuuucuaccuucaacucucaacucugggccaguugcaucuuaauucaguccuuuaaauucuugcuuuuuuuguucucaggauacuuggagugccccaccuuuaucucagucacaauguaauuaaaauugggcucaucuugauugaugugagaaggacaaaggcacuucuugcauaaaagcacucuaucugccuccuaccacuuaugugacaaauuaugucuaaaccugcuccuagauuguuuuguucacuuaauuucuugaugaagagaguaaaguagcuauuuauuggguuagacccaaaauguuugcugugacauucaaggccuggcuuuugucucucuggacuuauuuuccacuguuccccaucauggacugugaucuccuuugcaucuucuuucugggucaucaguacucccgcgcugauucccacuucccugccuuuccucauucuacuuccccugccagcagcaacuggauucucuucucugggaauguacaggucuaauccuccuaaagagcuguucuccuccaugaaauauuugauugauuugauuaaauucaggguguaauaguuuuuucuuuggagcacuuuguuucauguauauuuuuguaucuuuuuuuccccccaaagcaaauugcuaacaccuucaaucacugguaucaguuugcuauguuugcauccucuagagugccucucauugcaauaggcacagaguugauuucuaauuaauguuuguuuccugauggauauauaguaagaagacagauugacaucaccaucaugccaaguuuuggguuuggguuuuuuuuuuuugcuuuugcuuuugcuuuugcuuuuuugagacagggucucacucugccacacagccuugaccuccugggcucaagcuagccucccgccucagcuucucaaguagcuggaccuauaggugugcaccaccaugccuggcuaauuuuuuuuuuuuuuuuuuuugagaccgagucucgcucugucaccuaggcuggaguauaguggcgcaaucucggcucacugcaaccucugccucccugguucaagcgauuccccugccucagccucccaaguagcuaggauuacaggugcccaccaccacaccgggcuaauuuuuuguauuuuaguagagacaggguuucaccauguugaucaggauggucucgaucuccugaccucgugauccgugcaccuuggccccucaaagugcugggauuacaggcaugagccauugcgccuggccgccuggcuacuuuuuauauuuuuuguagagauuggguauugcuguguugcccaggcugguuuuuaacuccuaggcuuaagugauccacccaccucagccucccaaagugcugggccugaaggcaugagccaccacacccagcacauggcaaguuuugaccaaauaccuuuaauuguguaucagaguguuucuguggccauuacaauuugacaguugacuuugauaauuguauguuagggaguuccagguuuucauaauuuguuauguggggaauuuuaagaaauuauagcuuuucuaguacccuuuauuguuuuuauaaauuacauuguuaauuuugaaucaaccacuuguauauaaugcuuuuuauauaaacagaauauuguauauacuacacugcaacuugcucuugucauuuaauaauacuuccaagauaucuuuccauaucuauguaugguuuacagaauuuuaaaaaucuacuuucuuuuuuuuuugagacagggucucacugucaaccaggcuugagugcaguggcgcgaucauggcuuacugcagccuugaccucccaggcgcaagugauccucccaagcagcugugacugcaggcgcgugccaccauacccagcucauuuuuuuuuuauuuuuuguacagacgggauuucaccauguuguccaggcuggucucaaauuccuaaacucccagucacgccagucagccuuccaaagugcugggauuacaggcaugagccaccacguugcgccuuuuuuuuuuuuuuuuuuuuuuaaaaagaguuucgcucugucagccaggcuagaaugcaguguugcagucucggcucacugcgaccucugccucccagguucaagcgauucucccaccucagccucccaaguagcugggauuacaggcaccugccaugaagcccggcuaauuuuuuuuuguauuuuuguagagacgggguuuuaccacauuggcgaggcuggucuugaacuccugaccucagaugauccacccgucagccucccaaagugcugggauuacaggcaugagccacugugcccggccacaugccgggccuuaauccacuuccuguucacuuuuuuuuuucuuuuuucaagcaaccccagccugagaauaacccacauucuauucugaaaauguuuucuuuucauaaugcacaucaguugugccucauauucuaagauguguguacuaucuaaacacuuagaauaaaguuuauaaaagucauuaguuaaauauuguguucugcuuguuuuauagagauaucacugauauaaauacuauuugguauuuuaugaacauuuuucuaaauggaaaguucuuaauuuaccagugagggacgggcaauaggauagauuaaaaaauagcuuuuauucaauaucaguaacauagaaguuaaugagagacaaauuccaacucuaauuagaugacccauauucuguuucuuacuaggaaucaacccucaaaagcguauugagugccuuauggaauuugucagcacauugcacugagaauaaagcugauauaugugcuguagauggugcacuugcauuuuugguuggcacucuuacuuaccggagccagacaaacacuuuagccauuauugaaaguggaggugggauauuacggaauguguccagcuugauagcuacaaaugaggaccacagguauauauagaguuuuauauuacuuuuaaaguacagaauucauacucucaaaaagaccuaauuguaagcaauguuuuauauaaucaugaaaguuuuaagccaaaauauauuuauuacugugaaaagauaacuacuaacucuuaguuuaacucauuaguguacuuaauguaauaacaguuuauaguauuauagaggagacuaaauuaagcaaauuauaguugagagguguagcccauagguggaggaaaaaauagucacaaauauuguaacaaaauaauccauuucuauuaguauaguauaaaagaguaugaaaacaaaauuuagaacaagacaaaaacuaugagcgugauccagagaauauaaagguucacauuuuucuaaugaugucuuaguauccauaauaauaauuuuuuuuuuuuuuuuuugagacagggucucacucugucucccagacuggagggcaguguugugaucuuggcucacugcaaccuccaccuccuggguucaagcgauucucccaccucagcuucccaacaagcugggacuacagaugcacgccacaacacccggcuaauuuuucuauuuuuugguagagaugggguuucacaauguuguccagcugcucuugaacuccuggccuccagugacccaccugucucagccucccuaagugcugggauuacaggugugagccaccgcgcccggccaauaaucauaauauuauuuagcuaacagccauucauccaaucugcuagaguuguaaaacccaagagagugcuucagauacagggcacacauuuucagaacucggaugcuguauuauaucaacaaaaauacaacugucuuuuuuuuuuuuuuuuuuuuuuuuuucuugagauggagucuugcacucuugcccgggcuggaguacaguggcacaaucuuugcucacugcaaccucugccuuugggguucaagcgauucuccugccucagccucccgaguagcugggauuacagguccccccccccccccgccaccgugcccggcuaauuuuuauauuuuuaguagagacggggcuucaccauguuggccaggcuggccuugaacuccugaccuuaggugauccgcccaccucggccucccaaagugcugggauuauaggcaugggcuacugcgccuagccaaaaauaugguuguuuuuuauagcuuauucauuuuuuaagucugugaugcagaaacuacaagccuagucucccuuucugcuauacagagaagauuucuuaaguccaguaacuacuggacugcuaagagaagacgaccauguuaaagcucauuauguacccuugccauucaguuuuaaagcccacuaaagcugaauaugcugucauuaaucuucaguuugccugcguuaaacaagcuguugcucuuucauguccagaguucauuaugcugauucucacuccuuguuuuuauaugccuuaaauguuucaaaaacuuuaauuuacuugauuuuuuaaaaauaauaagcacacagucugccaaagagcaguuuuucuuuucuuuuuuuucuuuuuuuugagauggagucucacucuguuguccagguuggagugcaguggugugaucucggcucacugcaaccucugccucccaagugauucuccuggcucagccuccugaguagcugggacuacaggcaugcacuaccaugcccggcuaauuuuuguauuuuuaguagagacaggguuucaccauguuggccaggcuggucuugaucuccuaaucucaggugauccgccugccucagccuccuaaagugcugggauuacaggcaugagccacugugucuggccaagagcacucguaagaaggauggcaguaucacaaaaucaagccagagauacagagauuacucuaaaaaguaaguguucuaaucuaagagcuuauaaugugcacugacugcagaaaaaucuucaaucaauucuaucuaccucuuccaagauaacucaauaucaauaucagaguggcacccaaccauagauuaaauuaccacaaaguuccuauucaacauaggauuucaugauauaguuuuuaaauugggaaacuguuauaugaauagaguaaauguaugugccccacccccugcaaauguuuuaagcuauugggucagaauaggaaauguagaauugacaaaaaauaacaccuuuacuuuuuuuagugugacagauuaguacuuuaaaacauuaaacauuacaugaaauuagaacaaaaggagauguggaauacuuggaauuuauaggauaauugguacaaucauauuaugccuuuugucuucuauccuuuuauuuguuguuacugcauacacauugugaccuuaauuuugugaucucuugauuuuauuucaggcaaauccuaagagagaacaacugucuacaaacuuuauuacaacacuuaaaaucucauaguuugacaauagucaguaaugcauguggaacuuuguggaaucucucagcaagaaauccuaaagaccaggaagcauuaugggacaugggggcaguuagcaugcucaagaaccucauucauucaaagcacaaaaugauugcuaugggaagugcugcagcuuuaaggaaucucauggcaaauaggccugcgaaguacaaggaugccaauauuaugucuccuggcucaagcuugccaucucuucauguuaggaaacaaaaagcccuagaagcagaauuagaugcucagcacuuaucagaaacuuuugacaauauagacaauuuaagucccaaggcaucucaucguaguaagcagagacacaagcaaagucucuauggugauuauguuuuugacaccaaucgacaugaugauaauaggucagacaauuuuaauacuggcaacaugacuguccuuucaccauauuugaauacuacaguguuacccagcuccucuucaucaagaggaagcuuagauaguucucguucugaaaaagauagaaguuuggagagagaacgcggaauuggucuaggcaacuaccauccagcaacagaaaauccaggaacuucuucaaagcgagguuugcagaucuccaccacugcagcccagauugccaaagucauggaagaagugucagccauucauaccucucaggaagacagaaguucugggucuaccacugaauuacauugugugacagaugagagaaaugcacuuagaagaagcucugcugcccauacacauucaaacacuuacaauuucacuaagucggaaaauucaaauaggacauguucuaugccuuaugccaaauuagaauacaagagaucuucaaaugauaguuuaaauagugucaguaguagugaugguuaugguaaaagaggucaaaugaaacccucgauugaauccuauucugaagaugaugaaaguaaguuuugcaguuauggucaauacccagccgaccuagcccauaaaauacauagugcaaaucauauggaugauaaugauggagaacuagauacaccaauaaauuauagucuuaaauauucagaugagcaguugaacucuggaaggcaaaguccuucacagaaugaaagaugggcaagacccaaacacauaauagaagaugaaauaaaacaaagugagcaaagacaaucaaggaaucaaaguacaacuuauccuguuuauacugagagcacugaugauaaacaccucaaguuccaaccacauuuuggacagcaggaauguguuucuccauacaggucacggggagccaaugguucagaaacaaaucgaguggguucuaaucauggaauuaaucaaaauguaagccagucuuugugucaagaagaugacuaugaagaugauaagccuaccaauuauagugaacguuacucugaagaagaacagcaugaagaagaagagagaccaacaaauuauagcauaaaauauaaugaagagaaacgucauguggaucagccuauugauuauaguuuaaaauaugccacagauauuccuucaucacagaaacagucauuuucauucucaaagaguucaucuggacaaagcaguaaaaccgaacauaugucuucaagcagugagaauacguccacaccuucaucuaaugccaagaggcagaaucagcuccauccaaguucugcacagaguagaaguggucagccucaaaaggcugccacuugcaaaguuucuucuauuaaccaagaaacaauacagacuuauuguguagaagauacuccaauauguuuuucaagauguaguucauuaucaucuuugucaucagcugaagaugaaauaggauguaaucagacgacacaggaagcagauucugcuaauacccugcaaauagcagaaauaaaagaaaagauuggaacuaggucagcugaagauccugugagcgaaguuccagcagugucacagcacccuagaaccaaauccagcagacugcaggguucuaguuuaucuucagaaucagccaggcacaaagcuguugaauuuucuucaggagcgaaaucucccuccaaaaguggugcucagacacccaaaaguccaccugaacacuauguucaggagaccccacucauguuuagcagauguacuucugucaguucacuugauaguuuugagagucguucgauugccagcuccguucagagugaaccaugcaguggaaugguaaguggcauuauaagccccagugaucuuccagauagcccuggacaaaccaugccaccaagcagaaguaaaacaccuccaccaccuccucaaacagcucaaaccaagcgagaaguaccuaaaaauaaagcaccuacugcugaaaagagagagaguggaccuaagcaagcugcaguaaaugcugcaguucagaggguccagguucuuccagaugcugauacuuuauuacauuuugccacggaaaguacuccagauggauuuucuuguucauccagccugagugcucugagccucgaugagccauuuauacagaaagauguggaauuaagaauaaugccuccaguucaggaaaaugacaaugggaaugaaacagaaucagagcagccuaaagaaucaaaugaaaaccaagagaaagaggcagaaaaaacuauugauucugaaaaggaccuauuagaugauucagaugaugaugauauugaaauacuagaagaauguauuauuucugccaugccaacaaagucaucacguaaagcaaaaaagccagcccagacugcuucaaaauuaccuccaccuguggcaaggaaaccaagucagcugccuguguacaaacuucuaccaucacaaaacagguugcaaccccaaaagcauguuaguuuuacaccgggggaugauaugccacggguguauuguguugaagggacaccuauaaacuuuuccacagcuacaucucuaagugaucuaacaaucgaauccccuccaaaugaguuagcugcuggagaaggaguuagaggaggggcacagucaggugaauuugaaaaacgagauaccauuccuacagaaggcagaaguacagaugaggcucaaggaggaaaaaccucaucuguaaccauaccugaauuggaugacaauaaagcagaggaaggugauauucuugcagaaugcauuaauucugcuaugcccaaagggaaaagucacaagccuuuccgugugaaaaagauaauggaccagguccagcaagcaucugcgucuucuucugcacccaacaaaaaucaguuagaugguaagaaaaagaaaccaacuucaccaguaaaaccuauaccacaaaauacugaauauaggacacguguaagaaaaaaugcagacucaaaaaauaauuuaaaugcugagagaguuuucucagacaacaaagauucaaagaaacagaauuugaaaaauaauuccaaggucuucaaugauaagcucccaaauaaugaagauagagucagaggaaguuuugcuuuugauucaccucaucauuacacgccuauugaaggaacuccuuacuguuuuucacgaaaugauucuuugaguucucuagauuuugaugaugaugauguugaccuuuccagggaaaaggcugaauuaagaaaggcaaaagaaaauaaggaaucagaggcuaaaguuaccagccacacagaacuaaccuccaaccaacaaucagcuaauaagacacaagcuauugcaaagcagccaauaaaucgaggucagccuaaacccauacuucagaaacaauccacuuuuccccagucauccaaagacauaccagacagaggggcagcaacugaugaaaaguuacagaauuuugcuauugaaaauacuccgguuugcuuuucucauaauuccucucugaguucucucagugacauugaccaagaaaacaacaauaaagaaaaugaaccuaucaaagagacugagcccccugacucacagggagaaccaaguaaaccucaagcaucaggcuaugcuccuaaaucauuucauguugaagauaccccaguuuguuucucaagaaacaguucucucaguucucuuaguauugacucugaagaugaccuguugcaggaauguauaagcuccgcaaugccaaaaaagaaaaagccuucaagacucaagggugauaaugaaaaacauagucccagaaauauggguggcauauuaggugaagaucugacacuugauuugaaagauauacagagaccagauucagaacauggucuauccccugauucagaaaauuuugauuggaaagcuauucaggaaggugcaaauuccauaguaaguaguuuacaucaagcugcugcugcugcauguuuaucuagacaagcuucgucugauucagauuccauccuuucccugaaaucaggaaucucucugggaucaccauuucaucuuacaccugaucaagaagaaaaacccuuuacaaguaauaaaggcccacgaauucuaaaaccaggggagaaaaguacauuggaaacuaaaaagauagaaucugaaaguaaaggaaucaaaggaggaaaaaaaguuuauaaaaguuugauuacuggaaaaguucgaucuaauucagaaauuucaggccaaaugaaacagccccuucaagcaaacaugccuucaaucucucgaggcaggacaaugauucauauuccaggaguucgaaauagcuccucaaguacaaguccuguuucuaaaaaaggcccaccccuuaagacuccagccuccaaaagcccuagugaaggucaaacagccaccacuucuccuagaggagccaagccaucugugaaaucagaauuaagcccuguugccaggcagacaucccaaauaggugggucaaguaaagcaccuucuagaucaggaucuagagauucgaccccuucaagaccugcccagcaaccauuaaguagaccuauacagucuccuggccgaaacucaauuuccccugguagaaauggaauaaguccuccuaacaaauuaucucaacuuccaaggacaucauccccuaguacugcuucaacuaaguccucagguucuggaaaaaugucauauacaucuccagguagacagaugagccaacagaaccuuaccaaacaaacagguuuauccaagaaugccaguaguauuccaagaagugagucugccuccaaaggacuaaaucagaugaauaaugguaauggagccaauaaaaagguagaacuuucuagaaugucuucaacuaaaucaaguggaagugaaucugauagaucagaaagaccuguauuaguacgccagucaacuuucaucaaagaagcuccaagcccaaccuuaagaagaaaauuggaggaaucugcuucauuugaaucucuuucuccaucaucuagaccagcuucucccacuaggucccaggcacaaacuccaguuuuaaguccuucccuuccugauaugucucuauccacacauucgucuguucaggcugguggauggcgaaaacucccaccuaaucucagucccacuauagaguauaaugauggaagaccagcaaagcgccaugauauugcacggucucauucugaaaguccuucuagacuuccaaucaauaggucaggaaccuggaaacgugagcacagcaaacauucaucaucccuuccucgaguaagcacuuggagaagaacuggaaguucaucuucaauucuuucugcuucaucagaauccagugaaaaagcaaaaagugaggaugaaaaacaugugaacucuauuucaggaaccaaacaaaguaaagaaaaccaaguauccgcaaaaggaacauggagaaaaauaaaagaaaaugaauuuucucccacaaauaguacuucucagaccguuuccucaggugcuacaaauggugcugaaucaaagacucuaauuuaucaaauggcaccugcuguuucuaaaacagaggauguuugggugagaauugaggacugucccauuaacaauccuagaucuggaagaucucccacagguaauacucccccggugauugacaguguuucagaaaaggcaaauccaaacauuaaagauucaaaagauaaucaggcaaaacaaaauguggguaauggcaguguucccaugcguaccguggguuuggaaaaucgccugaacuccuuuauucagguggaugccccugaccaaaaaggaacugagauaaaaccaggacaaaauaauccugucccuguaucagagacuaaugaaaguucuauaguggaacguaccccauucaguucuagcagcucaagcaaacacaguucaccuagugggacuguugcugccagagugacuccuuuuaauuacaacccaagcccuaggaaaagcagcgcagauagcacuucagcucggccaucucagaucccaacuccagugaauaacaacacaaagaagcgagauuccaaaacugacagcacagaauccaguggaacccaaaguccuaagcgccauucugggucuuaccuugugacaucuguuuaaaagagaggaagaaugaaacuaagaaaauucuauguuaauuacaacugcuauauagacauuuuguuucaaaugaaacuuuaaaagacugaaaaauuuuguaaauagguuugauucuuguuagaggguuuuuguucuggaagccauauuugauaguauacuuugucuucacuggucuuauuuugggaggcacucuugaugguuaggaaaaaaauaguaaagccaaguauguuuguacaguauguuuuacauguauuuaaaguagcaucccaucccaacuuccuuuaauuauugcuugucuuaaaauaaugaacacuacagauagaaaauaugauauauugcuguuaucaaucauuucuagauuauaaacugacuaaacuuacaucagggaaaaauugguauuuaugcaaaaaaaaauguuuuuguccuugugaguccaucuaacaucauaauuaaucauguggcugugaaauucacaguaauaugguucccgaugaacaaguuuacccagccugcuuugcuuuacugcaugaaugaaacugaugguucaauuucagaaguaaugauuaacaguuauguggucacaugaugugcauagagauagcuacaguguaauaauuuacacuauuuugugcuccaaacaaaacaaaaaucuguguaacuguaaaacauugaaugaaacuauuuuaccugaacuagauuuuaucugaaaguagguagaauuuuugcuaugcuguaauuuguuguauauucugguauuugaggugagauggcugcucuuuuauuaaugagacaugaauugugucucaacagaaacuaaaugaacauuucagaauaaauuauugcuguauguaaacuguuacugaaauugguauuuguuugaagggucuuguuucacauuuguauuaauaauuguuuaaaaugccucuuuuaaaagcuuauauaaauuuuuuucuucagcuucuaugcauuaagaguaaaauuccucuuacuguaauaaaaacaauugaagaagacuguugccacuuaaccauuccaugcguuggcacuuaucuauuccugaaauuucuuuuaugugauuagcucaucuugauuuuuaauauuuuuccacuuaaacuuuuuuuucuuacuccacuggagcucaguaaaaguaaauucauguaauagcaaugcaagcagccuagcacagacuaagcauugagcauaauaggcccacauaauuuccucuuucuuaauauuauagaauucuguacuugaaauugauucuuagacauugcagucucuucgaggcuuuacaguguaaacugucuugccccuucaucuucuuguugcaacugggucugacaugaacacuuuuuaucacccuguauguuagggcaagaucucagcagugaaguauaaucagcacuuugccaugcucagaaaauucaaaucacauggaacuuuagagguagauuuaauacgauuaagauauucagaaguauauuuuagaaucccugccuguuaaggaaacuuuauuugugguagguacaguucugggguacauguuaaguguccccuuauacaguggagggaagucuuccuuccugaaggaaaauaaacugacacuuauuaacuaagauaauuuacuuaauauaucuucccugauuuguuuuaaaagaucagagggugacugaugauacaugcauacauauuuguugaauaaaugaaaauuuauuuuuagugauaagauucauacacucuguauuuggggagggaaaaccuuuuuaagcaugguggggcacucagauaggagugaauacaccuaccuggugccuugaaaaucacaucaaguaguuaauuaucuaccccuuaccuguguuuauaacuuccagguaaugagaaugauuuuuuuuaaagcuaaaaugccaguaaauaaaagugcuaugacuugagcuaagauauuugacuccaaugccuguacugugucuacugcaccacuuuguaaacacuucaauuuacuaucuuugaaaugauugaccuuuaaauuuuugccaaauguuaucugaaauugucuaugaauaccaucuacuucuguuguuuucccaggcuuccauaaacaauggagauacaugcauauaggucauacugguuuccuuucauuuuuugauuuucuauuucuaauuuucugaauuacugcaugccaguuguugcaaaccacuucaaguacuucuauggaaagagauggauguuagucaauuagauaaacuugccuuuuaauucaaauaaggaagaaaauauaaaugcugaaaaugaacauuccacaugccagaaaaguggaauuuuuguaggcaacacuugaguggggggagacgggccagucuauacuacccauugaaguaaagacugcuggaugaggcccucuguuagagauagugguucugaauuaguaaaggggcaaaucucaauucuaauuauagauguucacagggugcugcuauaaucgauagcaggccaaauauucccaguuuaugcuuguuaacaaauggcauacuaagcccagcguugggaauuagucaggaguuacgaugccuguuuagagaggagugggggagggagaguuaccuaacguaaggcacuucaaaggagugcguugggaucaccaggagugcuuaacaagacauagcugggccauacccccaguuugauucaggauguuuggaauggggccuaagaacuugcauaucuaacaaguucaaaggugaggcuaaugcugcuggucuggagaccacacuuuuugagaauuacugcccuaagaucacagugaagcuccuugagugguugccuucagcucuagcgauuccucccaacaacuggacccuuaaucugacaaaguauagcaacagauaaaagacuuccccuaggcauaaaagauuucaauauuaagccauccaauuucauaaugcucaucucaacuccugacagcagacaaacuuagccagacaugaacaaacaaguaauucuaaagacagugauuauauuugaaggaucaguuaauguucccuuugagacugucauuauaaaaagcaguaacuucagcaaagaucuaauuugaauuuucaauaagauuaaaagacuaugaaaagggaacuuugagaugagagaagguugauuucagaugaaaauauccaguuuuuuaauauacaguggaagugaucaauaauuagcaaauaagauauuugaggacaacuuuacagauuaccaggguaaugaaaaggaaguaaucaaagauaagccccauaaggaucaaauagcacuguaaguacaguaaaauguuucuugauuaaaauauggaucauguugccacagguuaauuacaugaaagaaugaaucucuugcagaggaugggagccaguugcacaauaucugaauauauguuaucccaggguuucuuggaaucuaaggaaaaaagcagagcaccagaaaugcaaaaaguaaauugcccauaguuaaaggaacaucugaguagucagaucauuaaaauuuaugaaacaauuauuuuucacaagucaugguggcugaaauagaguguauaauuuuuuuccuuucaaauaagcguauuuuccucauauuacacugacuuaaaauuuaaaaauuacuuuguaauguugaaaccuauagacuguggcuccuguaaaccccaggucauuuuccugccauucuuacaacucugucuaagaucuauaaaaguauauucugcuuuuuguuaggccauucaugcuuuuuucaaccuguacauucuauguauauaauauuguucuuggugcuaaauacacuuucuuuuaucugauauucaggauaauucuuucucuacauuugugacuauccacuuauuuucucgaauaauuaaaaauauucaacauaaugua

SEQ ID NO: 21553 - RNA, 16095 nt, Homo sapiens
gugcugaaugaauguuaacuaugcuuuuauuacaugcaucaucaugcccauuucccucuccuuucauaaauaggaaacuagcaagaauuaacauuccuagaaaggcgaaagguacaaaaaauaccgacuuaguuuauuggauaaaaacagugguaaaauggacauaaagccaaaagugagaacagaacauuuucauauccuccccacacuugaaaacauacuucccaucaucugggauucagguguuagggagccagagccccuuccaaaucucucucucuucaucuucccuggaagcaaggggaggaagaagucagaacccaggggaggaggaagucagaggcaaucucaguccuugucuacccguucaucccucaaaaaucucuggguucgagggaagcagggaagaaauaaggggcaaggggggcuagggacuggccuccagggcccacugccaauaaugucccagauagcuauccuugucuguaucucaucccuaauagguaccauugucaggccuugggagagagaggaaaagcagguagaugguucgagaaccaaauguggucuccagacucuuucccagagucagcaaaagcccuggggugacccccaggacucuaggagccacuccuuuucccuccagcccaaccaagaggugaaaagaaauuccuugggacacagcaucccaagccacucuuaaaucuccacaucgcuuuccuugucauugucauggucuccaucauagaacucauugggugccucuggccugcaaagcaaggggagagaggucaggaucucacucuaaguucuaaucuucucccagcacccuuuuccaaagccauuucucaggccccguugagaaccacuccuccucuuguugguagagacugcuauucauucacccauucacguaucaaauaaacauuaaggaacuacucuauacagacacugucauaaaccuuagcaauacaguagaguaacaagcuggacaagguugucuauccucaaaaagcuuaccuaauaaaugagacuaguaacuaacaaaguaaauaaauauaauaauuucagaugauggagaguacaauuaauaaaaugaagugauaggacugaaggugaugagaggaaaagggugaaauuucagacaggacuauugggacauaagaccuaaagucugaggaggagcuaagcaggcaaagacuucaggaaggccauuccaagcugcaagaaaaccaacuacagaggucaugaaauggaaagagacugauguauuccaguaagaacaaggaggccaggacagccgggagcacugugcauggaggagaguaguuagagaugagauccuggauguagguaagggcuagcaugcaggaccuuuuuaagccacagucaaaauuuuggauuuucuucuaagugcaagguaaaggagaguuuuaauuuuaagaagagugacgugguauuauaaacccauagugaaagaauggaugugaaagcaaaacagggcccaacagguacucaauauugguuucuuucuuuuugaaaaaguauucucaaaagccgggcgugguagcucacaccuguaaucccagcacuuugggaggccaaggcagguggaucacaaggucaagagaucaagaccauccuggccaacauggugaaaccccgucucuacuaaaaauacuaaaguuagccgggugugguggcacaugccuguaaucucagcuacugaggaggcugaggcaggagaaucgcuugaaccugggaggcggagguugcagugagccgggauuagccacugcacuccagccuggcaacagagugagacuccaucucaaaaaaaaaaaagaaagaaaagaaaaaguauucucugggacacagagaauugagaaagucaucaaagagaagcugaggcacuaagccaggaaaggccuuaucugcauggugagcaaugucucaguuacuucuaagugcacaggguuaaagguguggagucagagaaucagguugaaucucagcccugaucuuuaacuagccaugugaccuucagaaaguuacuuaagucucgccgggggcgguggcucacaccuguagccuguaauccuagcacuuugggaggccgaggcaggcagaucaccugaggucaggaguucgagaccagccugacuaacauggagaaaccccaucucuucuaaaaauacaaaaaaaauuagccaggcguggaggcucaugccuguaauccagcuacuugggaggcuaaggcaggagaaucgcuugaacccgggaggcagagguuguggugagcugagaucaugccauugcacuccagccugggcaaaaagagcgaaacuccgucucaaaaaaaagaaagaaagaaaguuacuuagacucucugagccuuagauuccucccguguuaaucugaaaauaagagccaucagaguugucugauggcaacagaaugaucauauauauguuguaauagauagcacuuaguagugucuggugcuuggcaaaccuacaaaaagugguaacucuuccuauuucuacucugcaagucauaugcaagcuggagcuauaggcaucaaagaagaacagaaacucaguggguggccugacagagagguagggcuuaggaacaggaagaggccugaggcuucugcuggcugugacagggcuugguauuauuauaaugcagagacuagguccagaugccagccuggagcuauugauaaaaaacccaaaaggaagaacuuaaaaacagguuuuaccaaaccaaaccagacaaugaaaagcaauuuccaauaguccuggaagcccugaagccagacacuuccagauguucagacacuuccucacucagaagggaucgggggauauccuuggaggaagagaguugcagagauccccaagagucagagcaguaaagcccagguccagaggagagauucggaggccugaauucuaagacagaagcagauucuagaaggggcugagaagcccaucaggcucugcagcagagccggcucaaaccucuaacccugcgugggagcaagacagcgugucccacaaguguccagcugugguuaucccucagucauguaaggaaaucuguuccccauuaagugcaucuguuucugcacuucuugguucuguugucuuucccuuucauuuuucagcaaaguuuugggauuaaaaaaaaauuccauccuauccuuuuuccccccuaauucauuccaucuacaaauauuuuguauguaucucagaaagauaaagacuuuuaaaaaaaaaaaaaaaacauaaccacaaugcaauuaucccacccgaaaaaauuaacagagcaaagaaaucaaagagccuuagagaguauuacgcaggcagugaccuguccagcucaagaccuggaaagacugagaaaaaugcuggcaagacuauagggugcuacagacuuucuggacggcaauuuggcagcaaauauaaaaaauuuuaggccaggcucaguggcucacgccuauaaucccagcacuuuggaaggcuggggcaggaggacauuugagcccaggaguuugagaccagccugggcaacaaggcaagacuccgucucuaccaaaaaaaaaaaaaaaaaaaaaaaaaaaaaaaaaaauuagccaggugucguggugcacaccuaugauuccagcuacucgaggggcugaggcaggaggaucgcuugaacccaggaguucaagauugcagugagcuauaaucaugccacuguacuccagccugggugacagaaugagacccugucucaaaaaaaaaaaaaaaaaaaaaauuaaugcacacagccuuugaccuagcagcaaccauucuacuaucuaacccacucaaacaagaaugcaaagauguauaauguaaggggguucauugccacauuauuauuguaauaccaaaaaaauggaaaauaaucuauccacauaguaaauuauuauacagcugauaaaauacugaagcagaucuauauuagcuagcugaaaacagcuauaugauguaaagcagcauacguagaaugacccuauuuguauuuacgaaaaaccaaaaaccacacaaacuguaaaugaguguauauguguuuguuuauauguacauacagaauaguauauuugcaaucuauagaaaaaggucuauccaaaacaauaaaaacuauuaacagugguuacuccuguggaauaggucugggauugugugaacgccaacaccauauuuuggugcuguuuuaaaauuuugcaauaaauacguguuacuuuugucauuaaaaauaacaaagaaaagagugaggaaauuguagcagacuaaaggagguaagccagaggcaauuaaacuaauaccuucccauuuacuuuuucccuuuuaaaccuccccagcaagccuauugaaaguaggcugaagucccugcucccagaccugcuauaguucuccucaggaccccucuccucugcaucagccucaucaguccugucauaggucaggaggucugcaggcacgucaugaaucuggacacuaggugcaugguucagcaucuucagguuuucaaagauugucuggcggaucugguccagauacugguuggaaaugaggaauacagagugagcaguuuccagagauucccaggacauggaaucuccuagcugccuuuuaccccuaccauacugguuuucaucucagugguaccucuaguucaggucccccaacugauagcucucccuccccaccaaccccaacugccucuacuuuaaacuggacugccuccuagucaauaacagugacugugauggcuuagaacuuccuucucuuugguuuuuccuacuucccacaucuuugaccucuccugggcuccaccuuucaggagaaguuugugcucagcuuuucugagcugcugaccuggcgugaguucugauucucgaugcgggugcugacaucuggaugaagugugaagucuggggcaaaguacucgaaguauucuuggggaggagaggagaaaguauggcucagacugagaaaggcagcuaacaagacuucccaaucuuuuuccuucccauccagagcaccuacauaauagcugcccaaucucuucccugcucugagcccagggguuuagucugcagagcucugagaguguaaaauuucccaugugccuucaaaccaggucauucuggaaucuggugagaauggccuuccuguuauggggguguuguggggugguccuuaccacuauagggaagcuccucacuaauggccucuucuaccagcagcgaugucucauauguccugaaaccaaccagcagaggggagcaggcugaccaagugggcugaaggacccauguggccauaucugagggacacccuagcucacacuggacaacaggggaggaaaucaggagagugcucaccagcagcgggcaacauuucggacaguauaaccaccaccacccagcacgaguagagggauauugaagcucuugacauauucaacgcauucccuguuaaaaggaaccagaggaagauguggaggagguuaucaaaagacaagguaaauaccuuuagguauugccugaaaggagcacaagaaaacuauaaauguucuaaaucuuuaucuugauagugaaauucauuauguuauacccuuaagauuuggguauacuuuauaugcugugucucaauaaaaauuuuaaaauaaagcacaguccccccucuguucugcucaacacccucccuggcacccugccugcuaaucaacuauucucaucaacccaaguucugucaauucuagccuugaaaauauaacucacgcccggcgcggugcucacgccuuuguaguagucccagcuacucaggaggcugaggcaggagaaaugcuugaacccaggaggcagagcuugcacugagccaagaucgugccacugcacuccagccugggugacagagcaagacuccaucucaaaaaagaaaaaaaaaaacauauauauguguguguguguguguauauauauauauauacacacacacacacacacaccucucagaucaucuacuucucuccauugccacccccuccaccuuagucugggcaccuaaccaacaccauggcuuccuaacuggucuuucuacuuccaucuccauccccccuacccaaaccuuucucuauucagcagucagaauugucacuuucaaacacaaauuggaucaugucacuuuccugcuuaaaauccuucaaugguuucccaucaucuuuggaauauaauucaaacuccuuaccaggguuuaaaggcucugcacaaucucaccauggccagcuucucggaccucaccucaacagacugaaguccaguggcacaaucauaguucacuguaaccucaaacuccuaggcucaagugauccuccugccucagcuuccugaguagcuaggacuauaggcaugcaccaucaugcccagcugauuuuguuuuuuauuuucuguagagauggcucucacuauguugcccaggcuggccucaaacuccuagccucaggcgauucucccaccuuggccucuggaaguguugggauuauaggugugugccacugggcccagcccucagagccuuuugugggccuuuguccaugcuugggucaggcuucucucugcuccucuuaugacucacuccuucuuagucuccaggucucaacucaaauuuuacuuccucagaaaaacuuuccgaaaccaugcuaucucaaguaggucccccauuguauccugugucucagcuuucuuuuuuucuuucacagaauuuauaagaaucuauuuauuucauuugauuauuuauuuuuugucuguuuccuaaacuguaaacuccaugggagacuccuuauuccauccccaugaugugguaugaugccuggaacauaacaggugcuuaauaaaaauauaucgugaaugaaugaccaucuagggaacccuguucaagaugacauuucuaguucaaguacaauuuguagcuauuuuugauuuccaagaagaggugaggcccauuccccaacuacccccacccacguacugaaguccaaggccacuuaaaaaccuuggggagaagaaggagagcaagucucacccaugcccucggaugcugagguuaaagcagcccaaucgaucacagcccagagagucagcuccacacugcaaaaagcaaaaccccaggaaagugcagugaucagaacugaucagaacaucacagauaccccuuccaccaccaaccuaaagaaccuccucuucccuugcucucuuuccccaagcccaggcagaacacuccugaggaggaacugacaguauuaccuggagcacaaugcacguggguugguagaaguccacuaccugguugauaaccggcuggaaaaggugcuuguaaccugggagagggccaaagaugggcaccuggcaccccaaggggauggggagacagggaacaaaaggaaaaaggggguugagcgagcauguagcccaggaaaggggccacccaaaagaaucaaaucacuggucugaaacuucuggaagggaucccagacugcuaugagugacugaugaaagccaaugacuuuucccagaaaaaugcacauacacaugauauguugcauacaauuuccagagauucauggucccucugaaggccauucauccuuaaggacaacuggcccaacagcagacaauaccaggcagaagagguuauuucaaggagaaaaagaaggggccuagggaacagagggaagacuucgguacuuacucuggucaucaaugccaucccgcaggggcacguucagacaguaguagcggccacucucugccccgacuucauacaugucaccuguagggaaguggguggugguagccacacaugggaagcacccacaacccagcuguuucagccccaaucugcacucugggagccucucauuccaucuauguagcuucaccauaaacucccuagagccacuaaaucucuugcagcuugcauucauugggcaaauaguuuugggggauccacucugagccaacuguguacuaggcaguagggaugcagcaacgaauggaacuaaugaaauuuacgauaucccaccacgcuuauauucuuagggaauagccaugaggaggagggaggcaguaaacaaaacaaaacaaaaaaccacaauaaacacaaauagcagugaguguucugagggaaacaaugaggcugauguaacagaggaauggggaaggaggugauuaugauaacuggagugguaaggaaaggcuucucugaggaggggacaccugagaugagacuagaaggcugagaaggaggcacucauaguaaagagcugaagggugcaaaggggaaaguaaucccuauucccauaccugugccagggaagaaguaauuuccguauuuguggaaggacaccgucaugacccggucagugagguagaaagcuucuugaaccccgucaccaugguggaugucaaugucaauguagagcacccgagggugguaccuagagggaagccaaagccagggucugagcuagaagugaaccccccaacccacuccucucaaacaccgggucucgaauugugaagagucugcuucugcccuggucaccugaaacuuaaugucaccaguucccuaaaggcaacugggggcuccagccuagaggcuagaggcagggacaggagagggauaugcagagaaggcugaaaugugagcaggcaguagggaaucugcagcaguggaagaggcagccugaauaaagcaucaagaacuugggagaagcuaaucagggaggagggaggucaaggucaggguugagacugagagaccuccucagccaagaaucccguaacugcccccaucuccuccugggcuacuuacuugagcagcuccaggaugccaaucacaaugucguugacauagcagaagccagaggccuauggcaagacaguggucucauaaagagaagagcaauuccccucccagcugccccccaccaucauccuaaacaccuacccuaggauggccacugucuuucccaucaccuccucacucaccucaaacuucuuggcauggugcagaccaccagcccaguuaauggcaauaucacagaucugaaagacaaacaccuaagucacaguccuuccugcccaccccucaagcugggagcccaggaucaggguuaaaucccgaguccagggauccagaggaaaggaagaacaggacucgggacuaugucaccuuguuguucagcuggguugcuccuugcagagaugcgccuguguaacgcgagcagaacucaaagagcccgggaaacacugggcugcagggaagaggaacaaguuggaacccuccugccucugucugggcccuucccauaucucccuccccauccuagauuccuccaaucuccauuuuucaagaaccuucucucccucuccuacacacgugggcuaucugcaaauuuauucaacaaauauuuuggaccaaaccauguaccaagcccugugcaaggcacuggaugggaaguaaagaagcacuuaacugucagggaguuuguauccuagcugcggaaagaagcaagcagcuuccagguacucaaguacaauguaaaaaggaaaucaguugaaagaaaacaugagcucuguuuuucuuagucuucucaguguaacaaauuuuagcauaauguucaauaauauuuuucagucacauauuuuaaagaaagaacuguauaccuacauaugugaaacagugaugagauaacccacgaaaagccuguagcacaguauacaguauccgcucagccuuuaauaaaugucagcuauaauuauuaccauuguuauucuuuauaaaaaguaaaggcuugaagccagacacaaaagccuacuuacuguaugacuccauuuauguaacauucuggaaaagguaaaauacaaggacagacaucuuaucaguaguuggcuggaucuagguugcagagaaguuauuaacuacaaaagggugagugaccuuuguuggguaguggaaauuuccuguaccuugauaccuuuuuuuuuuuuuuuuuuguagagacagggucucacuauguugcccaagcuggucucaaacuccugggccuaagugauccucccgccuuggccucccaaauuguugggacuacaggugugagccaucggcgcuggcccuauaccuugauauauucuaucaaaccucucagaacucuuacaccuaaaaaagguuaauuuuacuguaugcaaguuauaccuauauaaaccugacuuuuuaaaaaggaaaggcuuaggcaaucccuaguuuuaggucucaaaaaaaaaaaauagugcagcugauacauuugaccaugugaaaaacagaacuguagggguuuuuuguuuguuuguuuuuugagauggggucuugcucugucgcccaggcuggggugcaauggugcgaucucggcucacugcagccuccgccucccggguucaagcaagaauuguaggguuuuauaguuucucaaaaggcuuggaaagaauuagugauuaauaccagaaaacuaagcaaaugaaaaaauaaugcaauugucagcuccaggaaaaacaaaaagcuuuagaagaaaauagauuaaaucacacuacacuauuuggcuugauaguaaaugaaucuuucagaguuauaauaauguaaacacagaauacugauuuauuuuuaaauuacuaugaagcugaaaggggaaaggaagccaaugugaugguguaagaagacuaaaugcucauaucccauacuaaaagcuuaacagauaaugccuaaaauugacagaugaagaaauagcaaugagagacaauacaggaggggaguaugauuacaagcaccgauucuggagcuagacuaccuagguucuuuaacaccuacuaaugauagugagguuguacaaacuguuuaaccuuucugugcuuaaguguccucaucgguaaaaggaaacaauaauagacccugcuucauagggguuguugagauuaaauaagcuaauggcuguaaagcacuuagaacaguaccuaguauauaacagguauuaccuaaggauuacagauuaguaauaacagucaauuaauauuauuauuuagaaauccaaagguaaauaccagaagacauaggggaaaggagcugaaaguggcugucacugggcagagggauuuaugggugaaaaggagaggucuggaauuuuuuuuuuuuuuuuuuuuuaagacagagucucacucuguugcccaggcuggagugcaguggugcaaucucaggucacugcaaccuccaacucccggguucaagcaauucuccugccucagccuccuggaguagcugggacuacaggcacgugccaccacacaugacuaauuuuuguauuuuuaguagagaugggguuucaccauguuggccaggcuggucuugaacuccugaccuuaggugguccacccgccucggccuccgaaagugcugggauuacaggcgugagccacugcgcccggcuugggacuacuuuuuuauuuuuuucauuuaaaggccuauaguacaauuuggcuacuuauguuagaauacuuugaaaccaaucagaaauucauuaaacagaagaaaaauuccugauucucaucggaaauacagauaagcacaacuguaacuuguuugacaggaagacugaugcagcauaaauagcccagagauaguauucuaauuagcauucccuaaucgcacaaagagcaucuacgggaccccaguguggcguaagggcugacccuguauucacagagcuagaaagugagcucagaaauaacagcaggaauacuaacaaaaaaacaagaaaccuccccaaacagcaugugacugaacaccaaaugagcagugcagugugugcaagacagagcucuaugggcugguguggucaagaaagguuucauggagauggugugaaggcugagaaggccuugaagagguugaauagagaacuaagggcauuccaggaaggcauccugugcagcugagguguagggauaaaguuggaaaggugccaaugccagccuaaugaguuggccucuauccuacagcccuggcugcuucugucauuaagaucuuucaggaaaacagauuagugguuuaaaaacccgggaucuggaucaugcccccuccaaugaccaguuaugugacuacggcuaaguuaccuagauauucccaaaccucaauuuacuuauauauaacaucagaaaaaggucuauuauaauacaucuaaggauugguaugagaauuaaguggauuuaccagcaacccuuggcauaauaccuagcagaguaagcacucaguaaaugguagcuaucauaagaaauucuacaggaucaacaaccugguuucuucaagaaauaaauucaagggggugacagaaaagcuacaaauuaaaagucuuaagagacauaucaaccaaaugcacuguauagaccuuguuuagaucuggauuuaaauuagcuacaaaauaauuaugagacaacugcagaaauuugaauauugaucccauauuugaugacauuaaggaaucacuguuaacuuuuuagguuugauaaugauacuauguuuuuuuaaaagaguaucauuuagagauacauaauaaaauauuuauggauaaaaggauauaacaucuaggaucugcuuuaaaacaaucuaacaugagggaguauagaugaaguaagaguggccacuugcucagcugggugcgauggcucacgucuguaaucccagcacuuuuggaggcugaggcugguggaucaccugaggucaggaguucaaaaccagccugaccaacauagugaaaccccaucucuacuaaacauacaaaaauuagccaggcaugguggcaggcgccuguaaucccagcuacucgggagucugaggcaugagaaucgcuugaacccaggaggcagagguugcagugagccaagacugcaccacugcacuccagccugggcuacagagugagacucugucucaaaaaaaaaaaaaaaaaaaaaaagaguggccauuugcucauaagcguugaagcuaggugauggacguaugggaggucacugcacuacuucacuuucagaaauuuuugaaauuuucccuaauaaaaaguuuaaaaacaaaaguaaguagaauugagcaacugguagcugugaugguuacuauuuuuucauggauauagaguagaguguggcuuaucuuuguuguccacucucuuccccagagggucuaacccugacucuucuauggaugauacaagcucaauguaaaccuaaugauaucaaaccacuccuucguuguuuuuuuuguuuuuuuaacugcccauagcccucuuaagaucccuugcuuuuuaaaacacuuugauagcuucccucuacucuacggguaaaaaccccaauucauaauagagcuguuugcuuuuaaaagguccuauuucuuuagccucaauucaguucaccuccucuucauacucugcacuuggccuuuuuucuguuccucaaaugagucauacucaguccuaccacagacccuuagcacuugucccuacugccugcuauacuucuccccucacccuccaaccaucuuucaucugauuacuucuacucuuuuuucagaucucagcucaaucuuuacuuccucuaggaaggccccaccgaccagccacuccaccaagcuaaacaauccuccacguauacacucucauaaucugucauacaccuccucuuuauaagacuuagcaaaaauacgauauuaaaauuuuguuuuuguucaucacugcauucccagcacuuagcacagggccugccuagaacaagugaccaauaaauauuuauugaauaaacaaauaaaaugaauuaugaugcauugacaaguaggccccccuugagaucuucccacugcugccaaaagaccucacugaagggcuuggcauuaaacuguuagacaucaaaacucccaguccucccucaccagucaucgccuacguugaaggcauuaagacucuuggugaagccuugcauauugguggggcugacucucugcaggaagucaauguaguccucggaguggaagcggcacaugucauguugggaggccugguauggcuugaagaccucgggauggagacacaagaugaacccaggcagggucagccccacuccacaggcucagaccacccauacugaacccaguccuggagacuauaugaagccaaacauagcauuccccucaucccacaauccuuaagucaguagagagacuccgauuaaccagguaaguuauuacaaaugagcccccugaagaccacuucuuuuccuuuccaccuccagcucagccuaucguaccuucucaacuuugagcccugauccaccugcccuguuccuuggaaucuccuauucccaguucucuccaugcucaucuccucccccaagcucugauucuguccucuuuccucuggauucuucuuucuggagucaaauauaugggauauaugucaacuuucuaauuaaaaucaaagauuuauuaucuuuggaaggucagggggaugugucacaccucuuugaaaacugcacaagaaagagcuuuucuucucccagaaaaugcacacagguacauacaggcaaacaaucucaagggauauagauuccugcacuaacaucaccucagucuuuucuaugaccaguccauuugucugugccuuggcacaagcaaugaacauucauucauauuguucacuaguuucccuagcaacacauaaagccuggguuuagcuguuuugucuuauuuuuucuuuugagacaagguccucccugucaacucaggcugcugaucauagaucacuguaacuuuaaacuccugggcccaagccauccucucgccucggccucccaaguaguugggacuacaggcacacccaccgcacauggcuacuuuuuuuauuuuuauuuuuuguagaugugggucccacuguggcccaagcuggucuccaacuccuggccucaagcgaucccccccauuucaaccucccaaagugcugggauuacaggcaugggccaccacgccuggcguggcuuaacuguuacuaucccauaucacagccauaaauuccaagcugggaagacagcauguguaugucugguagaugaaaaacuggauagcgauuaagcagaaccauguagagguauuccaggcugaaaaaggaauaucuaaaauaucgccucuguuccacacgcacauacacauuuacaaagacggcagcaucguuccacccuggagcccuagcuccuuggagguaaagaaaggugguaaaagaggagugggaacugaggguaaaccucacacccugauacagugauauccgcuccccuaacccuaauuccugaggccaaggcccuauccacacucuaaaaugcagaggaggaacacaccuucugucuucaaaccagccccacaucacgcuaacccuaggccaagggcuagugugccuacagucagaggguggccgaccugaggugagaaaguacuuuccauuaagcagaggacgccacccccaacacccugcacuuucaagguacuccuggugacuucuauccagcuccccgauacucuaggggcgggucgcacuucaugcacucaguccagcccaccuaucccuacggccacagcucgccccaccccccaacccccggccgaggcggcggaacucacgaucaucuucuuauagagaccguaaugcaggaccaggcuaugggucaaugccaggcgauggggcuucauaggguguccagcuccuggggguggggagaagagaguucgucagcucucaccccuggaguugcaaccccgccucaaaaccuccgugucccaacuccucaugcauaucccuguuuccucaccguaguggaaguugcccacgucggggucguagaaauaggccacggucuuggccauggugccggcgggagcaggccccgcaccuccgccgcccgccgcccgcggccgccgccagccccuccccggccgu

SEQ ID NO: 21554 - RNA, 13638 nt, Homo sapiens
cucaaugcauaccaugugaguacuuggcauauauuaggccuucaaaugaugauggauggauagacagauaaaaggcccaaugaaugauuguaaaugugucuucuccuauguauccaugaugauauugccuaguuuuuaauacaagcuuaagaaucaauaaaaugauagaucugaaaucuguagaugccagucuggcucaguauuaauacugacaguaguuuuuuuguuuuuuaagaaagcaaguauauuaaaauaucucuguuagaaaagauuacaauuugaaaggaucauucuacaaucuuagaacuaaaaagcaauuuaaggcaaagagguacaucaaagaagcuauuccauagcucaguuacagcucaacaaaagcucugucuguauugucuacugguaagcuugugcccugguggcuaaggaucauauguaccgcuauauccgccaguugaugacuguccaucucuagccccucuaaccaugcuaugcacccagugagugcagaaugauuacuaguaauugauguugacuuuacaauucuaugacauguaauacaggaugccgaggcacuuuuaaaauuccaccuaacauguucuggcacuggaaaaucuuacuugagauuuuaauacugguuaauauaggaaaaauuaugcuuaagcaccacuaacuuaaaaguguaauuucauuuucuugaauuuagguaaaagcaaaauucucaaaauucuauuauggcacaugguuucacaguuucaaaugaaaucacagcugucucauuacgcagcacaguccuugguuuugcagaaaguauauuuuuccuuuguucaccaaccccucaaguauguaauacuaugugcuuugcuaauuuagacuauaucucagacacacacacaugugugacugauuccugaauaacccaggaugauguuccuguguucuagauaauauaaaauuuuuaacauuccucuaauagcugaacaucuuuuuaaaaucuagaaaacuugaaaaauccuaaaauguuuuucaauuuuuuuaagcuauuugagagacaguugugguuugggggggacuuguuugugugauuuuuaugucagcaagaaaauuguaucuuuggcaaauacuuuaauauguuuaaaugcauuuuaccucuggauguaucacaucagucaucaaaaugacuuuccaguuucacggcugccuuauguauaccagucccaagaauggugauauuaagaaucccacuuacaacaucucugcccaugggaaagauaaaaugauagagggcagccucaagaaauaucagacaggauugggcagcucccuuacuuaauuuguuccaaaacaaaaguugacucaagucaaaaugaaauugugcacuugaaagaaaggaaguuaucuacuaauuuuuuaaauguaaacauacuuuuuauauagggauguaacuaucugaguacauguauugccauuucucugcuauauaguaauauuucuugacaccaaugguaauguguuuguuucuuucucagcaccagauguguccauauguauuuaaacaguaggagcauuguuucuaaauucaucuaugcuaugacauauauaaacccauuauuauuauguuucacuaaaguuccagcacuuuagaaaaguuucaguucaaagucauuuuggcucauucauuuagauaauacugaccauuuugcacuacaauuucaaaaggaacaugagaaauuuggauuucuuugaaagagucaaauauguaauuacagaauugaaacacuguguuaauucacaaagugauguaaauaauaaacauuaaaaauuucccaaguaaugaugacuuaagcguucaaaauccaguuaugugcuuuguuauugaaaacaguccaaacaaaaauucuuuuguuguuuucuguucucuuuuucaaaauacauaaauccuacugaaguuagucuauuuuuucccacuucagaacaccaggcacugauuuauccauugggaguuuugcuuugccuucuaauaccuagauuaagaagacaaaauaagacaaauuauuaaccugauaauauaaugaaugaguacaacagacaaauuuaaagucaaccuuuuaaaaacuuuaugcaacaguuucccuccaccuaagcagcaaucauguugugaaauuaugcaguaguacaucauuuuaauaaugguuugaagaaagugacuaugucaacagcagagaugccugaugccuacacucuucacauuuagaggcaaagaaaccacuucugaaacacucaagaguacagcaggacuucugggaccagcaucccugaccaggggaauucauuccauggaacaaggguggcauguccaccaagaaguagagucaaggccucugcuccaucuugaauuaguccuucuccagcauggcuuuggauguagaauaauacauuaauaggcagaaacuggaccaaagcuaaucaaucaaauauuacugucuuuaaaugugaccauagaucuucauguaaggaagugaaaauucacuuauucaaaucauaaacuaccaauuuccaaacaguaaauucugugaggagaaaaaaaaaaacuuacauaguaucuuauaacugaaagaagccucagagucaccugguccguacauuuuguuucagugaggaaaaugaaggagagaggguacauuaacagcacauaccuauucaacuauuuacuggguggcuuuuacacaucaacagaaugcucuuaaauaucuggcaggaaaagcaaucagugaacugauacaugauaugucuucagagucacacucacugcugcuuacacagccaccagacugaccugauggccuuaggcaaguuacacuuccugcucaaaaagcuucagccucccacugccuccagaauaaauuuuagccugcucuucagggcugucuuccaucuggcucaacuuacuuuuccauccuuuuuguccaacucguaacuccacaaaauucaugcuuuagccaaacuagaagacuuguuuuuccaaacaugcccugcaguuuccuccugccaugcaaguugccugugacguugacuugcccugggcuuccuuuccuuaaugcuccccggugcauuccccagacuucaaggcucaauucaaauguauccuaaagucacuccugaaacucagcccaaagagaccucuccucugucugaacucugauuccuaggaaggaaggccugaugugaaagucaaaauguaagaagcaaguauuacuauccugaaggugugggguuuuuuucucaaauauucuauacuuuccccaauauuuccacucagaauaaguaugacauuuuauuaugaucacuaauuauaauuucacuuuucauauuuucaucugguuuauauuaguuauaaacauuccagcuucaaccacucuugaaguuuguuacagucaguaauaacuaguaaaaaaaaaaaaaaaaaaaaaaauucaacucuauaugagugaccacaucaggaaucccucuuguacagucauauugcuggagcaauacaacaauuuuuauuucuucuaaauaucuagcaauacccaauucaauggauucuacugauuaaaagcaagagacauucuaugcaacagaccucuccagaccuauuucuagugggaagucaguaagacauaguugggaguuaccaaacuuauagcaaagguccuucugaucucaccacauuuuauuuuaucccucaugaaacuucucauauuguaucucuauuacaguuauauguguaauucucucacuuccccuacucaaaaugccuuuacucaaauuauuugagaaagaaauucauuaagcagugagugagaggcugcaagguggcagaccuguaccugacaauggguauacaacaguggacaagagacuaaaucacagccaucacugaguagagcaggagacagacauuaaacaaagaaauucauaaguaauuaacugaaaauaguguaauaaggcuacagcaguauagagauuaguaguccuauuuauguuugcauuauucaguaauaucuagcucagggcaucaacaaacaguacaaaaaugagagugcaaaugaauaaauaaauggagaauggaugaauaaauuaaggaauuauaaaaauuaagaaaaaacuaaucuguuuauuuaagugcaaauuauuuuagcuuaaauuauaaugguguucuggcggugggggucggggguugguucuacuauaaccaacuccacacaauaugggccauaaaaccugccagguuuucugugcugugggcauguucagaagaauguaugugacucuguuuuuucagugcuauccuuuugcuaucacaggcuucaucuaucucuaauguugugacaacacuuguaaagcacagucucugcuucuuuauguagaaaguccuggguuuuuguaucaggcagaaauuucuauuaauuaugagauucuaguauagcucugcuauaccugucuguaugauccaguggcacuggugguucuccagugacaaagcaaagcugaugaguguugaguaucauuccaauggaaauaguauucucauuguugggaaggcauaacucaaguggcauauguaauuauaaucuagcacccagcaacacuuggggagguagugcuuaaggagauggggcaggacagacaggcaugcagucaaaccuacccaaccuuuuuucauuauuuucaucagagcaccucccugugaauagauaucuuccaguauuucauucuaagaagagucucaggaguaggaauauuaugaagaaaccuccacacaccucaaucuuuugcagaguauuuuccuaguaucaaugguucuagaacucaaauauaugacaucuugauuuguacagaccagagggggcugaacucuucaguugcuuacuuuauggcagugguuuucaaaauguacuuugaagaacccuagcaauucuuucagggacugcgaggaaggggccaagaagcaacuacuggggcuucuacaagcucacccacucuacauauugagcaauuugauauauugggccuucacaaaugccuucuggguaaacacuguggucuguuuaugucuucuccugaaaacuaagcuucuccugaaaacuaaaaaccuuaguacauucuccuuugccuuccauuauuuaaaaaaauaaaaucagacugcauaccauuuucugccuuuggucugcuuacaagaaagcugcuguaguagcagaaacagauacauucuauguauaauguuuggcaugaacaaaaauuauuugugacaacaauuacuuagcuaagcaaauaacacuuacggugaaauugugcagccugaggcauacgcaugauguccuguguagcgaaugucacagcgcacaacauuguugguauagucagauucaggaaccagguagcugggguuuacacugaccugggcaacacaaagaguuccucaguauuucuuuuuccauagggcuacaauaaggaaauuguuaaugaggacuuagcuaaaucaagcagggaagggauuuuaacuuaaguaagugguuaaacucuggagacguuauggaaagagacugcauauuuuccccugaaguucuuuaaaauaagacagauuagauuagauuagauuguuuauaaauaguuugaggauguauaauugcuuccaauaccaugauuauuuaacauuugaauccagagaagagggccuauugaucugcaauaucaauauaugauauauuuucaaaggucuuuaccuuuaggauauaguuuccagguuuuacaucuguaauaucaauccacuggcagucuaugucugcaccauagguaucauaacagccaggacucaaucccuaagauaaacaaaauaaaaaauuuaaaauuaugguauguggucagacuaugauaaauaauaugcuauuauuugcaaauuaaauuuuaaguuaguacuuacaagagucugacauaaaacuauacuuauauuucaucucccuugagaaguauuuauuacucagccuuauagcaccuccagcuaaaaaagauacaggacuaauauaaguaguaguacaccucacuucuuaaaagugucauauaucaccagagauaaaugcaaucugaaggaacaaaauaggccucuaccaaaguucuagaauuuuaacaguucaggaauaaaggccacauaauaauuaucuuagcucaaauguccucuucucagugaaauccuccccaguuuccccuuuuggaaauuaccuucuugugcuuugaacguccaugauacuuuuuauuguggauagcuuuuacaguguuuaucccuuuuugcucugcauuauaacaugcuauguaagaauauagcuaaccagaggcugcaaguucccuaaggguagaguuuacguuguaucuuugaauaacuaacauuuauuaaauaguauguggcaggaacaaucguaaacauuuauauguguguguguguguguguguguguguauaaaaauucaauuuucacaacuacaugaggggcuauuaucuccauuuuauagaugagaaaacuaaggcacacuaagaucaaauaacuuacccaaggguauccagccuaguaaguggcuaagcugguuuugaguuuagguaaucaagguccagagucccuguucuuaacuaccccacuauacucucucucauacagucacugaaauaugacauauuuuguugaagggguaaaugcaugacuaaauugaugaaugccacaucacuccacuugcuaaaauauucacaucaauaaguaaaugaaugccuucuacaggcugggaggagaaaaauauaacaaauacaauccuugcuuuuaagaauguuauagucuagagaaguuuccucagauuggagucuguagguauauucuugauuccauuaguucuucacaaaaaguuuuaacuuguauuuuuauucuaauaguaauuuaaauucaaaguacaugcuagauucauuuuaacucaauacugccauucaauucuagcaaccaauauugcuuugcuguuuaagaucacuuuggucacccaagagacaguaaaaucaccuuagcaugcucuaccaaugcugguuuagcuguagcuugauuugggaagagcaggggagaauugugcugucauagagcacacaauagcacagacaggcccaacucagaagggucagugucacagcagugagacucauauucuguuguuauuaucuagauuccuaccuugauccauacaucacuuaacaguauguugaguaguaaauauaaaaugaagaauuuuuggucugauuccagcauacaauucugauucuggcauauaauacauacucaauaagugcuaguuauuacuucuacuacuaccacaauguucaugacauuguaaaggauucacuggauuagauauucauuuaagauggguuuacauaaugcuucagugcuuaucuugccuucaaauagacaaaagagccuuaaaaaugcugaaauuggcacucgaguucauaagcuggcagaacuuaaguauaagcuuugauuauuugcacaagcaagcaaaaacgaguuacuaaggcaaauaggcauuucauguaggcaaagucaaaauauaaaaacagauucaauguugaauguuagcugaggcucucuaaaucagcaauuugaguuuuagcaauacauacuauuuguuacauuaaauuaauaaggugaauucaacuguuuuaguuucguauauauuuaauauguaaauuuuugucucagaacacaagaguuauuaauauguaaaaguauaaaucuaaagaaguuauaccuaguuuuaugcuugaauacauuuaagcagcauuacaauaaacuaaucugagucaucauuaggugauugagagacuauuuuuuccuuuaaaugaaguccaugugaaagagacauugaucuaaugaaaaaaacaaauauauaaaucgcucaaugcaagauuuggugaauaaugguuaaaaagaacauauauggaagaugauuaacaagaaagcuaccauauaaaaugaaauggggucaccccaaagaagggggggaaccagaagugcuauaaugucuacaaucccagcuucaaauauuucagagugagcuguccagagugccucuuuuuguaaauggggcaaauaaacucuaggucccuugcacaggacuugcagaucacugaaaagggaaucuguauaugcacacaugaauaauguguggguaaguuacaucuccucuuucuuaaguaaguacuguccuggggcauguagaaguuaaccuuucccccuccaauugcuaugauguucuaagcucagagaaaaaagcaaugguaacauuuaggucaccaaacagcuuccugccacagcccuggaauuugcuucccaagaugccaacugcugaucccuucauacccucaguuauguacauucacuaccccuugccaagaucugggcgggagucaaauuauaauguccuuuuacaaauuaggguuucauauggaaauacugacauagauuuuaacugacacgcauuuuccaaugauaaaacaugcaaacugcuuaguucagcacuacuuuaaaaaaauccauccaaacaacaucugacaucaauuauacuguagauuuaaauauauauguguggagaaagaaaugguguccuucugcucuuauuugcauuauuaaaagaggcaacuuuuuaaagugcuuuuaaagaaacuuauuuuuccuccauuugcuaaccgcaaccacuauucuauuuucagcauaaaacagaaggaaggaaugguuucacaggugaaaaaacagagauaucuuuuuuuacaguuauuuacuaagccgguuaaggaauacagaaugggugcauauguugucaaccauucagacuuuuucagagaguaaauuuuuguucuucauuguggacuguaacaaggacccacacugaccugugaucaugaauaggggccacaugcauaacuggaaauacuucaaaaguaauuuggaucaucaagccaucauuugccuuuucccaauuauuuuacaucuuaacaacauggaccucaaauugaaugcuuuauaaaagagaggugagaggaaagaaaauacuagacucaugggguauaucaucuacaguuuucuuugagaacagucucuguauccuuuugauaaaaaugugugugcucuucaugaaaugcuauuuaaugcuaacuaacgguagaugacccguuucucucugaggcuugagguucuggauuucagggugccaacauaccugugugugugcaguacaugcaaaucgccugugguagccauagucacaggaugugucuucaagacagaaacuugcuuuguggccuucagccacucuccucuggguguuggcaucaagcaggucauaguggcuaaacucauccauacugugguaaugucugaugucccacaaaacaaaaagaugguggucaguuacauacagagaaagcaaugaagauauuaaaugacuucccccauggcuucacaaauuuguuuucacauuaaaauugagaccaaauuuaucuucuaaaagagagauucaugcuaggguuuuuuuuuccccaggacauaagucuaucaaaauuguaagguuuaacuuugcuacuaggacaaaagacuuaguucaguauuuugcuuucuuauuguaccccauuuugucuuugaauauuaaauagaaauggacaauaaauuaucugugcuuaagugaaacuugcccuguguucucuaguguauuccccuuggcugccacugcugauguuucauuccgaaaagcagcacaugacuuuuucaagguuucuaugagauuuuaaaaaauugaguucucacauauuuaaaaucauuagugaaaagcaagggagaacucauggcauguuuuauccaccauuauuauuuaaauaguacacacuuuuauuuagaaauaaaauauuccuauuuuaucaggaaauuaagggacuuauaucuacuuuuguuauuucauuaaauggaaggugcugagcuguucaucuucccacauaaggaaaaaacaaugaggacuggcuuggauuucaggaaguaaguuuaaggccacacaugaggauuuccugaaaauaaacacccaggcaaguuacuaaggcaaaugauagaauuaccuuaugcaaaaauccuuaaauuuaggauagaaaaggcaaccaccuugggcuugauacaggucuuuuaaaagauggaagaagguccuucugagcugaugggauguaucaucuacaucuuucuuugagaaugguuucugaaugcuugugauaaaaaacguguggucuuuaugaaaugcuauuuaaugcuaacuaacuuuagaugaucuuggcuguaauggacuuuuaaagaaauccuaucuguaaugcauuggaguaaauuuuauugaagucaauugcuguauccuaucaacagcuuuaauaagcugggcuucagauuuuccauuucaaaagauaacaggaucuuguaguagauggguuaugugaaauuacauagagaaaaauucuaaauauaaguaauagcaauuuucucccuucagguaagaaauaagacuugcauuugugauaucaaaaaucaccugagaaaugaaaagcaacccaaaaguacccaggaggcccauuuacuuacugaugacaacugugccauucccaggaauaucuuggucggcuggguaagaaaucugaugucccuugguuuuucacucuuuggggaaaucugagcagcacccugugaucauaaucucugacaucugcccuguaugcuguacugugauuuugaaaaaagaaaaauuauuauauucauggaauauuaacuaaagacaaaacuacaaauaaaacauccauuauauaguagugacaauccuccuuucccaacuagacuaucaguuccaagagucuaaggcauuuuguuucuuuuuguucauugcugaauccaaagcuccuagaaccgucuuggaguagucagagcucaaugaauauuuggugaauaagugaaugaauaacaccuauggaaauccacagaucuuaacaguaaaaacauaauaagcauuaaaaaucuaaaugucagaaguaaacuuuagaaucaauucaaguuugaucauaugaaugagugaaacugaaguggaaauaaucccccaauaaaaaaaauaauucauagauguuuauuacaaacuucaaacuuaacaaaacuuuuaaaaaaguuaaugagcugcaaacugaggaaauaacucuaaaagagcauacccagauuuaaauuaauaauuuuguaacuucacuaucccaaaacaauggcaguacuguaaaaacaucauagggaguucaauggugugagugaugcaagacucaggaaugaaaaugagcuuggauuucuucacuuccuuuagccugacaauuauaaagggucaaaguggaagaaauguacaaauaaacaucacuguguuccuacuaauauauuuagugugucuauauguucaggugguauugaugaccuuauuuuacacuuuaaauuuuuauuaaaacaucuuuugcucccucugcuguuucccagcaguaaacccagagaaccccaaucccagaguuacuauuuuauuuuagaauaguggaaaaacaaagcucuugcucacggucuuauucuggcugaaguaauaccaaaacaaccaaguucaucguggucucaaacaaaagaggaaaacuuagucuuuaccaaugaggcuacgauggcaaauuugccccgaaucuuuuaaggggguauuaacacacccuuccauuacaauaaauuuuuugaauuacuguauaguuguuuuaugaaaagugauuggaacaauugacucccaaguuuaaguaucuuggaaaaagagcaugagacuuucagucuccaggauaaggguuuccuccaccucugugauuccugcugcacuuugagacagaacccacagaaaucuucaaaaauauuaacucuccguccaggucagcaugcccaggaggucacgucccacuucccagcucuugucccacuuccuaacacuugucugcgcgaagcaguagcagucagaaccaggcaccagagcgcccccugaagguagaccggggagcggggccucagacauaucagcccguaccuggccagacaguuuuccuccgccgcgcaucucagguuguacauggacaucuucugcacguacguggacgccuggauguaguaggggucggccaccaggucugggagaccuaaacgucagcaggcgacgggcgcagcagugaaacaacccggcgccccccgcuccaacucccuaccccucuaggucccuuacuccucacccuucgcccaccgggacugcagaguggagcggaggacagcaagagaacuggggacgcccgggacugcaaagcaaugugaaaaggaagcaggaggggccagacgcgcgguuugcacuggauuccagggcugccacugcaggcgcgugggggagggaucggaucugcgaggaccggggcccgccgcgcccaggcagccacgucgagaagccacauagcuggggaccaggugcacgggugcuuccagcggacuuggggguacuuaccguacuggaaguagccagugccguauccgggccgguaccugcccccaggucugggccuuucauaaguaucguaguaguuguaauaaggguugucgucagaguacuuguagggguuguaagggucgucgcccaccaugccguccacgcggcugggcggccgcagguuacugagcgcaggaacuucucccggcgcugucugguucuccgcgcgcgaggcgccagcuucgcgggcucuagaugucgaguagccagcuuggaaccagugacgggcggugggccuggggcggccagcggugacuccagaugagccggccguccgcguucgcgccgcggcggugcgguugucgcggaucagcaggaucggagugcggggcugcugggcggaggcguuggcugcaccagggacggcggcgcccgggucccggcggcgcugaggcugguacugugagcccaggcucagcaagcugaacaccugcccguuguucucccauuggaucugcuggcgccaggcgcccggagccgccggcggcucgcgcgggggcugcuguuggccggcggcgggaggggcgcagugcacuagcgcgcagagcugcaaaggcccgagcaggagcacgguccaggcgaagcgcaucacuccuuuugccagauugaccccgcucgaggaggacguggcucacagaaaauaaaaacggggcucaaaucacgugagggaaggagaaaucuucaaccaaggaggcgagcggagcacggguaucucagucuccaccaagcaaugccaagggugggauucagacccuuccccagucaaggcggcugcucggacguggcacccuucccuuuccccuuucucaguccuggaaggcaacggggagcggcgcggcagucccggagagcgggcagugucuggagugaaggaaggaggagagauuuuaaacuuucuggcacguuugcaaaguuacacaagccguucuggcccggccgccccucagcuauuuguucacguaaugcgauu

SEQ ID NO: 21555 - RNA, 1661 nt, Homo sapiens
agagcacaacuccaaaucaucuuuuauuaauauaaaaagggcauauuuagcaaaagacacacagauaaaagagucacuauggcucaggacacaaggcagggaggugccaggccugugccccugcugggggagaaggaggcucgggacaaagugggagaagugcugggaagggcugagcgguaggggccacaaaaguuccggugggcaacacugucggcaggucaugggugggacucauggggaccucgcugcuaacucuuguuguggggggguguccuuagugcugccaccuggagggccacuccuugguuccuggaggggacccaccaagggacacaggacaggaagcccaggaugguuagugcaacucgggaugaaggccagggagaagcgggugcucugcaguggccggauagguccagacgcugaggccgaggcgcuuccuguuacgugcgggcguuccgcucugucucugccaggcacucucugacuagggcccgggcauggaugauaccugggggugggguggggucucagcaacccuccacagccccacccacugcccuccagaggaggaccccugccuccccacucccuuuccacuuucggcaaaagaaauucaaaucuaaugacggcuagaugaaauuagagguuugguuaauccucaagguugcccuguugaaauacaaauucccaugcucuucccuggaaauggacucaauuucaauucgauucaaaacaccucucugguaguaauacuggacauccucuaggcuuggcucagguggccuccagauguccuuccuucccucaugaaggauaguccagugucgguuuccugagcagggcggccuggccucacuuaccucucuucaggcgcuccauggcgcucuugcugccagcauagguaggccggaucucuuugcccaucuccucuaugacugacagcagguccguguaggugcucugggagcccugggcgccggguggcuucaucgccuaugucaaaagagaacagggcagugagcucaggcaccuggcggggagggggacuccaguccgcauccauaagcaaggcuuuggccccacucaccugcacguagcccauggaaggcgguccaaagucguuaaacagcggucugaaaggagcgccggcuccuggcacugagcccgacggcgacgggacgcuuccugcagcaacaggcgcgaguaagaggucagcgcggggcagggacgccgccucccagcuuuuccaagcccaggaccggguucgcccgauucccuccaaaggaugcuucauuccaugcugaucaacuucagggacaaaucccucccacugcgcuccaccuacaagcccuuacgugaccacgcccacuucacaggccagcaaacugaggcucagcgaggguaggcggcaggcccaguauugcagaacucaggccgucuucucuucgagaccucgaccgcccggcaggcgagcagggguggagcuggauccucaccuguagggaccggggugcccggcccaggggugcuggagccaggggugcugcugggagcaggggcgauggguuuguaggacauccccaacuccugggcgcggcggacgccagccggccgcuccucggggguuggcugcggggccgcucagccgcgcucug

SEQ ID NO: 21556 - RNA, 10747 nt, Homo sapiens
uccaaacugcaaauugccccaaguuuuauuuguaguccauacaaaagggaaaaaaaauuaagguuuucuaacaccaccuacuuggggagauggggaagugggacugugccgcucaccaucagcuagaacauuaguggucagcagggacuuggauacauaccaacugacugucccaacaggaacucagucucaacagucuacagagggacagucaggguacccuggacugcuggcacagcuuggcacauaggaaaugguuaagcugacccuuuccuggccuccuucccaucuaaaaagaaaaaggcgccggcgaccucagcugcagguugcuuccccauccagacgaccuuaaauaucgcgcacaaaaauaaaagggagccaggaaaaaaauaaaaacauaaaagaaauucccauucuggggagacgggaggcaggguagaggggaaaccgcagaucuagagccaguagcaagauuugcugcugaggcgaaggaacaaaguagguuacugccgaacacuuaacaggaucaucuccuggggaaggcccacaugguagagggcaugaaaaaccacaaccaggaaagguaugggccagaguaguuauaaccuggaucuguaacccuacccaccucuuuucucccucccucccuguggugccccaucccaggauggcccuacaugcggcgcugguagccagagugcaucugagccgcccgcagguaaucauuauaggagcccgaauagcgugcguaaucggaaugggcaucgggcaggcgacgguaauccagcgaggacuuugucggcgagcggcggaacgaaagcugcgacucugauaaacggcgguaaucagagagcucggcuaaacgccggucggaaccauaccuagucgagagaagaagacaguuggugaaugagacaauugaggggaggacuccaggugggcauuggggagaugccaauggggacagggagggugugaucacaguggucuccaagagauuggucuccuuuugucagaaggcucaucacccuauccaggccaaaaaaaucaagccuggcuucaacucagugggaaaucaaacccuccacugaaguccuccccucugaacuagccaagguggauuuuggucuacauucccacaccacagcaaacuaucuccgccccugggcccugcagagaaagaccuugguuguuuaucaacagaacggcggaugaaagcgagguccccaacuucccagaguggacgcaccucguaaacuugccuuuagccagugaaugccaaagggacuacucuuuaacccacaucccugccaaagccaggacaaccacguaauaggcuuaaggauccuugagacagugggaaaggauaugggccacaguccugcaggcaguagcuccaaugacacuugggcuagccuagacaggugacacugugccuggccugacuagcagguaccaccccaggcugagcacuaugcuccaccugaacccuggugaccaggaaaguucauagacacugcuccccucggccucuggacaucccacaaaaauagagaagagaagaccgagggaggggccgaugccuccaguuucccucccaugccaaccucagccccuugcccuaagccccagcugggggcagaggcgggggggcauacaguaccuuuucgacauggcgacagccuuuuuguagggaucgucguagcuggcccgggguggggagaggcggguacgcucauagggcggcggggugcuguuggcguuggcaacggcccccugggacauggacagguaggcugcagacggcugaccugccccaucguaggcauugccuggcuggccgcgguaggaggcagcagccuggggaugcugcugggcagcauaggaagcagccaaugaggcugaugacugagugcgguaaggagcugccaggguggcagaagguugggccccguaggcugcugcggcaccauaggagccaguggccgcagcagccgacugagccccauaggagccugaaaggcccauugaugcuugggccccguaacuauucagcugggucugcacaaccggcugggccccauaggagccagccauugggguaguggcuugugcggcguaggcugcuggcuggcuggcauaggcagcagcuguggcuggcugugccacauaggcagcagguugggaagaguaggaagcagccugcugugcagcauauggggcagacugggcauuguaagaggccgagggcugggcauuauaugaagcugccugggcuccauaagcuagugaggaggcugcagacugggccccauaggaggcugccugagccccguaggagccuaaggaggaagcugcucccuggguguuguaggaagaagcagcugcacgaaccccauaggaagaggcagccugggcgccguaagaggauggcugguuaccauaggaggcaagggaggaacccugagccccauaggaguugagcgaagaagcugcagcugccugacccccauaggaggaaagggccgaggcugagggcugggcuccaccauaugggccgagugaagaagcugcagcagacugggagcuaggacuagccagcuggccccuguauggugccccaagggagacagagggcugagcgcgguaagaggcugccugggcugucaugggcugaguccgauagccaacacccaaagaggcagaaggcugggcccuguaggcagcucccagugacacggacggcugggcccgguagguagcuggcugggccgucagaggagccacauaagaggcucggggaggugaacggcgcagagggcugcggucgcgaccaaagaaggguggugugggcugacgggcuugcccaucaaagccaccagugcuguugccaaaagccugcugguagucgaagguggcagagaagccaccaguuccagggaaggccguauccccagccccugguuucuuggucuuguccccagacuggacagccaggccaggccccuucuucugacccuugguggagaguuccacguugaugcgcuugcccuucacuucuuugccguugagcugcgcgauugcggcuuuggcaucugcuuccuucuccaugugaacaaacgcguagucugauaaagcagcagacagaggguuagcaauuaggggggcagggcaugcuaccugaugggucccaaauuggacacacaacagcacccagcuguugccagcuaccuccaaggccuccaaacccuccucuccaggaguaugucauaaaauguagcucccauauaacaaagcuucugacugucccaagcagucaucuuugccuacagccuucuucccauucuccccuuuacaaacccugccaucucacccaacuuccuggugagagaagaaggagcaaagaugaacugcaacacaggauaaaaaucuucacaucuccuguaaguacaaaccagcagaacaaaaugcagaaagcguuccuagaucacucaguucuucaguguucucaacccaaacucaccaaacaccuuugaggccuagcucacuuuugaggccuaacucucaaacacuggaaaugaccacucacguuuugguaugacccaucucucagcccauguccaauuaaggcaagagagauagacugcaacaagcaagcaguucacaacauuccaauaugaucucuccgcuuuuucacaguacuucccaaguuuucaaagcacucuuagguacaggaggaccucauuugggccucacaauccugugagguaggcagggcaaagaaucauuaccuccauuuaacagguggacauacaugcucaagaguuuuuauauggcuugccccacucaaaguguguuagagucaggaccagaaucacagcucuuccaaugccccuuugcuacauaaucuaucccugagaagucaagguauaaggcaggacuguguaauaugacuaaaaauuuaggcuuagaagcagagaagauggacccuguguaagccaaugagguaugggaauagaaacuaagcccacuggcugaguucaugcccaaucccccugucccagaccacacugcauccuccacuguuuccucuuuaagggacagagguauaccuuacaccuugggcuucuguucacagagcagacugcuuaccagaaagaucugguuucucaccuauaagguaugaagcugcaauuacugcagcuaacaggcucugcuaaccagguuaccccugcagcucucauuaugaccugaauaagcugugguaggagaagacaggaugccggucucaaagcuauacuuaucuacuacacagaaggagaaaacuucagggaaugaaggaauggaaagaaauucucauguccacacucacaaagcacaggcagaaucugaaggagagaauccugccccuaggaaauaaggcucuaagcuuagcuccauucucgaccuguggcuacucuuagauagcauccaaguaccaggaugcuaucugucacaucagcuuaagaaacaaagagcuacccagaugacaauacuaagauaagaaacauucuuaauaaccuccaaacaaggguccucauuuuuagaaacuuucguacugggaugccuuaucuagcugcuccuacagaacaagucauuucccuggauuugaagacaaugacacaagacuaaggauaauggggaaaaaaugcaaucaauaaguagaagucagaaguguggcauagcacaaaagggauccuuaauuagaaauucaauggucucaguuccagacccagguaucacugacuuguuauaagaucuuaggaaacuuaccauuuaggcagguacaggggcucaugccagggcuuugggaggccaaggcaggcagaucaccugagaucaggaguucaagaucagccugaccaacauggugaaacccugucucuacuaaaaauacaaaaauuagcuaggugugguggugcacaccuauaauuccagcuacucaggaggcucuggggcaggagaaucacuugaaccugggagguggaaguugcagugagccgaaauggcaccaccguacuccagucugggugacacagcaagacuccauuucaaaaaaaaaaaaaaagaaaaaaagaaaagaaacuagccaagcacgguggcucacgcauguaaucccaacacuuuaggaagcccagguggguggaucaccugaggucaggaauuccagaccagccuggccaacauggugaaaccacgucucuacuaaaaauacaaaaauuaccagggcgugguggcuggcaccuguaaucccagcuacuccagaggcugagggaggagaaucacuugaacccggaagaaaaagaaggaggcugcagugagccaagaucacugcacuccagccugggugacaagcgcaaaacuccgucucaaaaaaaauaaaaagaaacuuaccauguauuuccuccgacacaucuauccuaccuaccucaaaguuaagagguucaagagaaaagacaaaagugccuuguaagauaugaacagcuacagaauaaggaauuaugauuauucaaaccuagaaauaaccagagauuuauuucccuauagaauauuaucuuucaucucaagcaaaacacaaugccaugcaaacuuagaagcuggcacagacgauaaaagaacacaaugagaccaggcgcaaugacucacaccauaaucccagcacuuuggggaggccgaggcaggcggaccaccugaggucaggaguucaagaccagccugaccaacaaggugaaacgccgucuuuacuaaaaauauuaaauuagccggcugugguggcaugugccuguaaucccagcuacucaagaagccgaggcaggagaaucacuuuaacccgggaggcggagguugcagugagccaagaucgugccacuguacuccagccugggcaaaaaggaugaaacucccucucaaaaaaaaaaaagaacaaaaugaauuaucacaacucuguccucaacacucccauggccagagccuuaucuaccaccugugaaaagcuacguguuuccuuuggccuaggcauaaggcacuaaaguuguccugugauccuucaucuccacuuugaauagaguaagcuuaaaaaaaaaacacaaaaaaccagcauguggccuaagagcccuuuaaaagcagaggcugggccaggaaugguggcucccuccuguaauccuaauacuuugggagacugagguggaaggauggcuugagcucaggaggucaagacuacagugagccacaaucacgccacugcacucuggccugagcaacaaagcgagacccuaaagaaugaauaaauauuuuaaaaaaucuuuaaauaaaaaauaaaaauaaaaccagaggcugagguaauccucgggaauagcaaaaccaccuggagauggcaagcagaaaggcccaaagugaaggggaagcagaguugcuggagcucauaggcacuuguugcagggaggggccuccagacauucugagggaauauuaaggaacaauucuaacaguccugauuauucuauccacaacuuccugacacuagaaugagacaaaaacuuccaugggcuuacaagagcauuuggacaucccacugucuguuucccuccuuagugaguuuuauucagaccaaguggugaaaucugaaaauugagauuucacauguaugauucaaaugacuacccaaaugaguuuuauaacugaucaaaaaauuuaaaaauccaagccgggcaugguggcucacaccuguaaucccaacacuuugggaggccgaggcaggaagaucaccugaggucaggaguucaagaccagccuggccaacauagugaaacccugucucuacuaaaaauucaaaaauuagccaggugugguggccuguagacccagcuacuugagaggcugaggcaggagaauugcuugaacccaggagacggagguugcagugagccaagaucucaccacugcacuccagccugggcaacagaaugagacucugucucauaaaaaaaaauaauaaauauauaaauaacauaaaaauaaauacaaaauuuaaaaauccaucugauacaauuauaaccaaauuguaucaggaaguuucuaagccugacacuggaggggaaaagugugaauagguugcccagcuaacucaacugcauccuguagugauaagccccaucacaguaagugcaaagcacagaccuagcuagauuaaagaugcccuaacacccaaguacuccuaagaccauuaaaaccagagaucugaaaaauuccaggaaccuucuugcccacagaucuaauucaaggaaacucugaaggaaaucacugcauugggacuaucaaguaauguuuuacagagaucuccaaauggucugguggcaucacaaguccuccaguaacaaaguuaagugaauccagaaaaacaaguucuccuaucuuaagacuaaaaaucuuaaacuugagggcuaggcgcgguggcuugcgccuguaaucccagcacuuugggaggcugaggcaggcggaucacaaggucaggagaucgagaccauccuggcuaacacagugaaaccccgucucuacuaaaaauacaaaaaauuagcugggugugguggcgggcgccuguagucccagcuacucgggaggcugaggcaggagaauggcgugaacccaggaggcggagcuugcagugagccgagauggcgccagugcacuccagccugggcgacagagccagacuccgucuaaaaaaaaaaaaaaagaaaaagaaaaaaucuuaaacuugaaacuacagagcucuguauaggaagaagaaacagucacucacaaaaaugaagagaagauauuuuccucuuuugucuuucagaucuccccacaagucuguacauguuuccggaagcuguucaucuuugaacacccaauaggaggaagcuguggagugguuacaauccacuguugcuauugagauuucuguucuacaaauccuaucuaagcuccuggaguaaccaagcaacuauguuguuuuuuuuuccugugaaauaaaacagagcugguugucuggugcaacaccaagcuucugugcuuuucaaagcccugucagccaacacaaggagacucaaucaaaugaccauucccagcauaagaaaugaguacgcucuuuagagagccagucgcuucuacuacacucccaacuuucaacccucacuuuccgucaucacaaacagauaaaaagacaucaguggaggauaugauguucaaaucuuucccagucucuuacaucgaaguaugucaggagcucuguuacacaacaauguaacugcaaauaguugaccaccacucccggaguaagucaaugcauuuuugcuaaucaaauguuuacaaaggaacaagaugcacaaaacuccgucuaacucucacaaggagucagccaggaguucuaaaaauucaugugcaguuaugcacuucacccgcaucgucacuugguguugggucccaagcaaauuucaggcaaauuuuugacuuucucuaccaccugaaagccagcaagaagccugaguuccagggagacugucccuucagauguuugacucuagacucucaaccuaguagccacucuaccuaacaaccacaaaagaaacuugguaagucaauuaaacacaaaacucucacaaaugagacucauauaccccacccuuuugcuggacaaguacccaaucugagacccucccccaccacucuuuuacucuaaacaaaagcaaaaauccaugcaccauacagccugccucagagcacccagcaggaaagcccgauuccggauagucguggacuuguauaaccugaguugaggaaaauagaaugcaguauuaaugcagaacaaggacuuguuccuaguaguggacacuaugacccuuuauauuucccccacuuaaaggacuaggaauggccccaaacaugugccuuuccaggacagcaaaugaaauaucuuggugggauaaauaagcacuugcacccacauuuauuuccuaucccugaaacuucucacacaggguaugagcagguaugaacccaccaggaguagggcaucagauacucccaggcugcaucuuccaaaaugacagggcaaaguuaacucugaucuguucccaaguggagcagagacuggccacauacacaacggcugucccaccaaaucuugccaauguaaaagauaaagagcuuaagggauaaaaacucaagcuaugaaaaagucaacugggucccuagucaggcuuaaauuauggugacacauuuuucucgaagaaaaggcaccgggaucugcccugagaaucagacuacucaagcaaugacuacuacugauucaguaaaccguguuuagccacuguuuaaugaagagcucucacagaccccuccccaggacccccucagccagaguaugccccccugcaaagucaccaagcuuauaaaagaaugacacugcccuagggcacuggcuuggcauguaaagacuacgcagaaggggacuucauaaaacaagcuuucuugcacaugcaaaaggcugggguuuccaguugacagauguaaaaucgagcccaaagaaaaaccccaaguuugagggaggagaaaagcacagagcugccacgccuaaccuaccuaauauugaaaggccaaagugauucggaaggggccccucucguacccacguguaacugugcccaugaguagacccaugccagacaagacuaaaagaccccagcccgagaaacguccaagggccccguuaccuuccgcuugagcacauucaucgggagggaacaggagggcggccuuggggcgucagcccccaccuuuucccucuucccuugcucugaccgacgucuggagaggaaguggggaaguggagaaaucuuccccgcuucaugauccggcuugugcccgucacuucccaauuuccgcugggugccaggcccaggagaccaggagaaggcgcgcccccggaacacucgcaaggcucucaggcgcguccccggccccguagcuuggcucgcaguggccgccgcacccacccagagccgcuuccuccuacuugguggacgguuccuggaccgcaggggaggaggguggcucuacccaacgcgcccccaacaccuccgaccugcucccgcgcacuuccccaccccucccaaccgcgcagugaccgacccccggguaaggggcguggcuaacaggcagagugccccgagcgcgcccccgcccccgagcgcgccuccgcguuaccuuucaccacgucacacucgaugacgcguccgcggcgcucgaagaggcugcgcaguuccuggcucgugcaugcagccgacacauugcccacgaaaaucuuccaaguauuaagaggccuugggcgcgacaucuccaccacgagcgcgcgccccggccgcagcucguggccgugcagggcuucgauggcgcgcagcgcgcccgcguucucgcgcaugugcacgaaggcgaacuguuucaugacggcgcagcucaugaccgugccguagggcgcaaagagggcugccagcuccuccggagucguauccgccccgucgacguugcccacgaauaucuucauuuugucgccgcagccaccuuccuggagagcccggaccucuccuccagcgacaggcaagacguccgaacgaccggcaguccuccucaggaauggcuggcgaccgagaaccccgccgcgcaggcgccc

SEQ ID NO: 21557 - RNA, 10747 nt, Homo sapiens
gggcgccugcgcggcgggguucucggucgccagccauuccugaggaggacugccggucguucggacgucuugccugucgcuggaggagagguccgggcucuccaggaagguggcugcggcgacaaaaugaagauauucgugggcaacgucgacggggcggauacgacuccggaggagcuggcagcccucuuugcgcccuacggcacggucaugagcugcgccgucaugaaacaguucgccuucgugcacaugcgcgagaacgcgggcgcgcugcgcgccaucgaagcccugcacggccacgagcugcggccggggcgcgcgcucgugguggagaugucgcgcccaaggccucuuaauacuuggaagauuuucgugggcaaugugucggcugcaugcacgagccaggaacugcgcagccucuucgagcgccgcggacgcgucaucgagugugacguggugaaagguaacgcggaggcgcgcucgggggcgggggcgcgcucggggcacucugccuguuagccacgccccuuacccgggggucggucacugcgcgguugggagggguggggaagugcgcgggagcaggucggagguguugggggcgcguuggguagagccacccuccuccccugcgguccaggaaccguccaccaaguaggaggaagcggcucugggugggugcggcggccacugcgagccaagcuacggggccggggacgcgccugagagccuugcgaguguuccgggggcgcgccuucuccuggucuccugggccuggcacccagcggaaauugggaagugacgggcacaagccggaucaugaagcggggaagauuucuccacuuccccacuuccucuccagacgucggucagagcaagggaagagggaaaaggugggggcugacgccccaaggccgcccuccuguucccucccgaugaaugugcucaagcggaagguaacggggcccuuggacguuucucgggcuggggucuuuuagucuugucuggcaugggucuacucaugggcacaguuacacguggguacgagaggggccccuuccgaaucacuuuggccuuucaauauuagguagguuaggcguggcagcucugugcuuuucuccucccucaaacuugggguuuuucuuugggcucgauuuuacaucugucaacuggaaaccccagccuuuugcaugugcaagaaagcuuguuuuaugaaguccccuucugcguagucuuuacaugccaagccagugcccuagggcagugucauucuuuuauaagcuuggugacuuugcaggggggcauacucuggcugaggggguccuggggaggggucugugagagcucuucauuaaacaguggcuaaacacgguuuacugaaucaguaguagucauugcuugaguagucugauucucagggcagaucccggugccuuuucuucgagaaaaaugugucaccauaauuuaagccugacuagggacccaguugacuuuuucauagcuugaguuuuuaucccuuaagcucuuuaucuuuuacauuggcaagauuuggugggacagccguuguguauguggccagucucugcuccacuugggaacagaucagaguuaacuuugcccugucauuuuggaagaugcagccugggaguaucugaugcccuacuccugguggguucauaccugcucauacccugugugagaaguuucagggauaggaaauaaaugugggugcaagugcuuauuuaucccaccaagauauuucauuugcuguccuggaaaggcacauguuuggggccauuccuaguccuuuaagugggggaaauauaaagggucauaguguccacuacuaggaacaaguccuuguucugcauuaauacugcauucuauuuuccucaacucagguuauacaaguccacgacuauccggaaucgggcuuuccugcugggugcucugaggcaggcuguauggugcauggauuuuugcuuuuguuuagaguaaaagaguggugggggagggucucagauuggguacuuguccagcaaaagggugggguauaugagucucauuugugagaguuuuguguuuaauugacuuaccaaguuucuuuugugguuguuagguagaguggcuacuagguugagagucuagagucaaacaucugaagggacagucucccuggaacucaggcuucuugcuggcuuucaggugguagagaaagucaaaaauuugccugaaauuugcuugggacccaacaccaagugacgaugcgggugaagugcauaacugcacaugaauuuuuagaacuccuggcugacuccuugugagaguuagacggaguuuugugcaucuuguuccuuuguaaacauuugauuagcaaaaaugcauugacuuacuccgggagugguggucaacuauuugcaguuacauuguuguguaacagagcuccugacauacuucgauguaagagacugggaaagauuugaacaucauauccuccacugaugucuuuuuaucuguuugugaugacggaaagugaggguugaaaguugggaguguaguagaagcgacuggcucucuaaagagcguacucauuucuuaugcugggaauggucauuugauugagucuccuuguguuggcugacagggcuuugaaaagcacagaagcuugguguugcaccagacaaccagcucuguuuuauuucacaggaaaaaaaaacaacauaguugcuugguuacuccaggagcuuagauaggauuuguagaacagaaaucucaauagcaacaguggauuguaaccacuccacagcuuccuccuauuggguguucaaagaugaacagcuuccggaaacauguacagacuuguggggagaucugaaagacaaaagaggaaaauaucuucucuucauuuuugugagugacuguuucuucuuccuauacagagcucuguaguuucaaguuuaagauuuuuucuuuuucuuuuuuuuuuuuuuuagacggagucuggcucugucgcccaggcuggagugcacuggcgccaucucggcucacugcaagcuccgccuccuggguucacgccauucuccugccucagccucccgaguagcugggacuacaggcgcccgccaccacacccagcuaauuuuuuguauuuuuaguagagacgggguuucacuguguuagccaggauggucucgaucuccugaccuugugauccgccugccucagccucccaaagugcugggauuacaggcgcaagccaccgcgccuagcccucaaguuuaagauuuuuagucuuaagauaggagaacuuguuuuucuggauucacuuaacuuuguuacuggaggacuugugaugccaccagaccauuuggagaucucuguaaaacauuacuugauagucccaaugcagugauuuccuucagaguuuccuugaauuagaucugugggcaagaagguuccuggaauuuuucagaucucugguuuuaauggucuuaggaguacuuggguguuagggcaucuuuaaucuagcuaggucugugcuuugcacuuacugugauggggcuuaucacuacaggaugcaguugaguuagcugggcaaccuauucacacuuuuccccuccagugucaggcuuagaaacuuccugauacaauuugguuauaauuguaucagauggauuuuuaaauuuuguauuuauuuuuauguuauuuauauauuuauuauuuuuuuuuaugagacagagucucauucuguugcccaggcuggagugcaguggugagaucuuggcucacugcaaccuccgucuccuggguucaagcaauucuccugccucagccucucaaguagcugggucuacaggccaccacaccuggcuaauuuuugaauuuuuaguagagacaggguuucacuauguuggccaggcuggucuugaacuccugaccucaggugaucuuccugccucggccucccaaaguguugggauuacaggugugagccaccaugcccggcuuggauuuuuaaauuuuuugaucaguuauaaaacucauuuggguagucauuugaaucauacaugugaaaucucaauuuucagauuucaccacuuggucugaauaaaacucacuaaggagggaaacagacagugggauguccaaaugcucuuguaagcccauggaaguuuuugucucauucuagugucaggaaguuguggauagaauaaucaggacuguuagaauuguuccuuaauauucccucagaaugucuggaggccccucccugcaacaagugccuaugagcuccagcaacucugcuuccccuucacuuugggccuuucugcuugccaucuccaggugguuuugcuauucccgaggauuaccucagccucugguuuuauuuuuauuuuuuauuuaaagauuuuuuaaaauauuuauucauucuuuagggucucgcuuuguugcucaggccagagugcaguggcgugauuguggcucacuguagucuugaccuccugagcucaagccauccuuccaccucagucucccaaaguauuaggauuacaggagggagccaccauuccuggcccagccucugcuuuuaaagggcucuuaggccacaugcugguuuuuuguguuuuuuuuuuaagcuuacucuauucaaaguggagaugaaggaucacaggacaacuuuagugccuuaugccuaggccaaaggaaacacguagcuuuucacaggugguagauaaggcucuggccaugggaguguugaggacagaguugugauaauucauuuuguucuuuuuuuuuuuugagagggaguuucauccuuuuugcccaggcuggaguacaguggcacgaucuuggcucacugcaaccuccgccucccggguuaaagugauucuccugccucggcuucuugaguagcugggauuacaggcacaugccaccacagccggcuaauuuaauauuuuuaguaaagacggcguuucaccuuguuggucaggcuggucuugaacuccugaccucaggugguccgccugccucggccuccccaaagugcugggauuauggugugagucauugcgccuggucucauuguguucuuuuaucgucugugccagcuucuaaguuugcauggcauuguguuuugcuugagaugaaagauaauauucuauagggaaauaaaucucugguuauuucuagguuugaauaaucauaauuccuuauucuguagcuguucauaucuuacaaggcacuuuugucuuuucucuugaaccucuuaacuuugagguagguaggauagaugugucggaggaaauacaugguaaguuucuuuuuauuuuuuuugagacggaguuuugcgcuugucacccaggcuggagugcagugaucuuggcucacugcagccuccuucuuuuucuuccggguucaagugauucuccucccucagccucuggaguagcugggauuacaggugccagccaccacgcccugguaauuuuuguauuuuuaguagagacgugguuucaccauguuggccaggcuggucuggaauuccugaccucaggugauccacccaccugggcuuccuaaaguguugggauuacaugcgugagccaccgugcuuggcuaguuucuuuucuuuuuuucuuuuuuuuuuuuuuugaaauggagucuugcugugucacccagacuggaguacgguggugccauuucggcucacugcaacuuccaccucccagguucaagugauucuccugccccagagccuccugaguagcuggaauuauaggugugcaccaccacaccuagcuaauuuuuguauuuuuaguagagacaggguuucaccauguuggucaggcugaucuugaacuccugaucucaggugaucugccugccuuggccucccaaagcccuggcaugagccccuguaccugccuaaaugguaaguuuccuaagaucuuauaacaagucagugauaccugggucuggaacugagaccauugaauuucuaauuaaggaucccuuuugugcuaugccacacuucugacuucuacuuauugauugcauuuuuuccccauuauccuuagucuugugucauugucuucaaauccagggaaaugacuuguucuguaggagcagcuagauaaggcaucccaguacgaaaguuucuaaaaaugaggacccuuguuuggagguuauuaagaauguuucuuaucuuaguauugucaucuggguagcucuuuguuucuuaagcugaugugacagauagcauccugguacuuggaugcuaucuaagaguagccacaggucgagaauggagcuaagcuuagagccuuauuuccuaggggcaggauucucuccuucagauucugccugugcuuugugaguguggacaugagaauuucuuuccauuccuucauucccugaaguuuucuccuucuguguaguagauaaguauagcuuugagaccggcauccugucuucuccuaccacagcuuauucaggucauaaugagagcugcagggguaaccugguuagcagagccuguuagcugcaguaauugcagcuucauaccuuauaggugagaaaccagaucuuucugguaagcagucugcucugugaacagaagcccaagguguaagguauaccucugucccuuaaagaggaaacaguggaggaugcaguguggucugggacagggggauugggcaugaacucagccagugggcuuaguuucuauucccauaccucauuggcuuacacaggguccaucuucucugcuucuaagccuaaauuuuuagucauauuacacaguccugccuuauaccuugacuucucagggauagauuauguagcaaaggggcauuggaagagcugugauucugguccugacucuaacacacuuugaguggggcaagccauauaaaaacucuugagcauguauguccaccuguuaaauggagguaaugauucuuugcccugccuaccucacaggauugugaggcccaaaugagguccuccuguaccuaagagugcuuugaaaacuugggaaguacugugaaaaagcggagagaucauauuggaauguugugaacugcuugcuuguugcagucuaucucucuugccuuaauuggacaugggcugagagaugggucauaccaaaacgugaguggucauuuccaguguuugagaguuaggccucaaaagugagcuaggccucaaagguguuuggugaguuuggguugagaacacugaagaacugagugaucuaggaacgcuuucugcauuuuguucugcugguuuguacuuacaggagaugugaagauuuuuauccuguguugcaguucaucuuugcuccuucuucucucaccaggaaguugggugagauggcaggguuuguaaaggggagaaugggaagaaggcuguaggcaaagaugacugcuugggacagucagaagcuuuguuauaugggagcuacauuuuaugacauacuccuggagaggaggguuuggaggccuuggagguagcuggcaacagcugggugcuguuguguguccaauuugggacccaucagguagcaugcccugccccccuaauugcuaacccucugucugcugcuuuaucagacuacgcguuuguucacauggagaaggaagcagaugccaaagccgcaaucgcgcagcucaacggcaaagaagugaagggcaagcgcaucaacguggaacucuccaccaagggucagaagaaggggccuggccuggcuguccagucuggggacaagaccaagaaaccaggggcuggggauacggccuucccuggaacugguggcuucucugccaccuucgacuaccagcaggcuuuuggcaacagcacugguggcuuugaugggcaagcccgucagcccacaccacccuucuuuggucgcgaccgcagcccucugcgccguucaccuccccgagccucuuauguggcuccucugacggcccagccagcuaccuaccgggcccagccguccgugucacugggagcugccuacagggcccagccuucugccucuuuggguguuggcuaucggacucagcccaugacagcccaggcagccucuuaccgcgcucagcccucugucucccuuggggcaccauacaggggccagcuggcuaguccuagcucccagucugcugcagcuucuucacucggcccauaugguggagcccagcccucagccucggcccuuuccuccuaugggggucaggcagcugcagcuucuucgcucaacuccuauggggcucaggguuccucccuugccuccuaugguaaccagccauccucuuacggcgcccaggcugccucuuccuaugggguucgugcagcugcuucuuccuacaacacccagggagcagcuuccuccuuaggcuccuacggggcucaggcagccuccuauggggcccagucugcagccuccucacuagcuuauggagcccaggcagcuucauauaaugcccagcccucggccucuuacaaugcccagucugccccauaugcugcacagcaggcugcuuccuacucuucccaaccugcugccuauguggcacagccagccacagcugcugccuaugccagccagccagcagccuacgccgcacaagccacuaccccaauggcuggcuccuauggggcccagccgguugugcagacccagcugaauaguuacggggcccaagcaucaaugggccuuucaggcuccuauggggcucagucggcugcugcggccacuggcuccuauggugccgcagcagccuacggggcccaaccuucugccacccuggcagcuccuuaccgcacucagucaucagccucauuggcugcuuccuaugcugcccagcagcauccccaggcugcugccuccuaccgcggccagccaggcaaugccuacgauggggcaggucagccgucugcagccuaccuguccaugucccagggggccguugccaacgccaacagcaccccgccgcccuaugagcguacccgccucuccccaccccgggccagcuacgacgaucccuacaaaaaggcugucgccaugucgaaaagguacuguaugcccccccgccucugcccccagcuggggcuuagggcaaggggcugagguuggcaugggagggaaacuggaggcaucggccccucccucggucuucucuucucuauuuuugugggauguccagaggccgaggggagcagugucuaugaacuuuccuggucaccaggguucagguggagcauagugcucagccuggggugguaccugcuagucaggccaggcacagugucaccugucuaggcuagcccaagugucauuggagcuacugccugcaggacuguggcccauauccuuucccacugucucaaggauccuuaagccuauuacgugguuguccuggcuuuggcagggauguggguuaaagaguagucccuuuggcauucacuggcuaaaggcaaguuuacgaggugcguccacucugggaaguuggggaccucgcuuucauccgccguucuguugauaaacaaccaaggucuuucucugcagggcccaggggcggagauaguuugcuguggugugggaauguagaccaaaauccaccuuggcuaguucagaggggaggacuucaguggaggguuugauuucccacugaguugaagccaggcuugauuuuuuuggccuggauagggugaugagccuucugacaaaaggagaccaaucucuuggagaccacugugaucacacccucccuguccccauuggcaucuccccaaugcccaccuggaguccuccccucaauugucucauucaccaacugucuucuucucucgacuagguaugguuccgaccggcguuuagccgagcucucugauuaccgccguuuaucagagucgcagcuuucguuccgccgcucgccgacaaaguccucgcuggauuaccgucgccugcccgaugcccauuccgauuacgcacgcuauucgggcuccuauaaugauuaccugcgggcggcucagaugcacucuggcuaccagcgccgcauguagggccauccugggauggggcaccacagggagggagggagaaaagagguggguaggguuacagauccagguuauaacuacucuggcccauaccuuuccugguugugguuuuucaugcccucuaccaugugggccuuccccaggagaugauccuguuaaguguucggcaguaaccuacuuuguuccuucgccucagcagcaaaucuugcuacuggcucuagaucugcgguuuccccucuacccugccucccgucuccccagaaugggaauuucuuuuauguuuuuauuuuuuuccuggcucccuuuuauuuuugugcgcgauauuuaaggucgucuggauggggaagcaaccugcagcugaggucgccggcgccuuuuucuuuuuagaugggaaggaggccaggaaagggucagcuuaaccauuuccuaugugccaagcugugccagcaguccaggguacccugacugucccucuguagacuguugagacugaguuccuguugggacagucaguugguauguauccaagucccugcugaccacuaauguucuagcugauggugagcggcacagucccacuuccccaucuccccaaguaggugguguuagaaaaccuuaauuuuuuuucccuuuuguauggacuacaaauaaaacuuggggcaauuugcaguuugga

SEQ ID NO: 21558 - RNA, 3452 nt, Homo sapiens
ucccauuaaugagccuuuuuauuauugucuuuuuuuuuuuuaaucgaaggucccuuacugguccugcuuccaugaguagccgugaccaggggaaaagggagaggaaccagccggcacagggaggggucaucuccacaacauuccauuuauacacagaacuaaacagacaagcacagagucacuauugcgguuagaaguuggcagcaugggaagggggaggaccagguggggaauggggauguuguuaaaaaaaauacaggcucccccacaacuggggugccuggggggaacuuggucugcuucagcccaagaggaaucaaaagaucaaaagcaguuugggaaggccagaaccgucaagggauggagggagaaggaaaauccaggggguggggggucuguuuggcaacuggggugaagggauugcccucccccugcugggauccccccagccccuccggucuggcaggaagggggcagccugcaacccccaagggcagguguggggcugccagaugcuccaggcagggggccagaaggggcucacaaaggcuugcccuccagggagaugacggcacugccccccagcuucucugccagggugcagcgguccuugaccuccucguagcaguuugcuugcaauucaugcuugaucccuauaaagaagaaaggggagcaucugugagcaggaagcacugggguggggguaguuucuguggcugggaaggagccaaucaaagcagauggaaggaacaagcaggcagcgaagacaagggggcagacccccucugcgugccauucacccugcccugcagccaaggccagagcagaagggcacucagcaccaaugcuggcccuuaccugucagcuucuucuugauggcguccuuggagcuggcauaaaucauuuugcucuuaaggggcgcagacucgggggcccuggacagaaacacgcgucaggcaacucccagcaacagcaaagccacaggugacuuugagaaacccuugggcuggcagugaggagucuuuuguuacaacccccucccccuccaaacccacacaucuggguugaccaggagccacagaaguucccaucaugagaaagggggcaggugacaggaagaagugccagaaugagcucaccagaagauaaacaccagauccuccuucuugcucuccuuggucucauagguugcaucauagagggcauagcggcaguccuuaucuggcagcaucuugacaaagguggcguaggggucgucgacagucuggcccacaucgcccaccaggaucuccuugcccuccuccaggaugauguucuucuuguccucacucaggcagaagagcaccgccuucuugcgcuucuucaccuccucuggcguugaagacuuacgcaccuucaugucguugaacaccuugaugacaccaucagagacagccacaccggaggccuaggagacaugccacguauacgucaagaaaaggauucuagggaacugccccuuguuuuuucagaagaucucaguccacgucccgaguggucacuagugcccuucccaaggcaagucacuaguuuucccacccaagucacugucaaagaaccagaugggacacaaccucagaauggcagccauggccucugaucaccuaguucaacaaccccuucccucauuuuacaggauagaaaugcaaaacucgugaaaagcagaaccuugaccaaaaugugaacccagaauuaaaagauccaccggcuacugacucauuugcuacucacaguacuugcucucagccuuuggauaaaacuggugauuuagaacuucggauauggaggacccaaacaccugagccaagacuccucuucagaaagagccaagaccccacaaugcuagaugggaccccaaggacaccgaacaguuacaacaaacccaccagaacugcuuaauacaguuacuacacaaacgaccccuguucccagcuaggcucuuucccaaccaagacaagaauugcaacccccauuaaggacccugcccgacaacucccuucuuccgggaauggugcuaggccccagaagucgcugauaaaaauuaacaugccaaacucaagugcccagaggccucgaggucuuuaaacucuuccuacucugcgucgugcuucggggugcccgagccaggagagggaggggcaauccaagguaaaucuggucccccaaacuccccggaacugcagaagaagccggccacgugacucggccgcauccggagugggcggggacaggagaucggcugggcccggcccccucaccaaugcagaaacgcguauccgagaggcagcagcaucuccaggucccuaacccuguggaaucgcccuaaaacaacggguguaucagacccaucuccugcaggcaggagccugggcaagcuacauaaccuucgguuuucucagcccucgggccguauacagggggcggggugguuuccgggcggugcccgccugggucacuucccuaaacucggcuccacccucacucaggcccauccgggaaggccucgcuggcccagggcuucggcaccggcggccgggccugagcgugcgcgcacgcgccgacagacagcgccguuccagcccucgcccgaugcacgggugagaacgcagcucguuagaugcgcucccgaacgggccgcggucucugcgaugcccccuccaagccuugcggugcaaggccuuaaucgcaggcacccacgccccaaccgggaccccgucuucccagcaucaccccucgccgcgccagcacccgccccucccgggcgcaggcaucccugccaccugcucccgagacggacccggcugccgagggagggugacgcgcagacaggaacagccuuggguggggcgcgcgcgccgagaccucucgcgcgcuuuuuccucgccgcccccgggccggguuuggacgccgcaugcuccagucgagagcgcgccccuaagaagaaaggcgcgacgccggccguuccgcgaggggcgccccagcgcgcgccccgaaccccuccccccgcggccgguguccgcgcgggcgcaccagcgggugggggaggggagcccaggcggagcgcgagcgacguccagaccggcccuccccggcgcccacgggcgcgcacgcgcauuccggcaccgcccgccccuucgugcgagacccucaucccgcccggggcgcugggggagggggugcggacgucgcuccccagucgcuucccgcgcgcaggcgaccgacccgcagccgccucccucaggcgccguggccugccgcucaccauguuuccggaaacgaaaaggagagggcaccgagagccgcagaagacgagagcgcugcagccgcugccgggacccgacugaacgcggccucucccggccccuuccguuuaguaggagccgcacaaugagggguggggcgggcuuccggcg

SEQ ID NO: 21559 - RNA, 6916 nt, Homo sapiens
auggcggagguggugaguccggugcccggggcggggcggagggagccaggggagguggguagagcccgaggccccccaguagccgacccuggcgucgcgcugucuccccagggggagauaaucgagggcugccgccuacccgugcugcggcggaaccaggacaacgaagaugaguggcgugagugacguuggggggcgggacuaaggaaccugagggcgaggggcgggagucaacugaaaucccgggauggggaggggcgucuggaauuauggggcgggcgaggcgcagauacuuugaugaaggggcguggcucuuagcugcuccgagagguacagggcggggccuggaaagggguggcacuugugacugaaggaggcuuaggagagaccuaagugcuggagcuuagggauccggccuggggguggaguucaggucguggaaggguggagucucauagccuggccugucuaaggccccugucuaugcuauucucauagcccuggccgagauccugagcgugaaggacaucaguggccggaagcuuuucuacguccauuacauugacugugaguucugggccugagguggggcaucaggguaggguugggggacagucuuuggcauucuguccugagccauccccacugcuacagucaacaaacgucuggaugaaugggugacgcaugagcggcuggaccuaaagaagauccaguuccccaagaaagaggccaagacccccacuaagaacggacuuccugggucccguccuggcucuccagagagagagguggugaguaggucccccacuucaccuuuucucuccugccuccuauuucucuugucuguuggcauuaggagcuccuggaugggcaggaggcggcucccucucacccugacuucaucuugcaaaggaugggggccaaauugcacauguagcucccagaguccaguagcuaguccuguguccuucagaaggcgagggugggguuugauaauuuugaggugagggaccccucuuccccuuccccaucccacugccauccccgccccaaaggaagacccuggaccuaucucuacagccggccucggcgcaggccagcgggaagaccuugccaaucccgguccagaucacacuccgcuucaaccugcccaaggagcgggaggccauucccgguggcgagccugaccagccgcucuccuccagcuccugccugcagcccaaccaccgcucaacgguacccucagcaauuccagggaccuugcuuucuucucaggucccaccuucucuaccuucugacccaccuuuguugguuucucucugcagaaacggaagguggaggugguuucaccagcaacuccagugcccagcgagacagccccggccucgguuuuuccccaggugaguuccccaaaccaucucuuguucucuuccucucuucuacucucugguggcuuuuuucaggcucauuucacagccaucccuucuuuuccuacuaucucggcagaauggagccgcccguagggcaguggcagcccagccaggacggaagcgaaaaucgaauuguuugggcacugaugaggugggucuggggagcagcagaagggaacugggugaaaaggaagggaugcaggcaggguggagaguuauuuagugaugaguuuaaaaauaaagaagggguggugggcagagcuaguguuggugggauuaggagacaggcagaacauuguucaaaugagucauuggggccgggcaccauggcucauaccuguaaucccagcacuuugggaguccaaccaaggcugguggaucaccugaggucaggaguuugagaccagccuggccaacauggugaaaccuuguuucuacuagaaauacaaaaauuagccaggcgugguggcgggugccuguaauccagcucggaaagcugaggcaggagaacugcuugaaccccggagguggagauugcagugagccaagaucgcgcuacugcccuccagccugggcgacagacugagacuccaucuaaaaaauggggucauugggugaucuuuuccacaucaucgauccuuuaggguuucagguuuuuuaucuggaaauuggggaucaugguaccucccccuuaggguugcuguuaggcuugaaggaaaccugucaaagggcugugagcugugguguccugcugagcugucucuuacaaccugguauuuuccacuggcccugggcaggacucccaggacagcucugauggaauaccgucagcaccacgcaugacuggcagccuggugucugaucgaagccacgacgacaucgucacccggaugaagaacauugagugcauugagcugggccggcaccgccucaagccgugguacuucuccccguacccacaggaacucaccacauugccuguccucuaccugugcgaguucugccucaaguacggccguagucucaagugucuucagcgucauuugguaugagggguccagggaggcugccuucccagcacccuccacguugcccuuguuccugauccuccucucuuccccagaccaagugugaccuacgacauccuccaggcaaugagauuuaccgcaagggcaccaucuccuucuuugagauugauggacguaagaacaagguuagugcuugagaggcagugaggcgcuggggugaaucaaaugacagcuucuucuugcucagguaaacacugaccagucaagccagcagaucaguccagcccauuuuuauugaguuccugcugucuggcaggugcugguagccaggaaugagacagucucuguucucugacagcuuaguccaugggagagacagucauaccaaugaccucuagcucccaguguccuaagugucaugaaacagaggguagguuagcaggacccaaaggagguggucagcagagcuucauagaggguuaccuuucagccuugguggaugacaaaguggcugaggggauuucuugcagugguguucugaagaguaggcauggaugcacaaagguggucuuugugaaaggcagagaucauucugguugggaggcagaaaagggaggaugagggaaggcucguacaugggacagagcuuaggugaugaagaugcuguguuaaccaccauuuuguaauuauuaauguggaccugggcauccaaguggcaguacccagcagcaggcgguuaaaaagcaauuccugggcugggcacgguggcucacaccuguaaucccagcacuuugggaggcugaggcgggcggaucacaaggucaggagaucgagaccauccuggcuaacacgguuaaacccugucucuacuaaaaaguacaaaaaauuagcugggcgugguggcgggugccuguaaucccagcuacucgggaggcugaggcaggagaauggcgugaacccaggaggcagaguuugcagugagccgagauugcaccacugcauuccagccugggagacagcaagacuucguguaaaaaaaauaaauaaauaaaaagcaauuucuggcugggcacaguggcucauaccuguaaccccagcacuuugggaggccaaggugggccaaucacuugagcccagaauuucgagaccagccugggcaacauggagaaacccccagguacucgggaggcugaguugggagaaucaccugagccugggaagucaaggcugcagugacccacgauugcaugauugcaccacugcacuccagccugggugacaggagugagacccugugucaaaaaaaaaaaaaaaaaacccacaaugucugaaaugcaggagaaaucgugugcagaaguaaagcagcaggauucauaauuuugcugggguaaacccuaaggcaguuauuuuguuaaauuccagaauuccuuaacucuguuguagaguagcagaucaguucccaggaggugugacuguggauguagaauguuagguuuuuuaacagcuagacucccaagacuguuagauagggagucaguggucagagucucacuuuggacacauuaguuugaggagccguggucagagucucacuuuggacacauuaguucguuggcugcuguuaaaaaacauuaaaaggcaguggucucuccuggucaggcuuagaauggaggugugcggagcaaggcgggaaacuugccugacugagcagggaggcacucagacaccaucacacaucuggcacacaggcuuuucaacacugaggagcagcccugccuaagcugcgggcugguggagugggucaggcccagccagggaagaacacucaucaccuagcagccuggggcauagcacgaacagugaagcuccugguugacccugaaccacuggccaggcucaaggcgggauacccagaguggugacaagccuuuucucuugcagaguuauucccagaaccugugucuuuuggccaaguguuuccuugaccauaagacacuguacuaugacacagacccuuuccucuucuacgucaugacagaguaugacuguaagggcuuccacaucgugggcuacuucuccaaggucagugccugcccaagcugucccugugcccuguccugagccagaucccuucccugacacucaccugucccccuucuccaggagaaagaaucaacggaagacuacaauguggccugcauccuaacccugccucccuaccagcgccggggcuacggcaagcugcugaucgaguucagugaguaugugugcugcggccaggggguaguggacccacuaucggugccucacaggcagaugggccaggcuacugugauucucaacccuggcugugcagcccagccucuaggggaaccagccagaaauaacaguggcacucucccgggguucucuccguucaggcugacugcccugcuuaucugggguagguucucagccccccaguuugcuccuuggccaggguucuaagugccacucagcuuuccccaaaucugacuuacgugcuccugccuggagccaugggcagaagguuagugagccgcuggugcugauguaucugguaacgugugccaugauacgaguacuggggcaaggaccaguggcuaauguccccaguuguccccugagccuugcaggcagguauccaaaaugcugucagcagauagacauaagcauguugucccucgcuccuuguguccagugaggucagucucuuaaagccagaagggacucugaacuucaucacacaugggcucuucagugcccuccccaacccugaggccccuucuucccagccucuuacuccccaucaccccccauucugucugucucaccacucacuuggaauaaccaagcucugaccugagaaacaaggaggaaguucuagcuguugaccuggugaagacacagaggcuuuaccugaucaagguuaugguccauucgagaaauuuuauugguuaaaugaugcccagauggggucacauccucagaacuucucagccugguagcacaaguggaugcuugaagaaacucagucuuggaacucagacagcaauggagacgggaugugagugggaccagcaaggggcuaagguccauuaugagggugaggaagggcuucuagaaguaacaaacaucccaggucccugacuggggagaaugaagacacugaccaagagaugugaagccacucagggcugugcagggucugaggaucucacuggggacggccucccagcggccagcuaucagcacgaguuggagggaaagagccauggugggggucagucacguggcucccaggaauggucuccccgacuuaggaagcaccuuggugcaccuuuucuccuugcauccucacaaccacccagucaggccacucaagucuuacagcaggugacacucccaaggucccagcuaggaggacuuugagaauucaagcauucucaggucuggauuagagacaggaaucugucuccacuuccuuacauggcuagacacagagcccgggauggcaaaggaaaauuggaggccccuucuucccaugagccauuuucucugcauccccugcccauaagccuucacuggccucugaucacccucaugguugacugcagcugcuccucucagugcccucaugcccuccacugugcucagcgcacggaaagagugaauacucaguucuuccugagggaacugaggcacagagaaguggagggcauagaacugccaaguggcagggccaugauaggaacuaggcagccugccuuggcaaccuguguuuuuaaauguugcuuauguucaucugugaccucuuacucacccucuccugcuccauugcuuuaggcuaugaacucuccaaaguggaagggaaaacagggaccccugagaagccccucucagaccuuggccuccuauccuaucgaagcuacuggucccagaccauccuggagauccugauggggcugaagucggagagcggggagaggccacagaucaccaucaagugagccuggcgcugucuaccuggggguacauggcauggcuugucuguuccugggcuuucucucucagggcuccuggggacagauaaagguccucagggaaccugaccugugcucucccacagugagauuagugaaaucaccagcaucaagaaggaggaugucaucuccacucugcaguaccucaaucucaucaacuacuacaagguagggaggcaggcaggggagacaggugugugggaugcagagugcaguccucugugggcugaccaccugcugaacccaucuccucugcccagggccaguacauccucacacugucagaggacaucguggauggccaugagcgggccaugcucaagcggcuccugcggaucgacuccaagugucugcacuucacucccaaggacuggagcaagagggggaaguggugacc

SEQ ID NO: 21560 - RNA, 7675 nt, Homo sapiens
uguugugacucucccuaaauguuuaagaaaacauuucauuccccucaggcuuguauagucugucccuggccuacuccccgcuccaggugguacagcccgcaagcggcuccccuucccagcugcucgcggggccgagucccccaguccgaggaggccacucagcgcaggagccauaccaucugugacuaauaaauaauagggggaccuccgacuccccccuguugccuuauuaccuuccgaccaccucucggaccucuugcccagcccuuccccguagacaucaccccagauacgguggugacaccauugcuaugggcccacguagggcgcagugcgagccagggcaggacgcacuugguacgacccacgccgcgccccgcgccgccggaagugaggugucugacccccgaaguuccgguucgcaggggguggggaguguuguuaaccggaggggcagccgcagucgcgcggauugagcgggcucgcggcgcuggguuccuggugaguggggcgaagucuggcccgaguugugguuggggucgggacccgaaccuuccccuugaggucuccggagucggcacgccccucagccccgccgcacgcuuucggccugucagcuggccggagaccucagacgccggugcggccgcuuugcucaagccugggcccugccugcgacgcccgcaacuccuggugcucacaggugcgcggccgcgagggcgacccggcuccucccgucccgcugcugcucucucccgucccgcuguuuuuguggugcucugaguugacacuacuccgggggucgggggaccccaggauuccaggcugacguuccccgcccgcucccgcagggcgggcguccgaacugcccacccuaacacagcugucaccggcgcugucgccugcccagccugcuauccucugugccuuggcugcucucagcccuggcugcgcauucccgccccuggagcagauuucugcuguugccucccaccccaucuucuccaccggagggucagcggugcagcucccccuccuccaacauugcagcuuuuccucaucaccucccuagaggaggcggcuuggcaggcagcguggaaagagcccuagauuugaagcaagacugacccagguuccaggccuugcgucagugugaucacuuaaccccuucgagucuaauuuguaaaaugggguagcguaagcuauucuuugucugaugauuucgagggcgaaaugugauuucccccccacuuucuccuaugaauugaggcugugccaggcaccgggcuauuuugcacagcacgagcaucacauaaguuauuuucuugccccaugcaggucuccgggccagggcaauguuccgcacggcagugaugauggcggccagccuggcgcugaccggggcugugguggcucacgccuacuaccucaaacaccaguucuaccccacugugguguaccugaccaaguccagccccagcauggcagugaguucagggcucagggagggaggaacucccugggagggaaggaggagucugccugggcaaggggcggggcuagaggucagguaaguagggaaguagccgccagcugccuaacuuugaauaaacugugaugaggauguggaggauccugcaugaugagucccaaggagaggaaagcagaaagugaccucaaaccacagccucuccccacuccuagguccuguacauccaggccuuuguccuugucuuccuucugggcaaggugaugggcaagguguucuuugggcaacugagggcagcagagauggagguaagaugucggcugccccaaaggugagggcagggugcugggaaagaauguuugguauccacauuauucccugccuggcccccagcaccuucuggaacguuccugguacgccgucacagagacuugucuggccuucaccguuuuucgggaugacuucagcccccgcuuuguugcacucuucacucuucuucucuuccucaaauguuuccacuggcuggcugaggaccguguggacuuugugagucaaggcagggaguucuggagcagguggaagccagggaguagccagcgggcaggcuuaaggagcagggagggcuagguugaggguguggggugagccccaggccuccugacaggccucuucugugcucugccucagauggaacgcagccccaacaucuccuggcucuuucacugccgcauugucugugagugagauucaggggaggggaagggaggacuggaacgugaaccguggaccuguacuccagagcacaggcuaccccccacagcuguacaggaaagauaauuuaggaaguuaauuugcauagucucugugcuguuccacucuagggcuucucaacugccugggcccucagcccuuugccuucucaccugcagccugggcagccccaacaacucccccucccccaggaaguucccagagggccagguucaguggagugugcccaccugacuagaucgcuggggccauggugggcuugaggguggggcuguccuagagcauuaaacagcuguugggcccugggcugacccccccacccugcauguguggggguccccacagcucuuauguuccuccugggcauccuggacuuccucuucgucagccacgccuaucacagcauccugacccguggggccucugugcagcugguguuuggcuuugagguaaaacuggcuugggagguugagaggacaagcccgaggugaccccacaugugccuugaauaacccaacagacccuuccucagcaccugcuauguggccaaccugugcuggccaccaaggggcagugaucagauauggcuccugcccuccacacgcucacuccuaggugacuggggagacgcacaaagaggcuaggacagaggaggagccccaaccuggggcucaggagaggguuccuggaggcucgugccggagcuagcugguaauggacaggagaggauuaguuccauggacaacuggaggcgugucccuggcagagagagaauguguucagugacaacagcucauauuuguugagugcgaauuucacaccaggcccuaugcugagcuccugaccugcaucucuuauucagcaagacaauacuguuauaaaggaacaguuaauuaugucauuuuauagauaaguaaacugagguucacugaguugccaaaagucacagcuaguaaguggaggggcuaggaggacccugggugugucuagagccugugauuguaccacugcaccugcugugcagaggccuuggggagcaaugugggugcagcaagggggagcuauguguuuacaucccccucgucccccucucccuucaguaugccauccugaugacgauggugcucaccaucuucaucaaguaugugcugcacuccguggaccuccagagugagaaccccugggacaacaaggcuguguacaugcucuacacagagcuguuuacaggugagaggggccugggccucuccugaucuggaccagcauccuccacucugccuccuggcccugugaccugcugcuuucugcauccccuccccucaggcuucaucaagguucugcuguacauggccuucaugaccaucaugaucaaggugcacaccuucccacucuuugccauccggcccauguaccuggccaugaggugagcccggcccugucccccgauccuccugaccugaucccgucccuucuccugcuuucacugacuguccuuucagacaguucaagaaagcugugacagaugccaucaugucucgccgagccauccgcaacaugaacacccuguaaguaggcuugucauggcugcugucccaagcucgguccugggucccucugcuuccagcucuggaccugauacagccccugucauccuaaccagguauccagaugccaccccagaggagcuccaggcaauggacaaugucugcaucaucugccgagaagagauggugacuggugccaagagacugcccugcaaccacauuuuccauaccaggugggaggggcccuggggagccugcacagcaggcacaggccccagaaggcaggccccuagggaccugcugaccucugccuggccuugacccgcagcugccugcgcuccugguuccagcggcagcagaccugccccaccugccguauggauguccuucgugcaucgcugccagcgcagucaccaccacccccggagccugcggaucaggggccacccccugccccccaccccccaccacucuugccucagccccccaacugugaguauccccuugucuggccacccggcauaccacuggauacuugcccugggcuggauguggaagaugcugggaaauuggagagucccugcccuccagaaucucagucugggccagggagggauuaaaagaugagaaauagaugcuugcagucagugugaccagugcugggcugagggccugugggaauaggacagagcucucaauagccaggcccccugccugggaguugggucuguguccauuuggcccuuuccuuaccuccgucuucucucugcagucccccagggccuccugccuccuuuuccuccaggcauguucccacuguggccccccaugggccccuuuccaccugucccgccuccccccagcucaggagaggcuguggcuccuccauccaccagugcaggugagccuuuggguacugugacagccagggggcggcagggauggaacacucacugacuucguuccugcucuucagcagcccuuucucggcccaguggagcagcuacaaccacagcugcuggcaccagugcuacugcugcuucugccacagcaucuggcccaggcucuggcucugccccagaggcuggcccugccccugguuuccccuucccuccucccuggauggguaugccccugccuccacccuuugguaagcugggccacucucuggguucuucuugggggugagguuggugucuggccccagcagcccagacugagccucucucucuccagccuuccccccaaugccugugcccccugcgggcuuugcugggcugaccccagaggagcuacgagcucuggagggccaugagcggcagcaccuggaggcccggcugcagagccugcguaacauccacacacugcuggacgccgccaugcugcagaucaaccaguaccucaccgugcuggccuccuuggggugugucuguacaggggaagcagaguggguuuggugggucaggaguggagcugccaagagguccccagcagugguucuuggccuuugacaccugccaauucaggcugccuaucuacaggcccaccaagggucuccaggaguucuugguaacuccuggugccuuuauuucccacuccagaaagcaugucuggaucuaaguaggagugauguuuauucgagagcugacuuuagaucuuauuccuuuauauuuuucuaaagucaaauuauucagaauuugcagugcuuuaguucaucacaugauauucuucugagauguggugacacuuagauuggcaauugcugcccccaaacugagggagcgaauaauaggaagucacuuggagccauccuggcucaaguucaagcgcuggucccaucacucauuuuugaccucucauuauuugaauaaaggggucuuaauucauauucauaagugauguguacugccagauacacaccuauaaucagcacuuuggaaggcugaggcaggaggauuguuugagccuaggaauuugagggugcagugagcuaugauugugccacuaaauuccagcuuuggugacagagccgagacgcugucuuuuaaaaaagugacauguacauaaugccuggcaucuagcagugacagcacaggcuuggagaggaacuugaguccaaggcucgagcacuguggcuuauugagugaguccccuauaaggugccugacuccccaggguggagacugcaggguaagagugaacaggucaacagucccugccugcaagcaccuuacagcuaagggauagaaucauuuggcccuugaguccagucacccugucugaguucauucagcauguucacuuguguuugccaggcacuggggccacaagggcacaucauucuauacucuguucugcaaggcucaccaagggcaggagaaucugcccaaccuuggaugccaaggccaggcccgccucucgucccuucucuucccaggcccccccggccugccacuucagucaacuccacugaggagacugccacuacaguuguugcugcugccuccuccaccagcaucccuagcucagaggccacgaccccaaccccaggagccuccccaccagccccugaaauggaaaggccuccagguaggugugauuggccuccagccgggggagcagggaacuucucuagguuccacuuccagucucucuguccccagcuccugagucagugggcacagaggagaugccugaggauggagagcccgaugcagcagagcuccgccggcgccgccugcagaagcuggagucuccuguugcccacugacacugccccagcccagccccagccucugcucuuuugagcagcccucgcuggaacauguccugccaccaagugccagcucccucucugucugcaccagggaguaguacccccagcucugagaaagaggcggcauccccuaggccaaguggaaagaggcugggguucccauuugacuccagucccaggcagccauggggaucucgggucaguuccagccuuccucuccaacucuucagcccuguguucugcuggggccaugaaggcagaagguuuagccucugagaagcccucuucuucccccaccccuuuccaggagaaggggcugccccuccaagcccuacuuguaugugcggagucacacugcagugccgaacaguauuagcucccguucccaaguguggacuccagaggggcuggaggcaagcuaugaacuugcucgcuggcccaccccuaagacugguacccauuuccuuuucuuacccugaucuccccagaagccucuuguggugguggcugugcccccuaugcccuguggcauuucugcgucuuacuggcaaccacacaacucagggaaaggaaugccugggagugggggugcaggcgggcagcacugagggacccugccccgccccuccccccaggccccuuuccucugcagcuucucaagugagacugaccugucucacccagcagccacugcccagccgcacuccaggcaagggccagugcgccugcuccugaccacugcaaucccagcgcccaaggaaggccacuucucaacuggcagaacuucugaaguuuagaauuggaauuacuuccuuacuagugucuuuuggcuuaaauuuugucuuuugaaguugaaugcuuaaucccgggaaagaggaacaggagugccagacuccuggucuuuccaguuuagaaaaggcucugugccaaggagggaccacaggagcugggaccugccugccccugucuuuuccccuugguuuuguguuacaagaguuguuggagacaguuucagaugauuauuuaauuuguaaauauuguacaaauuuuaauagcuuaaauuguauauacagccaaauaaaaacuugcauuaac

SEQ ID NO: 21561 - RNA, 7675 nt, Homo sapiens
guuaaugcaaguuuuuauuuggcuguauauacaauuuaagcuauuaaaauuuguacaauauuuacaaauuaaauaaucaucugaaacugucuccaacaacucuuguaacacaaaaccaaggggaaaagacaggggcaggcaggucccagcuccuguggucccuccuuggcacagagccuuuucuaaacuggaaagaccaggagucuggcacuccuguuccucuuucccgggauuaagcauucaacuucaaaagacaaaauuuaagccaaaagacacuaguaaggaaguaauuccaauucuaaacuucagaaguucugccaguugagaaguggccuuccuugggcgcugggauugcaguggucaggagcaggcgcacuggcccuugccuggagugcggcugggcaguggcugcugggugagacaggucagucucacuugagaagcugcagaggaaaggggccuggggggaggggcggggcagggucccucagugcugcccgccugcacccccacucccaggcauuccuuucccugaguugugugguugccaguaagacgcagaaaugccacagggcauagggggcacagccaccaccacaagaggcuucuggggagaucaggguaagaaaaggaaauggguaccagucuuaggggugggccagcgagcaaguucauagcuugccuccagccccucuggaguccacacuugggaacgggagcuaauacuguucggcacugcagugugacuccgcacauacaaguagggcuuggaggggcagccccuucuccuggaaaggggugggggaagaagagggcuucucagaggcuaaaccuucugccuucauggccccagcagaacacagggcugaagaguuggagaggaaggcuggaacugacccgagauccccauggcugccugggacuggagucaaaugggaaccccagccucuuuccacuuggccuaggggaugccgccucuuucucagagcuggggguacuacucccuggugcagacagagagggagcuggcacuugguggcaggacauguuccagcgagggcugcucaaaagagcagaggcuggggcugggcuggggcagugucagugggcaacaggagacuccagcuucugcaggcggcgccggcggagcucugcugcaucgggcucuccauccucaggcaucuccucugugcccacugacucaggagcuggggacagagagacuggaaguggaaccuagagaaguucccugcucccccggcuggaggccaaucacaccuaccuggaggccuuuccauuucaggggcugguggggaggcuccugggguuggggucguggccucugagcuagggaugcugguggaggaggcagcagcaacaacuguaguggcagucuccucaguggaguugacugaaguggcaggccgggggggccugggaagagaagggacgagaggcgggccuggccuuggcauccaagguugggcagauucuccugcccuuggugagccuugcagaacagaguauagaaugaugugcccuuguggccccagugccuggcaaacacaagugaacaugcugaaugaacucagacagggugacuggacucaagggccaaaugauucuaucccuuagcuguaaggugcuugcaggcagggacuguugaccuguucacucuuacccugcagucuccacccuggggagucaggcaccuuauaggggacucacucaauaagccacagugcucgagccuuggacucaaguuccucuccaagccugugcugucacugcuagaugccaggcauuauguacaugucacuuuuuuaaaagacagcgucucggcucugucaccaaagcuggaauuuaguggcacaaucauagcucacugcacccucaaauuccuaggcucaaacaauccuccugccucagccuuccaaagugcugauuauagguguguaucuggcaguacacaucacuuaugaauaugaauuaagaccccuuuauucaaauaaugagaggucaaaaaugagugaugggaccagcgcuugaacuugagccaggauggcuccaagugacuuccuauuauucgcucccucaguuugggggcagcaauugccaaucuaagugucaccacaucucagaagaauaucaugugaugaacuaaagcacugcaaauucugaauaauuugacuuuagaaaaauauaaaggaauaagaucuaaagucagcucucgaauaaacaucacuccuacuuagauccagacaugcuuucuggagugggaaauaaaggcaccaggaguuaccaagaacuccuggagacccuuggugggccuguagauaggcagccugaauuggcaggugucaaaggccaagaaccacugcuggggaccucuuggcagcuccacuccugacccaccaaacccacucugcuuccccuguacagacacaccccaaggaggccagcacggugagguacugguugaucugcagcauggcggcguccagcaguguguggauguuacgcaggcucugcagccgggccuccaggugcugccgcucauggcccuccagagcucguagcuccucuggggucagcccagcaaagcccgcagggggcacaggcauuggggggaaggcuggagagagagaggcucagucugggcugcuggggccagacaccaaccucacccccaagaagaacccagagaguggcccagcuuaccaaaggguggaggcaggggcauacccauccagggaggagggaaggggaaaccaggggcagggccagccucuggggcagagccagagccugggccagaugcuguggcagaagcagcaguagcacuggugccagcagcugugguuguagcugcuccacugggccgagaaagggcugcugaagagcaggaacgaagucagugaguguuccaucccugccgcccccuggcugucacaguacccaaaggcucaccugcacugguggauggaggagccacagccucuccugagcuggggggaggcgggacagguggaaaggggcccauggggggccacagugggaacaugccuggaggaaaaggaggcaggaggcccugggggacugcagagagaagacggagguaaggaaagggccaaauggacacagacccaacucccaggcagggggccuggcuauugagagcucuguccuauucccacaggcccucagcccagcacuggucacacugacugcaagcaucuauuucucaucuuuuaaucccucccuggcccagacugagauucuggagggcagggacucuccaauuucccagcaucuuccacauccagcccagggcaaguauccagugguaugccggguggccagacaaggggauacucacaguuggggggcugaggcaagaguggugggggguggggggcaggggguggccccugauccgcaggcuccgggggugguggugacugcgcuggcagcgaugcacgaaggacauccauacggcagguggggcaggucugcugccgcuggaaccaggagcgcaggcagcugcgggucaaggccaggcagaggucagcaggucccuaggggccugccuucuggggccugugccugcugugcaggcuccccagggccccucccaccugguauggaaaaugugguugcagggcagucucuuggcaccagucaccaucucuucucggcagaugaugcagacauuguccauugccuggagcuccucugggguggcaucuggauaccugguuaggaugacaggggcuguaucagguccagagcuggaagcagagggacccaggaccgagcuugggacagcagccaugacaagccuacuuacaggguguucauguugcggauggcucggcgagacaugauggcaucugucacagcuuucuugaacugucugaaaggacagucagugaaagcaggagaagggacgggaucaggucaggaggaucgggggacagggccgggcucaccucauggccagguacaugggccggauggcaaagagugggaaggugugcaccuugaucaugauggucaugaaggccauguacagcagaaccuugaugaagccugaggggaggggaugcagaaagcagcaggucacagggccaggaggcagaguggaggaugcugguccagaucaggagaggcccaggccccucucaccuguaaacagcucuguguagagcauguacacagccuuguugucccagggguucucacucuggagguccacggagugcagcacauacuugaugaagauggugagcaccaucgucaucaggauggcauacugaagggagagggggacgagggggauguaaacacauagcucccccuugcugcacccacauugcuccccaaggccucugcacagcaggugcagugguacaaucacaggcucuagacacacccaggguccuccuagccccuccacuuacuagcugugacuuuuggcaacucagugaaccucaguuuacuuaucuauaaaaugacauaauuaacuguuccuuuauaacaguauugucuugcugaauaagagaugcaggucaggagcucagcauagggccuggugugaaauucgcacucaacaaauaugagcuguugucacugaacacauucucucucugccagggacacgccuccaguuguccauggaacuaauccucuccuguccauuaccagcuagcuccggcacgagccuccaggaacccucuccugagccccagguuggggcuccuccucuguccuagccucuuugugcgucuccccagucaccuaggagugagcguguggagggcaggagccauaucugaucacugccccuugguggccagcacagguuggccacauagcaggugcugaggaagggucuguuggguuauucaaggcacauguggggucaccucgggcuuguccucucaaccucccaagccaguuuuaccucaaagccaaacaccagcugcacagaggccccacgggucaggaugcugugauaggcguggcugacgaagaggaaguccaggaugcccaggaggaacauaagagcuguggggacccccacacaugcagggugggggggucagcccagggcccaacagcuguuuaaugcucuaggacagccccacccucaagcccaccauggccccagcgaucuagucaggugggcacacuccacugaaccuggcccucugggaacuuccugggggagggggaguuguuggggcugcccaggcugcaggugagaaggcaaagggcugagggcccaggcaguugagaagcccuagaguggaacagcacagagacuaugcaaauuaacuuccuaaauuaucuuuccuguacagcugugggggguagccugugcucuggaguacagguccacgguucacguuccaguccucccuuccccuccccugaaucucacucacagacaaugcggcagugaaagagccaggagauguuggggcugcguuccaucugaggcagagcacagaagaggccugucaggaggccuggggcucaccccacacccucaaccuagcccucccugcuccuuaagccugcccgcuggcuacucccuggcuuccaccugcuccagaacucccugccuugacucacaaaguccacacgguccucagccagccaguggaaacauuugaggaagagaagaagagugaagagugcaacaaagcgggggcugaagucaucccgaaaaacggugaaggccagacaagucucugugacggcguaccaggaacguuccagaaggugcugggggccaggcagggaauaauguggauaccaaacauucuuucccagcacccugcccucaccuuuggggcagccgacaucuuaccuccaucucugcugcccucaguugcccaaagaacaccuugcccaucaccuugcccagaaggaagacaaggacaaaggccuggauguacaggaccuaggaguggggagaggcugugguuugaggucacuuucugcuuuccucuccuugggacucaucaugcaggauccuccacauccucaucacaguuuauucaaaguuaggcagcuggcggcuacuucccuacuuaccugaccucuagccccgccccuugcccaggcagacuccuccuucccucccagggaguuccucccucccugagcccugaacucacugccaugcuggggcuggacuuggucagguacaccacagugggguagaacugguguuugagguaguaggcgugagccaccacagccccggucagcgccaggcuggccgccaucaucacugccgugcggaacauugcccuggcccggagaccugcauggggcaagaaaauaacuuaugugaugcucgugcugugcaaaauagcccggugccuggcacagccucaauucauaggagaaagugggggggaaaucacauuucgcccucgaaaucaucagacaaagaauagcuuacgcuaccccauuuuacaaauuagacucgaagggguuaagugaucacacugacgcaaggccuggaaccugggucagucuugcuucaaaucuagggcucuuuccacgcugccugccaagccgccuccucuagggaggugaugaggaaaagcugcaauguuggaggagggggagcugcaccgcugacccuccgguggagaagauggggugggaggcaacagcagaaaucugcuccaggggcgggaaugcgcagccagggcugagagcagccaaggcacagaggauagcaggcugggcaggcgacagcgccggugacagcuguguuagggugggcaguucggacgcccgcccugcgggagcgggcggggaacgucagccuggaauccuggggucccccgacccccggaguagugucaacucagagcaccacaaaaacagcgggacgggagagagcagcagcgggacgggaggagccgggucgcccucgcggccgcgcaccugugagcaccaggaguugcgggcgucgcaggcagggcccaggcuugagcaaagcggccgcaccggcgucugaggucuccggccagcugacaggccgaaagcgugcggcggggcugaggggcgugccgacuccggagaccucaaggggaagguucgggucccgaccccaaccacaacucgggccagacuucgccccacucaccaggaacccagcgccgcgagcccgcucaauccgcgcgacugcggcugccccuccgguuaacaacacuccccacccccugcgaaccggaacuucgggggucagacaccucacuuccggcggcgcggggcgcggcgugggucguaccaagugcguccugcccuggcucgcacugcgcccuacgugggcccauagcaauggugucaccaccguaucuggggugaugucuacggggaagggcugggcaagagguccgagagguggucggaagguaauaaggcaacaggggggagucggaggucccccuauuauuuauuagucacagaugguauggcuccugcgcugaguggccuccucggacugggggacucggccccgcgagcagcugggaaggggagccgcuugcgggcuguaccaccuggagcggggaguaggccagggacagacuauacaagccugaggggaaugaaauguuuucuuaaacauuuagggagagucacaaca

SEQ ID NO: 21562 - RNA, 1507 nt, Homo sapiens
gacugaacuaaguggcuuuuuuauuagagaaagccagaauuacaaaagacuuaagaguuggcauuggggcccuucuucuugccaaaggugggcacaacguugacaaagcgccgguuguacugcauccgccgcuuagcccgaccugucuucuucuucuucuucuccuguuuggccaccuggagaagggaagguuaaucaggcccugguuccugucuuccacaccuagcaucccuucccucaggcucaucuccagggagggagaaggcaaaccgaguaagagcccagggacuugguuuagcugugaaaggaaaaaaaguccuaacaccaugaccacuaauacucucacucaccuuaggagucugaccucucacuuuuccagcacgggccagggaaccauggacuuuaccuguagugggaaaggaaggcaccagcagguaagagcaagaaggugccacccagcagaaccccucuuuucucaauucaagccuuuaaagagaagcugcgcccaauagguaaugagaacaaaguugcagauauuugaccuugaaaucuuaaguuucauuucaggaucuuccagcuucuaauuuuauagagcacuuugggggcccuggucugaccuaauuuuaguguggaagcugauaaccagacuaggaucucgugaugugacugaaauacaacuacacucuggcucagucucccauggacgucuguguucaacaugagggauguaaacaggaagaaucacucugaacugaagacagugagaaguacucuauuaccauaggugugacacucagcugucaggacuaugcaccccacacucacuagacgcuuaccgguacuucaaagaacauuccucucucacucaccuccaagcaugcggccugcuacuuccaggguagucagggccuccaccccgcacuggcccagaguggccucauccuccaggggcgcgccugccaggagcacgacuugaucuuccggggcaaugcccuccagugaggcuacaugagccuacagggaaagauaaggcucguaagcguucccucgggccgcgagagugaagagcacaagaaaauggaacccagggcgcaccaagcagccuuaccuugaucugggcgaccguuuccuggccggucaccucgaagguguguagcuccugggcgcggacaaagagcugcauauuggcgacugaguaaagaaaagacggcuuguaagagaagccaagaaaugcucugggauaaaggagauuugggaguggaaagcgguccagaaacgaucgcgacgggaugguggucgcggcggcucacguggggaaggccaggccucccaaggaguucggauagggacuggagcagggccacggagcaggccccguucuucgguuccccccgcgccuucugaccccgcagccaaccugcuacaagcccuucggauccagccaaggccccauucuuaccugaacggcggucccagcuaccgcgaagauggagucgagaaagaggaa

SEQ ID NO: 21563 - RNA, 3694 nt, Homo sapiens
uuaaaauacuguauccguauccucauuccaaucaauagauuucagguuaaacaaaacuugaaauaugaaacucaccuagcaagagaaaaaaagaguggaaugaggaaggauuugugauuuuuaauuaauaauuauuuuaaaaccaaaauaauuagaacaagucugcuuugcaugcaguaguacucaagauacugcaaauuauuuuguuugguacaaaaucugcauguauuuguuaacuguauuuaugggcacacauccuguuccugccaaucaccaaguacuuuggaguauuauuuuuguggaugauuuucuuccuuguccgaaaaauauugaccauuuagguagguauuauuaauuuauuggaaacuauuuuugaaaguaguaauguaagauucacucucauucugccaugaucauuugaguuuaucaaugcagaacacgucuuucuuuaaaguuauucuagagcugaucaauauugucuuauauuuagacacugucuuuucucugaucaucuuuaaacauaucacacuuccguucuuguagaacacacacauacguacacacacacaaaccucuaagaucacaaucccaaaauguaugucuacuuauaacauuucaugauauuaaauguuaaauuuuauuucaaaaacuaucacagccuaaagggaaauauaauuuaagcauuaagauaguacauuucagaaaauaagcuaguauuuucauguuacauuuuagguaccuaucauuugucauuccaagagauccuugcguucuagacucuagaauuaaaugggguaaaggguuaugcuuuuaagaacuauaagcugaaaugauuuacuucaguucaauauagaauauuugucagucaagauaacaaucaauguguacaaaaauuuacauaacaagaggaaaaauaggcagugcagcaccuuuagaaaaauaauuaaaaguuucauugcauuuacagguaagugccacacugagaauuuacaauacaguaauuuacugcaaucacaggggaguuccauaaagaaacaaagcucuuacacuccagguuuuuggaagguguuauuggaaugcuuaacugaaaccacagaacuuguauauccuuaggauugaguugaugaaggucauaaaagguuuucauagcaucuauuauauaaaaggaguucacugcauuuggauagcugguuuagugucucugacaagugugaagccuagaagaauuacuggcuugauggugaucuuucuguauccggcaagacagaccuucuccacaguaacaacgcuggaauauuucuaguccaugagagccuuuucuccuaugcuugguacacacuugaccuucuuucaggacagguuuacagaucuuggaccagaagugucuagcacaacacaauccugaggcacagucugaugaccggagacaaacagaaccuucuuguccuacgaaggagaagacaguaggaaaaaaguacauaguuacuguuaaaccugcaucguuucacuaaaauaauucaaaagacacuucugaugugcuaagaaugagucuuaacauccuuaccuuuggugugauacauuuuugaagacaaggugguucuucuggaauacccauccaaggugcuaugaucauuaccaaagcuuucagugaugguuuccucaauuucuccucggaaaugauuuugaucagaagacacacauauuccuaaggaagcaggaaauagugauuaacuucaggguuguaaugcauuacugcuaacagcugugacaguggcagucuguuaugccagcaucaacuugagauacuucauugcagugacaucauuuuaaacacaagccaaacuuccucuuuacuguuaaugcaaaacucuccagauggacagaagcaccaauguguauacuguauacagucagucauagguaauauccccaguauagccauuuaaaauacuuucccaccaacugugguaggggcaagugagauuucugcccauuuuaauauuaccuuugggguaagaaaaagaaacucagucacuuuaaaaauguucuuaaaaauaacuucucugccccuggugcuauauggguccuaccagacuaaguuaagcaaaugcaauuccagcugccuggaacauugcaaucucaccggccaguuacuuuacuguguaauuucuauauuacagagauuuacuuaguucauccuggaguacugcuggguccuaaggagggucgucgcccuguuagcuuauuucuggagaccucuuuagcugucuaaauccaccuuuugaaaaauuaaaaguuaguggaucugugguuggggggaggaguacuuauauuaaggcagcagaggguagagggagggggaaggauggagaagucaaguugugaggguaccaagaucucucuuaaaaauggccaaugcagauaaaucaguccucuggcugacaacaguuucagcaaaaaucagaaggcgaggccagucuggcaaaacugugagaaucacaauaagaaaaaugaaaaggacagcugaacgccaaagcugguuucuuugauaucuguaugaucccaucguccuccucaucaucccccuucucaauugaccucaagguucuccccagacaaauuuuuauggaagaguccacuacgaggugaaccguuguauugaaucauugagggacacggaggaagauaaggaccucagagaccucccaacuucucucuucuucccgauuaaacacuugcaaugaagauacuucagcggaauccugcaugcugaacacccauuugcagguggcgccgcaguguucucagggcggagauuucuccccccaccccccccaaccccccgcccccgcccaauucauagacgcucaaaggcuggacaguuuuagugugaaagggagcuuucaggacucaccauuuuugcaguaauucccggggcagcacauagcgugacgcaugcagcguuuucggcgcuuccugcaggcgagacagauuugcacgccugcguccccuccgcgggugggacuagcgcaguacucaucagugccgcacuccucguccucugcgcacggguacggcugugggaaggguucggggagagggugaggcacccagacguccagguacccgcccucuuggacccgggcgcugaucacaguccuuaucuguccaccucuccaaaaccuguuacugcccacugcucccaaaugcaggguuaccaaaugcucccugaaccgcacacauucagcacguucuacucccucgucuccagauaggacccuuucaaggucagagcauccucugagugcccgaccccucucaccugguaguugucaauggucugguacuuauucccgcccggguacaggauucccggcgcggcgcugacugcagagccugggugccccgcagcgccgcccagcggugggggcagguucuugauagcguuggaauugagaaccgaguucaagguggcgcucacucccagcagaggguggccgccgagagccgccgcuaccaucgcgacaaagacccggguagcucccgcugcgcccagagccaucaucucagaaggacucaagagggagaaagaaagagaaaaugaccgucacuuugcaagccuggguccccacgaaaccgugccgguucggcugcagagucaggguccgggagcccccugcggucccagaguccu

SEQ ID NO: 21564 - RNA, 42217 nt, Homo sapiens
gccauuuaaaacaauuuaagccauuuuauuaugcucauagaguccgugggucaggccuuuggacaggacacaguggggauggcuugucucugcucugcaaugucuggggccucugcugggaagaucugaagucugguagugacuugugagcuggggcugggaucacccagaggcaucuucacucacagaaccgguggcugaggauggccuugucugggucuguugaccaaagcaccuaugugugguuucuccaugggggcugggcuucaucacagaacaguggccucaggcuaguaggacuuuugaaggugucugcucacagcuccaaaaucaagugucccaguuuacaagauaggagagaaacuucaucauuuuuaugaccuagccucagaaaucaacuauauuauucccaccacauucuuacaagcaagucauaaacuaauucacguuuaagaguaggugaacuagguacugccucuugaugggaugggggagaggcugucacagagcacaugcgauggcagauauuguugugguuauauuugggaaauaaaaucugccuugcauguacugucucaauccuuccauuaucuuuggaaguagguauuauugucccucuuuacagggaaagaaacugaggcucagaggggcuaagcaacuggccuauggacaaggcuaguacauggcagaguuggaguucacccuagucuguacagagcagguguucuccaguagcauaugaugcugcuuacaggaaaagggaacugaaaaaaauaagacauucaaaggccaguucgggagugagguauucuucucucccauaauccugaugucagaguuaauaucuuccccauaugggaaucugguuccugugcauaacuccccagggaguugcuucccagaaacuauguaaguauguguguaccuuugaugccucaagucuuccagauaugcacugugugccagcagcugcugucugcccuccccgaccacacuuauauggcaaaauaguccagcaaacaaugagcaggagcaagcucugacccccuccgugaaggcagcacacagaaccaguucgugccaggaauaucuucucugccgugaucccccuuuaaaauuacaucuucccuuuaagugcaaacaagaaccuagacuuccagaaagucaucuugauacucccaggauacuuauaaucuggaaucuuuagaagguacuuggcacucacugcuugcucuguaggauuuuuguguucuaacaccccaguuagucuucuaaggccucagagggcaagguucaugcccuauucugccucagucccccaccccugcuauacaauaccccauucuuaguagguaggcaauaauuaggucaaaaggccucagaaaguuuauuauauuauaacaggaggacacgugcuucuuuaaaagcauuuuuugagagccuacucuaucaccggcauugugcuaaugacccaugugaucuagaagcagaaauuuagaaaaucaaauaugagccuuuugggcauucugcagcagguaaauaacaaaucaaaauugguaucuagaagugaagcauccuuggucagauuaagaggccuucaugacagguacauuugaggcaagcacuguaagguuacaaucucuaucagcugucagauguuuagaaagacccuaaauaggguauugagauccuaauucuugauuuuacuuucuccuagaaauugucugagugaugauuuuagcugggcuuaucagucaggaaaggaugggucuugcuguccuuaauuucaaaucagucuucuuguaguaggcaaauuucucuaccuuucuuuuaauuugucaccauuucaccucaaauuaucccuaaaggccaugaccuuuggaaauaccuuugaauguucaaaaucagcugauccagccacagauaaaccuggucauaaucaauggguaaucaauaucauauuacccauaauuuuaucuucacucauucuucacaucguaaauccuugauccaaauacaauacuauuauauaaaacuauuucuucaacauaccaacaacaagaaugaaacagcuccuguaaauaauuaccucugggauaugaaagaaaauguaaacauuuuauuuggcaguuguuucuguacacaugaauaaauaaauggaaaaguacauauuaauauuucuuuuuggaguaacagauaccauuaaacgcuuauuuacacaucuucacugcaaagaacaguuacacaauuaaauuuugucuuauaaaagguaacuucccacaucacuggacuggacaguuaaggauggagauacugguagugcuugguucuagcagucucaauguuugaaaggcauucauuugcaagugugauaagaagagucaucaugcauugaguucauccgggucauguacuguagaaaauuucugauggcagccacagaauuuggugucucaugcgcuuaagucaacuaugacauguuuguaaaucuguguauuucccuuaaaacuggaagcaaaaagaaaauuacgcuuauuaauggacacaugugugaaugaucuuggugccugaacauuuaauuccugaaauuucacaaauuuggcuuucucugcaucccaguuauacacuugaguaaaggaguaaucacuuccaagaauugcauauugguaauuauuuauuugaagaggcuggaacaccauggauccucgcgauggcauccucugaauauccuggaacgaggagccuccccauuucaugacuuuggaaucaccaaugaaucuugucaagcaaauguacacguccccuuucacugagaagugcuucacugcguacacauccuccauguuaggaaugucaguuugguuagugaauaauuguguugcuuuguuccacugauaaauuacaggacgcugggaacuacuagacagaauuaaaugaggcguucugagugucugagguguucugacuauuucuagauauuccacaucagugucccuguaccacgcguguaaggauugaugggaguagaauccguuuccguuccauuuguaaaugguaguaaaaccagcuuuugaacugucagcaacaacaaaguaccaguuguuuucaaucuugaauguuucaaugucauuggguuuucggauuuugagaauuucaauauccuggauuuuuaugaauuuauuugcaaaacugucucgcuuauagaugugagagccaccaaacagcugggccacaauaacauagagcugaguuucaaugacuauaggcuugcauacuacaguggaugugccugggaaaagacaaaggagagauuaguuguguggccauccucuuuuggagcauguaaacaugcgggcuggggccauacaacuuccacccaaaucagccugaaacaagagaucuccuugguugauuaggcaaggcuggucuccaaagcccaauggcagcaguguccuaaaguuccgugccuuugugccucguggggccuuguugccaacaauugaguuguuaaugucauaucuagccugcgcuagacguucaggacacacagcuauggcccgaguguucuccucuuacuucuugcagaaagaaagcauuaguuucccugacacaaaugaguuaaucauaauucuaaugaaaacuacuguuuacugagcaucuauuaugugcuuucucaauuuaccucauuaauuuucccaacaaucuuaagagauaaauauuauccuuuuuccacaugaguaaacugaagcucagagaggcuguucugguagcagaaggcagaguuggggauucaaagccaggccuaccagcaucucuaugcuuuuaacccaagcuggggacaaguuagcuauuccaggacuucaaauuugguuuaucuaagaucuuagauaaccaaaggcuagcguuguggucuggguagcccauggcucuacuguaauuguuuugcucuaagucugaacugcuuccugcucuagaauaauuugccuuuccccugcaaagaaaggagaugccacuugucacuuuucuggagcuuuaggucacugguggcaggagugaagagaaggaaaaggaaucuuuaaaaaaaucgaaagaagggugcagccaugggcacugcuccugaaaguuauuuuggaaaaucacagaaaaugaugugggaucugucaguggccuagcuugguauccuuuggggaagaguuugacauuuaucaguagauucugaucuugcaggaguuuggcucuagaaaauccagagacagcugaacaaaucugggcuuuaggccucuucugacuacagcgcuagugcggggcagaaaguucuacauuaauucuuucuacuaauuggcuucauccauaggcaaaauaguuuuauuucugacucuuuucagggcuaaacugauuguaugaucuuaagaaaaucauuuaacuucucugaggcucaguuuucuuuucuguacaaugagacuuuagacuagauuaaggauggccaccagauuccaacacauguaccaauacugauuggcucauugcgugugauugucuggggaacuguguugagaaggauucuguggccgugucugcacucuacaugaaagauucccaugauagauuaguggugccugucuagagugaaggaagggauaaugacugaguauggggcauauauuugucaucugcuaugguuggaauguuucugucccuccaaaauuuauguuguagcuuaauccccaguguaauaguauuaagaaguggggugucuaggaggugauuagaucaugaggacuccacacucaugaauggaauuugugcccuugcaaaagggcuugagcgagucuguuagaucuuuuuuugcccuucugccauguuaggacacagagaaggcaccgucuuugaagcagagagugagcccucaccagacccuaaaucuccuggugccuugaucauggaguucccagccuccagaacuaugagaaauaaauuucuguucuuauaaauuacgcagucaagguauuuuuuguuacagcagcaggaagggacuaagacaucauccuagacaagaugagcucugagaugcccucagaaaguuugcagauguaugauuuauuucucuuguaagugcucaucuaaagagucauucaaagaaauugaugaaccauacacaaguaagaaaagccugguuucgaccgcacaaaacccugcuauaguccacuggaaaacuuaugggggccuaaggaagcaugaccuucuuccuucagagaggaggauucuaaaagaaaggaggauuccaaaagggucucaguuuggaagggaucccuuuauuuaagcaaccccagccucaagcaagccccagaccugucuugguccuuugagcaaugagggugauggcuaccagcaaaaucuaucaugacccuccaugccuugucuaaaggguuaccuuuuauggggaggugugagugcucuugagagcagauuuaaagguauuagaagcuaaaacugauauuaaaaauuguagagggagcccuauguucuaacuuaugacuuauaauuuuaaaaauuauuaaaaugggaaagaaacuuaagagaucagcuaaguaagcccaggcaaggugguuuacucuuguaaucccagaacuuugggaggccaaggcggguggaucacuugaggccaggaauucgaaaccagccugaccaacuuggugaaaccccaucucuacuaaaaauacaaaaaauuauuagggcgugguggcacaugccuguagucccagcuacuugggaggcugaaggacaagaaucgcuugaacccaggaggcugagguugcauugaccccagaucacgccacugcacuccagccuggguaacagagcaagacuccaucucaaaaaaaaaaaaaaaaaaagagagauccagauaaguaaaaguuuucauagaaagaauuagauuccggccgggugcgguggcucacgcuuguaauggcagcacuuugagaggccaaggugggcggaucaugaggucaggaguucaauaccagcuuugccaauauggugaaacccugucuguacuaaaaauacaaaaauuagcuggacaugguggcacgcaccuguagucccagcugcuugggaggcugaggcagaagaauugcuugaacccgggaguuggagguugcagugagcugagauugugccacugcacuccagccugggugacagagcgagacucugucucaaaaaaaaaaaaaaaaagaaaaaaaaagaaaaaagaaaagaaaagaaagaauuaaauuccauggccaaauuaagggugaaaaauauuggaaaaauuuccucacugcaggacuucucagauccacagaugucuguauuaugaaccuacaagaccaagauaugguucaugaauuuauuggaccacaaaauccuuuucauuacaaggcauacauuaacauuuuguagaagacacguuuguguaacaaauuugagacuuauugaucuaaaauaaccuucuuauuuuauaguuaagaaaaagggguugaggggugucagugaguaugagcagcuugcccaaauagacuguggcagaaccuggacuagaacucaugauucaccauccaauacuuuuauuugaagaaaaauaaucaaauauuuacuguuuauguauuauacuagacccuaugcuaaguuucuugaauauguguucacaugaucuuauuaacaaccuugugaguuaaguauuaauauuauucccguuuuacaaguggggaaauuauggcuuagagaacaaucccaggucacuuaacaaaugguagaguuggaauucaaaugcuaaagcauuccccuauaccacucaucuuuccuuguugcccuuggcugaagcaguuuaaauuaccacucaaaauaucauuaggcuuuucauaccuguaauguugucauaauuccggaaggucuuuuccacauggucccauucaaggaaaaugcauuuuccaguaaaaggcugagcgaugacuacauacucaucauucaaauaagaaaaagugucuauggacaaugauugauaaggcaggucuugagacuuugcaaauucugcaaaaauaggaaauaauaaguaacugugagcuaauaccucuuuccuuggcuagaucuuaaauauucacaagaaauacauuuauuucagagaauaguaaaauggccauuuuacuuuuaaacacaugaagcauugucaaugguucauaauuuuuuuaaaauuaaguugcucagcuaguuuuuaagauauaaaaaauaucaguuccugcacaugaaaaaaaaagguagcccuuauuuuaauuuuuugagguggaaugaugaugaguacauuaccuguaaugaugcaaucaaaauccuucgaggagagacuauugauuuugcgcuucuuguauucuggggggccuucgcaguagaugucuucaacaguugcauugguguggccaagccauuccacuagccauuucaguuuacagucacaauuaaaugaauuaccccucaggucccugaaagacaaacuucagcugcuuuugcuguacaagggcccuacccacgcaggaaagaguucuacaucaacaauuaacaugugcagaaugaccuuacccggcguugcauccugcccuauaaccugccuggaaccugacugaccacucauucacuuugggcucagagaguuagcaccaugcacacuugaagacuacccagucaauggaaccucaucacuuacucccucuugaauuccaaagcggcuuagucuagggcugugcugucaauagaaacaguauaugaaccguaauuguaauuuaaaauuuucuauagccacauuaaaaaaguaaaaagaagcagguauaauucauuuuaauaauauguuuuauuuaacccaauacauacaaaagauuaucauuuugacacaucaucaauauaaacauuauugagauauuuuacauuccuuuuuuauacuaagucuuugaaguccaguguguauuuuauaccuacaauauaucucaauucagaugcuaaauuuuaccagaaauaggugaucuauauuuagaugucauaaaauucauaauugaaaaaaauagguguauauacccaaauuauuccaagcguacuuaacauuuuccaauaauugagcugagaaucagcuuuuaaauuuaaauuuaacuguuaaaaaauuaaguaaaauuuaaaauucagucucucaguuguacuaggagcacauuuuaggugcucagugaccauaaggucugguggcuacccuauuggacagcacaggucuaaaggacagaauguagugauuauuguaauguauuuaaucaagugagcuauuugcuuuucuucuuccucacagacauaauuaauccugauccucuuccguggucuacaaauucaguuuaaauaggaaaugacuuugacacagcagaguuaacacaggcauacaaucgcucaugccuguaauaaguuauacagcauagaccauuuacauauccacauaugaccccaacucaccaaguucucuguguauuugcauugcuucuguucaggaauuccaccuccuuuccuggucacacagaauucuuaagauaggugcugccuacucuucacaccacacauaaauaauuuuuaaacgcccaaacauuuaaaaauguuuuuuagaggauacuuucaagaaagccaagaaauccacuaaaaggcaaguuggcauggauccuuguacuucuaagauaauucuugauuugggcauauuagaguagguccaaaaggcuaaacccaucuugggauucccaugagagacugagccaauuucaauauuuuuuuguuuugucuuucacuaguguaggguauagacugacacaaaaaugggguaaaggacccccaaugagcuacaucccacgucacccauggaguguguucuaacuuccaagacacucccagaacugaccuagucucccaagagaacucugacccacacuaaugaguggcaaccuuucaggcuacuguaaaccagagaggauaacuauggucuguccaggacucucuuggaagaauccugauuugggcauucuccuggaauuaaaccauaucauucaggaauugagguaauagacauggaggaggggcuggggaaauacugcaaggaacaaagaaaguuuuucauuaggcuacugauuugaaguuaaauacugggcuuggaagaaaguacuugacucagauuuucuuuuuguuuguuauuggagaaaaguuguuuugaauauauauucuacagacaaguaccugaauaauuuuuuaaaaaagcuuuuguuuucauauauccuuucauuuguuccugucuuccaccuuaugacauuuaaauaccuuucuaauguucuggaaggcaaauaaugaagcugaauugcuuuugagaaguuuaggcauauauuacuugcuuugcuuacagcaaaauauacaaauuccuugcaaagaucuuucacucggaggcuuaaaagucaaaguuugaaagcucuuuuguuugaaaaagggucaaaaauaauuaaguucauucccuuccuggggcuuaagccaaauuccuggggauuaagcuuagaguuguuguucagucuaaugagaaaaaaggcaaacuuuucucccuucccccacuuccuguuccauuucucuguugauugaccaacccaaggauguaaccuuucaucuuuauucugucaguuucccagacuccuuuauguuuuuccuuuguagcccuauuuccuggaccucaugagaaaaaagggauuuugaaauuucuagccgggucucuucccaccccgucaaaguccuuuaucaucgcucccugccguauugacacacacuuugucaaaggaaugccugggugccauguauucagaauucccaaugauaaauaccauagaagacucaaauguuaguccauguaaauuuaaauuuuuggccaguuaaaauuuagauuuaaaaauccuaauuuuaauuuaaaagccaauuaaaaauuauaauaaucaauaccaggcuuccuuguuaaugacugcaaauuaauuaauuguucagugauuucuuagguccucuuacacauuuguuaaagaauccaggccuuugaaaauaucuuuugggagugucuggagauuguuguuugcaaggcuccuggaaaaaaaaaaaaaaaggugauguaaacuguagugauaaauuaaacaaaggcauuuaaugauaaagcuuagugaugagucucuuuugucauuuccagccuacuaaaagacuugugguccuuuuuuuuucuucugaacuacuacucagauuccugcuauuguccuuucaguuccuaaccuguucacuucaacacccacuccauauuuauuuacuuuuauuucuugagacaaaagucucgcucugucacccaggcuggagugaaguggugugaccucagcucacugaaaccucugccucccggguucaagugauuuuccugccuuagccugccguagcugggauuacaugugcccgccaccauacccggcuaauuguuguauuuuuaguagagacaggguuucaccauguuggccaggcuggucuugaacuccugagcuucagugauccacccgccucggccucccaaagugcugggauuacaggugcacucaauauuuaaacaacacuuuauguugguuaaaaacaacaaugauuccugggcauugaucuuuccauuuagaacagaacacgagagauucacacucucagacgcucaaucuaggggauaucucccaaaugaugacuaaccaaacuggugaguguccaucuccaaaaugcgcccccuccucuugccugggcugccccuucugccugcuuccuccucgcuugcuccggagagcaaccaaaccuccaacccacagugccaguagcucuaucucuuccccaguacauccuuucuccuuucuaaagcccacgccuccuuuuccuuucuagcaccauucauuccaccucagaaaaaaguuuucuuauaaaaaccuauccaucuauucucuuuaaucaucccccucuuucuccuucuucugguucuuuuccugugaucacaggaauguuuuucccuuucccuuucuauuuguucuuccguaaaucacuagaaugauucuaauaaagguuaaugaguaaaaaauuguccugauaaugucaaggaaagggaaaugugucccuaguacacaaauauagacauagcacagugcuaaugcuguaugacuggggaaggucaccaaguaguguaauuuucuauuuuuaaccagcaccauauauauacacguuauaaacuuuucuuagagguguuuuuuuuuuccacaauaaaaauaaaaaacuaaacuaaaacuaaagagcccauaccauuagccucuaaacccuugaaaauucucucaacuucccuuuaaaacauucucaaaagucuaugucuucuaccuccacuaauuaaauauaagguuucucaagugcaaacauucaugaacuuuagaacuuauuuuuaaguuaguuauguuguuuuucuagguuuuagaaauuacugcuaguuuggaaaaugguucucaaugaaccuuggaaugcaagaauaggaacugagucagaauguuccauugucaaugacgguccaauugugacaaagagcauggcuuuuggagugauucugagcuauguuugaauccugacuccagcauuuacuggcugugugacuuugguaauguaucuucuuggaaauucaguuguuucauuuuuaagugaagauaauaauaccuuaucucauaagauuauugaaaaaaggaaaugagauaaucaaggauggugcaggugucugaacuacucucaguagaguggcuggugucagaagagaacagcuucuguacguauguuguccaagaaacaacguuuagaaacagaccacaugaaugaacugcuauggcuguccacauacagcaaaauuaauaaaaugcugcuaaggaagacuauucaagagaaugucuccauaauucaucuuacugacugguguuugaaugaagagauuuucugaugucuuggaccaguccagagucacucccauguuaugugucucaguuuauuuucuggcacaauguggcuuaaaguuaucauacuaacuucuaaguggaugucccuuccucugaagcugguaaaaacugcaacuggcugcagagcauaaauuuagaggaggcugagucacaggacagugggcaugcaaugauuaagcagucaaauccugaauuacuacugccaauaggggcuauacaggagaaggcaccaugcuugucuuacuguccaaggggaauucuuuuuuuuuuuuuuuuuuugagacagggucucacuuuguuguccaggcugaaauauaguggugcaauuacagcuuaaugcagccucaacgucccuggcucaagugauccucugggcucagccucuccaguagcugggaccacaggugugucccaccaugcccaacuaaguuuuuuuuauuuguagagacagggucuugcuauguugcucaggcuggucuugaacucuugggcucaagcuauccucaugccucuuccucccaaugugcugggauuacaggugugagccacuguacccugugggauucuuuuaaauaaugagugaaucuggaaguucuacuuccugcccaaaggaguagagcuuuaggccucacaugauccacgugcaagcuaaccacagaacagauggcaaaacagagcugcagacuuggagcuauggggcuuccagaauggagaggcaguauuuuugcaugacaagauggagggcuucuaauucaccagaauugugagauggggcugagaaggacaggcuggcccgaugggcuguggaaugaggcauuaaauuuccugagaaccucuugugacaggcuuuugccuugggaaucagagggugggggaggcaggggagccagagggagaaaugguggguggauucgcugaacccagugucaacccucugaugcuccgcuaccaaaaauucaaugaaauccuugcccacaaugaacugcucuuagaggagagagaaugaagcuucaugucuagguuuggugagugaugggcaugagaaggcugccuggauucacuaagagaagcagacucaagaggaagcaagauucagaaaugagagugaggcuuccagacauccaaggcuagggagcuggaguucagacagcuucccuaagucucugggaggcuccagugacagguuacauuuagauaaaaagaaaguaggcagagggauuugggcagagaacgacuuaggaaagcaaugcugacagagccugagaauuacucugcaaaaaauguaacagguugccagggcaugguggcucacgcccguaaucccagcacuuugggaggcagaggugggcggaucaccugaggucaggaguuugagaccagccuggacaacaaggcaaaauccucugucugcgaaaaauacaaaaauuaguuggguguggugugugccugugguccuaguuacucugggaggcugagguuggaggauggcuugagccuagaacuugaggcugcagugagccaugaucauaccacugcacuccagccugggugacagagugagaccuuguuucaaaaacaacaacaacaacaacaacaaagagauauaagggaucauguaaauaaacuaugguccauauguaacacggaauauuuuguaggagauuuuaaaaaugagguagguguaggguuacuggaaucuuucacuuuucuguguaaauacauauuuauguugugaguuuuuaucaucaagcauguauuauuauuuuauaaucagaagaaacaaagaauaaaguugacuuuuugaaaggauccuguugcuuaguauuuguauauaucuaugguucuguccaaugaggguucagucauucgaaaucaaucguuuggcugcauuugucaaguuccaaagcuaccuacaggguuagauuaggaauuaccgaacucgggggccugaguggucaggucaugcaaaugucuuucacaagaccuccugcagcggggagcugccuguuuccuagaaaacucucaugcgguuucaggcccucacccuuuagggagguuuggggcuacagggcagccgaggcuugaagccaccgcugugguucuuugcgccagcuuaaagccagcugugaugagggccuguugccuccacaaaucaucaugggcaucugagggcuucagggagauuugcugcagcggagggcugcugagggcaccgggcucaggggcaacaggaaaaaaaaagggcaagucacgcgacguucccugaagccuccucagcauuuagucauuaaaaaagggguaaguagaaugagauccugugucuaucagggaauuuuaacagcuagagagacugagauagcacuuuguggguuaggguuaggguuauuuuaggguugauauuaggauuauuugauucuucagauuccaccucugcaccgaguuuugcuaccagaaagcaaaauaccuggauaaaauuuucccaguucugucuucaucccacucccagcuucacagaguaaugauauaauaauauuauuauuaacuuuuccucaacagaagcucuaguugcuauacgugcuaaguauuuuuaaaacugguuguagcuauucuuuccugcaucacuuaggggaguauagugguuuaagugccaacuucguccaaauccaccagggaauaaauuugaacgucaucacucuuaggaauguguccuuagccaaguuaauuucaccucucuggguuucuguuuugacaucugcaaaacugaguaaaggauaugaauuucacuuauugugagaauuaacacauguagcuacuaauauuuuuauauacauaucuuuguaauggauuccaggaaaaacuguaucugcaggugaauuuuuaaaccuuauguguuaagaccacaaaacuaaucuuuuucuuuguuguuauugucauuaaacagugauauuaaauaucuaaacacuuuaaaauauuugcuucaggaagcugagaucaucuauucuuucugccucucuuaguagggauaauccuaugcauugguauucuuaaaagucccaucuuuuacuuuuauugauacacacacacacauauacacacacuacauaugcacauauauauggaauaauaauuauuucuucacuucaagaaaaguuggaaagugcaaaaauuauuuuuuuaaaaaaggagagaaauaauaauuaucauagcagaaguaaccacuguuaagauuuagucauguuuucuuccagccauuaauacagagcccaucaaaagcaagugauucuggaacaucauguuauggauccuggcccacagagugucuaguccuucucuuuccucuagagugucaugacuagagagagugucacgacuugagagagugucacccugaauugcaguaggggacccuccuuccucugcaaagaucuguuagccaagagcuguuaagcagagcugaauuuuaauacuagauauaagaauucuuaauucuuaggaauaggaggaagaaaaauuaugaaggacagagaggcaaggagucccagguagccaccagaguugucaggaaaaagacuuucuacauguuuugguuuaaggaguaccaggcuccuguguuggccaaaguggaccccuugccagucagacucacuuuagggcccagaacucagccacagaguacaggggugacguggacagggaaguggauaucugaguuugagcucaggcuauucccuuuucuauaaagugaaugaucacugggucagaaugaucuccaaguccuauucuugcucuuaaaucacagcuuugucauuuucacugagaggcuauggcuucaucuuuaaaauuaauagaugacacuaggauaggugauacuuuaggccacguacuuaggggucagugaguuugacaacaggcuuuuccagggcauggaggucacacuagguggcacuagaauaucugacuggggugggguggagccgauugggagaggggugaagacacagucaaugagagacuugaggaaacauuuaaucaauguucuuuuauuucuaggauaauucugcaaugaguacuagaaggaugguucucuuuccauuaucuguagugcuagcauagugccuggcacaaaguaagcccucaauagauacuuuuauuuauuuauguauuuauuuauuuugagauggagucucacucugucacccaggcuggaaugcaguggcgcuaucucggcucacugcaacuuccgccucccugguucgagcaauucuccugccucagccucuuaaguagcugggauuacgggcauacgccaccaugcccggcuaauuuuuguguuuuuaguagagaugggguuucaccauguuggccaggcuggucuugaacuccugaccucaagugauccgcccgccuuggccucccaaagugcugggauuacaagcaugagccaccgcacacagccuaauagauacuuuuaaaugaaugaaugaaugaggcaggcuggaguagacgagaggacgcguacauaucuaggcaaagaaaagagcagaggaugcuccuuugaggcccccugugccaaggcacugggggagaaagcucaaagcccugugagugacuagugcaguccccaccagcugguguggacccccaccucaggaaggacccucccuccccacagccccacugugguagaaaucccaaggcaacguggaggcucuuuaaaguugccuucaacuaagcaccauucucuagguccugguucaaaguucaccuaagaaacauucuuuuauuuauuuauuuacuuauuuauuuauuggagacggagucucgcucugucacccaagcuggagugcaguggcgcgaucucggcucacugcaagcuccaccucccggguucacgccauucucccgccucagccucccgaguagcugggacuacaggcgcccgccaccacgcccagcuaauuuuuuguauuuuuaguagagaugggguuucaccguguuagccaggauggucucgaucucugaccuugugauccgcccaccucggccucccaaagugcugggauuacaggcgugagccaccgcaccuggccagaaacauucuuuaaaacaacugagauauugcgcagcugaaugucuaguuaccuugaaacuggcugaguaaggucaaguguucucaaaggcagacggccauuccuucuucacagaaaugaugaccauuuccugcccuuugguguuuucaucauuuacccaagaaaaccuccgauugugacuguggaacccacuggaaagucuucucucuaaggcagaccagacuggcucaaacaccgcguuuguuucagugccaccgggcucugcugcuaagaaagcaucgcccacagccaucuggggugcaccagccccccugcaaugcagauucucagcuuggguuugugucucucugaaccugcggcggugcaagugcaguuacuuuaauuucauagaaaguguuuaaaggggauauacacuguagcauuuagcauucugauucaggacuaauggagguuaugcagugaguuuuaguuuuuuccuacacaguggugcuuacuacauaccaggcccuguucugagcacuuuguaguuacuuaaauuucacagaaaauguuuaaaugguauauacacuauagcauuuagaauucugauccaggacuaauggagguugggcagugaguuuuaguuauacaguggugcuuacuacauaccaggcccuguucuaagcacuuugcauuuauuaacugacuuaaucucaagacaaccuugggcacuaauacucuuaaaugccuuguuauuccccaucccauuuuaagagauuauuauuauaaccccauuuuacaugcccagucuguagcauagugaagcuaaauggccugccccaaauuccacagcuguuaaggugcaaagccgaggaacugaucugagguggagaaaagugcacuuugaagccuaaagucuuaaaaaggaaacuaauggcucagauagaugccagauuuauuaauaaguaguaaauaauggaaaauaaacuuguccuauugagcuggcagagagacaguugaacccaggcagucugguggcagagaucacccucuuagcugcuacauugcacuaccucuuuacauauaaggcaaugugaaggcuaaaacaaagacauccugugcaacugauugggaacacacaagcauccugaguuuggggacuguuauauaguccuuuguacccccucagugcugagcaaccauuggauacucuacaauacauauagauugaugauaauuuucuccaaauauuuauauauaugcaugcaaacaaugcuggcuccacugggccuuagccacagugacacuuaauggcacacaaagcaaucauuacuaaagacucauagguauuacuagaagccaauacauaauguuugaagauuuugucaucauuggccauaaauuaauuuuuuauucauaaacuaauuuuuuauucauguuuuccugauuaccaaaauaacauauauucaucagaaaaauucaaauauacaaaagauuacuaaaauauacaaaccauucaaacauuaaagugaaacaugcauaacauuagaacaaugauucaaaacaaaguaauugagaaucccaacauuugacaggcuuugaaaggacuuaacuuuaagaagucucucucccuuuuuaaggguuaauuugcaggguuuuaaggguuaauuugcaggggaggggaggaucucgccugauagccagguauauauaauaacuuuuuuauauuuauuuauuuauuuauuuauuuacuucuuagagacggagucuugcucuuucaccuaggcuggagugcaauggcgugaucucggcucacugcaagcuccgccucccggguucaugccauucuccugccucagccuccagaguagcugggacuacaggcgcccaccaccacgcccggcuaauuuuuuguauuuuuuaguagagaugggguuucaccauguuagccaggauggucucgaucuccugaccuagugaucugcccuccuuggcuucccaaagugcugggauuacaggugugagccaccacgcccggccuauaauaacuuuuaaguuaucuguaaaugucucuuagaagagaaaucuacugacaucucuguauaagaaggugagaaagugcauuguuucuuaggcgugaacuaaauuuauauaaaggcgcagguaagggaguggcuuuaauguuaggccagagugggaaccagcuggaccugaaaguauacgucuaaucccaacuaucugcauuuugagaugaaauaugaggguagguuuccuguuuucaggaucuuuucuuucuucucuagucauauuuucuccucaaaucaugucccauggaaggauccagccagcucaauaaaagcuaucugguccugcgguaacuggcacaguggacguagcacuggacgucucaucaaagacggugggagcugucuggcuuuaccacuuaguaacuggggagcagcuucaacucaugguauaccuccacuugcucguucaucuaugaaccuagugcuacugcccugucucuuucacggggucgucaggagacuaugaugaagucaagaauaugagaaagcuuuguaaccucuuccugcaaugcaugcagguuagagggugagguacuaauuccucacagcuugaauguuugccuugauugggaaggauugaucugagguggagaaaagugcacuuugaagccuaaugucuuaaaaaggaaacuaauggcucagacaaaugccagauuuauuaauacgccauaaauaauggaaaaugaaccugacuuacugagccggcagagggaaauuuggguuucagauccucccuacuccaucucuccuugaaagacagaaaggaaagaaggaaggaauaaaagaaggaaggaaggaagaaaggaaggaaagaaugaaggauggaaggaaggaauuguaccaugaagaauagcauaauuugaaaggagaacauaacuuggggacaaaggcacucagugagaaaauauuuguccaauuucucuugcuagccugagcuucucuaaggugggacuagaucuuacucaucuuuguaggcccuacuccuuguaaagcaugugucacaucuuagaaacuauuuaagaugaaccauauggcauugccauuuuuguagauaaaaaacagccuaacauuggcaaugccguaucagucaaccuaauaaguguuagcuaaagauacaagagaccuaagggucauauucauuuagccacagccuuaaccccuguucccucauaacaccuuccuaccuccagcaccagcucagagaggugggacuucucuuucacugccuguuaagagucaugccucucuuugaaggcugcccuugguguuccucgaaccugaaauuuucugaauguuaagcguguucuguaucagucucucucucuuacaggcuccauacugcuaaagaaagggcaucauuaagacccauauuuaaauucccauuucauuugauacacaucauaggcuccaguaaacaaaauggguguccuacacuaggaugucaaacagacuuuuucuuucccuuuuuccucuuccccuucccuccuuucucccccuucccuuccucucucaucuuccuuccucuuuuucuuucucccucccuccuuuccucuuuccucccuuccuucccuccuuuccccuccccuccccucccucccucccucgcucccucccuccuuccuuccuuccuucuuucuuuccuucccuccuuccuuccaagacagggaaacauuuuuuccuguucugugcauggagccugagagaaaccacaggcuuuuaggcuggagaggagacacagcuggaugaauugggcugugcauccucccuacagcucucaugaugcuaagcacuggacagaggccauguggauugggauguaugugaaucuaguggauuucaaguugaggucaugaauuuccauuucuccuuccauauauuuguuucuuuuguuuauuuguugucugaaaaaugagguuuggcaguguugagcucugugauaaaauugcauagcauucauucuguaaacagccaucuuugcaucauaucaugucauugacaugaagaguaguauugcaaacacuguuuuuuuauuacaauaacucuauacagaagccuugaaaggcaugauuuuguaaaauauaucuggcuauuagcuucucuuugcuacaaaacaagcaacaggagagaaaggggccugguggaggcagagugacaaccgcguggacacacuggaaaucaggcucaguccaaggacaggcauuuuugucuccuuuguucccugcugcauccuagggccuagagcagagcugggaaugaaguaugaugagagaacagguuaaagcugacagaaugacuaugacacuuggaucucuugcaucuguaucuagaacugauaagauacauauuagguagauugagaaauagcuguugaaaggaugaagagucacugcaauucaacaauuaaguagauguucucauaauuccguaacuaaucagcucacgaggcauauauccccuccaagacuguuuccucauuucugaaacagggauuauugugccuguuuggcaggauuauugagaggauuagaugaaaagugauguaaauguuagugccuuuucuuuccaugcucuucuaguuuccuuaaaauaaucuguguguaugugagagugugugugugaguguguguguguaugcacaugugugccugugugugugugugugugugugugugugugugugugugaauguguuugucuguagagggugagggaggcuagaagaaacaaauuguuuggguccuguuguucaggguuucucaaccugcccacgaugccacuuuaggcuggauaauucuuggucgugaagggcuguccuaagcaguagaagaaucccugccuuucacccacuagaugccauuuacauccccaguugugacaaccaaacaugucucuagauauugccaaauguucccugggagacaaaauuguucccuguuaagaacaacugcuguuagcuguaaucauccauugaguaauuaaauauuucacugauaaacaaguugaucagguacuaugaagacaucgccuguggcuauauuauguuuaaauguauauaaagugagggcuuauagagggaaaaaaagcugauaucaaauuauacagucaacucauaaugauccaugaagcaaguaaugauguagauaauaaaagaaguuauuucaggcacacaauuucccugcauuagauugcuuuucuaauugugguugguuuuggauaaaaauauuaauaguaaucaauuuauugaacacccucugacagaugacagggaaagauggcaagugugcauggagagaagucauuuggguuucuuaaauuuuuauggacacucauaaaguaggugcauuaaccacaggugaucaaacugcauuguccauuagcaagcuuaaaaaguaauagcaacauucauacuuacaagugaauuaaugacuuuaguccccggaaaguaugucuugaaauugacuugauguuguuguuuucuaugaaucugcaauaaguuauaauauuuuuugucaaacaguuacaggaacuugagaguacuuguccugaaucaucauguuuuaaaaaagcuuuuuuacuuacaaauacucuagauguggaagaccaauaaaagcaucaucacugaucacaucaaaggaguucgaugugaauaaccugcccagaaaaaguacacaaugaaaauggugaaacugacagauugucaaucuuggcugcuuuuaucucucagaaaaaugagugggaguuguauacagaaaaaugucugcauggcugucugcuacaguguuaguuaugcagauaaucuaugcagcauuuuuuuacuccuaaucaucuccucaucaaaggcucaucaaggggugccuggugcccgauuccucacaaugacugccacauacccugggugacauuuugagauacaaucagagcagcuaugauagccaaagcagccaaagcaacauuuuacauauuuucaugacaaaggcacuaacaaucuuuucugcuuguucuagaaaccucuggaguguucuaacuggcaaaaacaaugguacuuugcgguuuugagccugggaaaccuaaaaaaaaguaagcugcaugccugguugugcugugacaucucguaacagacaggcaguugacacuggcuccaugaacaacagccaaccuccuccuuugcacacagacugaaaaugggaaacaugagguuugggaagagucuuagacccauuuuauuaccaaauaguugaagcuuuuacuuggacaaauauauuugcaauuucaaaauccacaaggauuugguuuagaaauuacugaugaaaaagaacaucaaucagccaucccacacccuguugaacuccuuggagaacugaaugagaggcuuaaaagagguaguuuuaggccaaacaguacaagaauauauuauauuaugucauaauguaauaauaauaauaguaauucuguuaguaaagcuuaucacuuuuacuucugaagccagggauuaaauauaaguaccacuaacuagcuuagugaauucaccgcugaaccugugaacuacaggaauuaaaacuaggagaucucacuuugugaacauuuaugaguaauuuauuugucaucugggauugcuucaaauaaucagaggagggggacaacaagggguuagagaagaauuggcaugaguugaugauuuuugaagcugaaagauggauacauaagagugaauuuuacuauuuugucuacauuuauauauacuuaaaauuuuucauaaaaauguggagaaugggggguaggaaugaaccaaccaaacaaaaugagaugauuucuugcauuucuuccuaaacuaucaauccuagagugguguuggauugucuucuaaucccucaugccucuaaugucauggauuuguacccaaguaauucacgaggcucugaaaagccaguacuaaugaacagugacacauguuagaauuccauguuacuaaaacaaauucaaagcuguaugauuuccaucacagcuuuggcaauugugucucuucucacuucauggcucuggaaaacaagaagacugcucagcuugacuccaagguaagcuaacacccaaaggcuuccuuagguuccagacuuucauugcauucaguauaggcagcaucagcaguggagagaauggaauaaggaagaaauugguacacacaaauauuauaccucccacacucacugauuugaaaaauggcccaaggaccagggacuucucauauuccaaguugccagaagaaauaguuuccauugcuacuucccuuuauguuaaaucagaugcaggacauagugggaaaugaauauuagugggcagaacuugcccaugcacgucacgggaagaaaagagaggauuucugcuagauuuuuugucugcuuguucauuucuuaucccuagcaccugugauacagcgccuguccucuaguggacacugaauaaauauuuguuggacaaagaggaauucaccuuacacuaaauucugaucauuacgagacuacuggauuaaauauuucuuacagcaggaauuugcccuuauuuguuuugguguccccagccccgggcacaguuccuggcugaauaauguuuguugaacuacauuucaaggacuaaaaccucuggugagaacuacaaaugcauaugcaaaacuaaggaugaauauucaaggaaaggagccaaaacacaauaaaguacauccuauaugacuguacuuauauaaaguacaaaaacuaaucuaugcugcuagaaucaggagagugguuacccuuggaggcaaggaguaauuggaagagaacacaaggggcaucuuuugggguaaugauaauauugaguuucuugaccugggugcugguuacaaggguauucacuuuguaaaaagucauugagauguacauuuauaacgugcacuuuuucuuuauguauauuauacuucaauuuaaaaguuucuuauaaaagcuaaaaaaacacccucuggcuaagauaauaaugaauaccauaaucucucaaugcuaaauucaauuguaguuucuauggaaaaagauguauaaaauuauacauacauucuaaagauaguugagugggcuauccauuuuauuauccuacguauacuuaaaaagacuccuacaucauauucuauacagaggaugaaacucugacccuuaauuuguauggauuccucuaaauauguuugauuucauuauuauaauuuguuauugaaccagauauguuaaaguauuccacagucucuguuaagggaaaccgugcccaacccaccccaccuacacaaaaaacagaacuggggcagaccaggguggccguguucuacacugcacaaccucugucccuuuccacagaguagccagucucuaaaucaaccagcaucccauggcccaaguagccugguuuaaaaaggugaguugggcuaagacgacacccuucuuggggaucuggaauuggcagacugagaaauggagccagccgguagagaagcuaaaggauaaaggaugccuuaggguugaauuggauccaugguagguaaaauuacgugcaaagaaugcuuaggagaguguagaauugugguggaaaacccaccaagauaaguuuuuugaagacuggugugggagagauaccuagaucuguguugaaaccugagccaaugcuucugaauccugcuugcucuuggaaucacccagacagcuuuaaaaauacugauacuugguucccacuccuggagauucugguuaaauucuaaacguggggugucaccuggguuacuaaaaagcucccuaggagacucauaugcagccaggguugcacaugguaagcuugccaagucagucaaaacacuguccccuuuaccuguggugaccaaggggucucugcuccuugcagcaagucugccuggagccguugguguggggaguggaggagcuguggacuuucuugucccuauaacuacguguagccuagagucugcaauaauaugaguuggaagugacaacuauccucacaacagcagcagcaucauggagggguuuaugaaaccaauguaccauccaaaugaccucguuacucugagccacagaucagagaucuggacccuguaggccugccaagcagccagcccguggguuugugcagagguugugcggaauuugcccucugccccaguuccaugggaacacuugagguuucuccucuuuuuuuagggaagcauuuuccuaagaagccaggcauuuuccccuagaauuuugguggagguggacacaggggugugccugaucugucuacacccuccccaaagggcugugcacuuauuaauucaguaagaaaaggggcugugggaggagaggggaggcuuuuuucuucugcaaccacgggaguauguuuccuuaccaagagggagauuuagaaaaaucauuuauaugaacuaugaauuccaggcagguacuagcuuauucuuugaauaaugaucuuuggcuucauaauagccuacaugucauagacuccugccuggauuuucuuauuuggucuuuagacaauucugugaaaguaguaaagcagguaagaucuauuugacagaagaggaaacugaggcccagaaggcuaccaaacacuuuccuugaggucgcaaggcccaagaccccugguucaguacccuuuuccacacacuggguggccucucagcacaggucccaggucacauaauggcauaauaaccacguucuggcgagcagccauaauaacaccacucagcucauacggauuuaagaaauguaauuaaacaauaaugccuuucuuagaggaauuaauuagaguaagcagucuuaaaaucacauccagauaauaucaaucuguguuuuucaaguagaaaguuugaaaauuuugaacacgcuuugugagguuuuuccaguuuuuuuuuuuuuguuucuuuuuuugacaaagucucgcucugucacacaggcuggagugcaguggcgcgaucuuggcuuacugcaaccuccgccucccuggcuccagcaauccucccaccucaacuucccaaguagcugggaccacgggagcgcaacaccaagccuggcuaauuuuuguauuuuuuuuuuuauagagauggaguuucaccaugcugcccaggcuggucuugaacuccuggacucaagugguccaaccgccucggccucccaaagugcugagauuacaggcaugagccaccguacccagccuugaauacacuuuggugaauucuguuuauaaauaauauaugcucauuguggaaauucuggaaaacacaaaagcuuaaagaagaaaaugaagugcaccauaaucauacuacccaaagacacugauaugcauaagcauaaugcauauaugauauauacacauauguauuuauaaaauugauguaauauuauaucauuguguauccuucuuuucauuugcuuauuauaucaugaacaauuucucaugacaaucaauuuuucaaaaauauaguuuccauagaugaguaaguuuuguauuauggauauaucaugauguaacuuuuuaaauuaucgauuccaauguuuacuauuauaaacaugauuauaaccauccuuauauauaaauauuuuuccuaucucuacuuauuuccuuaugauagacuuaggauagauuucuaaaaguaccauuauuagauuauagaagguuuuuaaaucucuaguucuuuacugcugacuuguaccaaauuacauguccaacucugaguaaggaaaugccuaucugaccauauccucaccaacauuuaaaauuaucauuuuuauuucucuaugaaaucauguccuuugaccccuuuuguugcuuucuaagcacuuuuuauuuauuaaggauauuacuucaucuuuuccuauuucuuuugaugcuaaaaguuuuuuccuacugauuaccaauuugccuuuucauuaaugauuuuuaacauauagaaguuuaaauuuguauuuaacaaaauacaucaacuccuauuauguauuauuucuuugcguuuaaucuuuuuuuuuuuuuuuugaaacaaaguuucacucuuguugcccaggcuggagugccauggcacgaucucggcucaccaccaccuccgccucccggguucaagagauucuccugccucagccuucugaguagccgggauuacaggcaugugccacugugccggcuaauuuuuguauuuuuaguagacacgggguuucaccauguuggucaggcuggucucgaacucccgaccucacgugauccacccuccucggccucccaagugcugggauuacaggcaugagccagcgcgccuggccugccuuuaauccuuuuuuaaaaaaauuauaaauuuagggggugcaaguguaguuuuguuacauggauauauuguguaguggugaagucugggcuuuugguguaaccgucacccgaauagugugcaaugcacucguuaaguauugcaucaucccucccuuccuccuacacccccacccuucucagucucccaugucuaucauuccacacuuuauguccaugaguacauauuauuuagcccccacuuauaagugaaaacaugcgguauuugacuuucugaguuauuuuacucaagauaauggccuccaacccauccauguugcugcaaaagacaugauuucauucuuuaaauauccuuuccugucuugagaucaaggaaauauugccuacaucuuccccuuaacauuuucuuuuuaauauuuaacucuucaauacauuugggacuuacuuuuauguaugaugugagguaagacacagccuugauauuuucuaaauauuuacccaaauuuacccaaggcuuucuguugaauaauuaacagaauuaacagaaucuccccuauuugaguaugugauauccuucaaaugucuggcacauuuuuuuuuggcauuuuccaaggaucaaaucuucgauuuauuuuuuuauucccacuguuuucuaauuuauuauuuuaucuuuucuuuauugcuuuucuccugauuuccuuaggauacuuauuaaguuuagugcucaauaauauacuuuuauucuuucugauuaaaaaaugaaaguauuuagaaauggaacuuuacuuuguguaaugcauccaguaaguuuugcucuguacucaucuuuuaaaauugcguauuugauuucaaugggaauuuagaauaauauucuuaaaauugccuguaauuguuuuuuuuaaaaaaaagcuuucauaauuucauuauuaauauugcucugggaucagaggaugugaccuguaaaaugcuaacauuaagcucuaauuccuccagauucugcugucuguagggacgggucaugacuaagugacacuuucacaccaaggucauaaagcuauuaggggguuccugguugaacggagagguaggacacacagaauuuacuucaaaaggaacggaaaaguaggcaacaggguuaacauggagcucagaguucagagggaaccagggccagcaacagagaaguaaaugaagaagcagaggaucuaagaaugaggauauagcuacaaggggucaaggguaaggcugcccaaauaccgggugagaggccagagacgggaaugcauaagagcgaaaggacugggcaggcucauguguuggugcuaagucuggugggccacugaggugcuuuccugcccuggggccucgccucuucagaggccagggaagcagcacacugaagagugaaucaggaagccuaauauaaauuugaccauaccuucuguguccuagagcauaccacuuuucucuauguuguaaagcgaggagacuagacuagaucauuugugaggucuuuuguagcucuaaagaugugugagucuaugcuuauagcacuguagccuucauucaugaaagaguaggcauguggaaucuggggagcggggaggcuggucugcagauggcugaaugguugggggaagggugacuccugcuaagaaaacuucccauugucucaaacuagacugcucauuuggucccgugccaggcacccuggcucuaaugacauguacuucuucagacucucuccagucaccuauaauaucuugauugccauuagaauuguaucuggcccaugaguggccuacaucccauguuucagccuagagcagauuuuccuggcuauggaggggagaugaucuaggaggcucuuccagaugauucccaacuccacaaaaaccacucugauuaagaagggaaaagugaguagccagugccugguugucacuuggagaaugaauugauuggauucagaauagagaaucagguuucuaagcuuguaacugccaguuauuauuguauguuuacacaucaaguagguaaaucuguuucaucaucuguuaaaauaggauugaggaugcaaaaagacuuccuggaugauuuuaagaauuaugugagauaauguguaugagcaugucuccaaugcuucugccaaggaauagcuaaguaaagagcacagacaucaaaugucagagcuggaagagcucuuacuuagaucuaggaaaagaacacguguuuaacugcuaaggaaacucaggucccgugaggaugucaccugccccaagaagacuuugauggacaucuaggauauuagguaggacacggacaguguguacaaacaugagugugcacacucccaagugaacauggguuuauuugcauauguauauguauauguaaaugaaagagcacaggaugcacagguuauagcuguuggaagauauggagggacagcuggaggggcuugccaaauugcuuagagcuggcuuugcuuaaaugauccaaacccuuugguuuuuacuaacacucuccuuuauccaaaagaauagggcugguuaaaugauaauuaauaauaggcugaugauucacuuuaguuaaaugcacacauuauaagugcaugugccaugugaauaauucacauuugaauauuuaaaaauaugcuccuaacacagaaaagcauuaaaauuggaagcaucacacacaaguacauuauuugacaguucuuuuugacucucaaccuugaaaauucagcugauccuuaauuagauuaccaacucuucaaccuggauugauuggaauaaccuuaauuugguuccacacuaaucugaggguuggggguacuccagagagauacguaguccaacuccucuuuuuacagaugaggagacugaggcuggcagagguuaagugacuuaaccaaggucacaucuuuugucagugguggggcuaggauuuaggauguggauuucagauuugcagggauguccuugacaugcacacuagcaaacauucgagcauggacccucuccuuuuggagugguaacccccuuuugguaauccucaauccuccugggauuaucucucaucccagagcaguggaaacucuuccuuucuaggaauuggcacagcuagucagcagcccacccuccccauguguuuauaaaaucacccuggaucuccccaguccuggaacaucaaggagaagggucuacuccaugccaggccucaucuucaacagcuugacaucugauuuuaauccucaaaugaauacuaagauguagguuuuauauucuccacguaagagauaaagaaaaccgaggugagggaggugaagugauuugaagcuuguaaguggcagagcugggauuccaggcucaggcuuccucucucccuccccgacuuccccaggacuggugaguggccaugaggaagccagcucccucuuuuuaguaucagcucugccuaguaucugcugcaaaccugcaacagucuugcccagaauuucccagaguguauucccuggaacgcacgaucuucaaaggguugagagguuuauguacacaaaaacuggcagauacauuuaggaaaaguggguuaaagaaguuaaucaggguucuuaacugugccuuuucuauccuuaaguaaauugagacucuucaaaauggaauuaaauauacaguuuccuggucucauugacaaugcgacucuuuuaucauugagcuuccuacaaaaugaauauuccauggaacauacccagggaaaugcuuguuuagccauuuagaaaauagcugugaugaaaucugcuccaaauaaaaacagugacaguguauauuuacacacucagaagccuuuuccuguugaaugagcugcaagaagucaucuccuuccucccaaagauggagaucuacugggaggucccuaaagaaggggugugugcuaaauugcuugaccagguagagagccuacugaggagccugacucccagaggucacaucaacgaauccacacuaacaaaauggucuugaguugcuccuuauauggagacagaccguuuaauguauccacuaggaugagauucuuuccaccugcguauccuuugcuauccaaccucucuagaaugaggugggguacaaauaguuaagcuaaaaauaagaugaauuaucacaugcauauauuuccaaaguacuguauguuccauagaaccaauauucuaugggauguuaagaaaagugaaacaauuuugaauaauuucagagauguuucuaugccaagguaacuucauuguaaauaaccaagcagggauagaacgugcaguuucccaaauuuauuugagcacagaacucuucuuucaggucaacugcuccacaggacacaaguuuagacaacaguagucuaagguguaacuuuaaaguaaauaaggccuuuuucuuuugcuuuuuucuuuucuuucucucuauuuuuguuuaagcaaggagaucagagcuuacacauauaaaugagaguugcaaccuagggaaacuagcugcucuugccagcaaugcggccacucuuucaaagggcuuuugaaacuccuuucagucauugucuccaggaauuagggcacauucuccugaaaacucuuguuaauggcaaagguugacccuuugagaggggauuugauuuugggaacaaaacuaugcaaagugaagcaugaugauucauguucaggaggaaguagacagaagugguuaaaagugaggacauggguuuaaacuccaacucugcuacuuaauaggggcgugacauugaggagguuaucuuuuaggacucagcgcuucauuugcaaaauggagauaauuauaucuaccucaaaagguuaccaugaugaugacauuaaaaaugagaucuauaggccgggcgugguggcucacgccuguaaucccagcacuucgggaggccgaggcgggaggaucacgaggucaguaaaucgagaccauccuggcuaacacggugaaaccccgucucuacuaaaaaaauacaaaaaaauuagccgggcgugguggcgggcgccuguagucccagcuacucgggaggcugaggcaggagaauggcgugaacccgggaggcggagcuugcagugagccgagaucgcgccacugcacuccagccugggggacagagcgagacuccgucucaaaaaaaaaagagaucuauaaaaugcuuagcaccaagcaauacaaaaauaacuaaugucucuaauaaaaccuugccugguuuuauugcguggcuuguaaacuggcaaugaagacaauucucaaaggaggguccagaaaucuuuagccauggaagcacaguugggcaaaaucuauggcccucugugaagucaagaguuauuuguauguauacauucuaguuuguauuuuuaaagauuuauugccuuuugaucacauuuuacacaugcaagcaccugccaucuugcuauauaaaaaugggccuaacaauuuuuuuccaauccuugcuccaugagagggauacugaaacaucauuuuaucaucaaccaccacagggagagccugguaaggucccuuuggaccuguuugggagauugggaacuacaauuauuguauuaauaaccuuauaacagccaguuucauauuaugaguuucuuucaaugaacaaccuaauguauugguuuguuagaacugauucaauaaucuuuguccauuucuuuuuuuuuuuuuuuuuuuugagacggaggcuuacucugucgcccaggcuggagugcaguggcgcgaucucggcucacugcaagcuccgccuccuggguucacgccauucuccugccucagccucccgaguagcugggacuacaggcgcccgccaccacgcauggcuaauuuuguguauuuuuaguagagacgggguuucaccguauuagccaggauguucuccaucuccugaccucgugaucuacccuccucggccucccaaagugcugggauuacaggcgugagccaccgcgccaagccaucguuguccauuucuuuaaccaugccauuucuauauuauauuaacguaacuguuuguagaauacaacagaauuuuaagauaggaggagaccuuagauguaauugaaugcaagggucucaaaaugccaacuuauauuuguuuggucuuuauccuguuuaaaaaucuacuuccagaauuccaccuuccccuaaaaaugaggaagauagggcuccaugugcauguaccacaaucccaucagcaauagucaguuggagcagaggauuuuuagguaagacaugucuucucugguuuaccucagucaccacuacuccuuauugucuuauacucaacugcuuccuucauuggucuuaccgccccaaaccccacuagcauuugaguuucagaaccacaguuuaaucuaccucuaauauuuuaugcaauaaaagcugagguccagugauauuuugugaccuacccaaacuauuagguaguuuugugaccuacccaaacuauuggaucacgcagcccaauaguggccaaacugaguuucaaacccauguuuccugauuucuaguuuaggccucuuucuaugcuaccauagaaccacucaucugaagacugccaauauuaauuauuuaaacaaaaucuggcauguuuuacaaaacguggugccagucauuuuauucaugaggaagaaaggagaggguuaugacuuuuuuuugaaagguaaauaguucauguuuccuguaagaaguauuuaaagaaaagauuucucagcaaguucugcuggggaacuguguguagaaccacaaaauguuuaaagcugagauuaucggcaaacccagauuauacaaucagacacuaaucugauguuaugguaguuccaauuaaagugauuuucagauacuguaauaaagcuaauguguauugaguuacaggaaccuugcaaagcauuuuucaugcauuguuuuacuuaauccuuacuguaauucugugcaauagguacuacgguucuuccucauuuuguagauauagauaucaagacuugauuaagcuugccccaaaucauacaacuaggaagaagcagaguggggauuugaacccaugcuuaucugcccacaagucuguguugucugccucauugccagcucaccagggucagcuguuuugauauuacagcugaugcuguaaagcccuugcagacauucuguagcccguauuagccacaggaucaacaaccagcaagcaucaccaucaucacuaaucaacugaaucucauuuugaacaaaaugagaaugcuuaucaagacuaccuuauaauacauuuaaggaggccaggcacauacccauaaucccagcacuuuggaagggugaggugggaggauuguuugaggccaggaguucgagaccagcgugggcaacauagcaagaccucaucucuacuuacauaaaaauaauuuuuuaaaugaaacuaaugcauucaaauacaggcaaaguauaauuuaccauaucaagaaucacuaccagcuuggagcugccauaucagggugaaaagugacagcgugucacucaucuuuguguccuucacaaagcccaacauuguaccugcuacccaguagagccucaaaacaugucugcuaaaaugggaggcuuuuguuuucauuuuguugcugcuugcaacuauacaauaaauaaauacuuauuuuggcuaagcaguacuuaaaucaaaaaggaaauuaucuuuguguuauugauuuuucuuuucauauuaauaaugcuuaacuaacauuucccucuggauguccggucaggcuggauaaaggagcaucuuacccuucccaggacagacuagucggccucugcagucugacuaaaaaccaaggagaccaaaugugaagucagcgugggacacaagagauucgagcggugggucuaaggaaaggcuuagaugcuuugccuuugaaaucugguaugcuggaaaucucugcugaggaaguuugaauucacaacuucaugagcaaauaucuccucgaguuuuuuuaguucggcucacuucccagaccuccacacuauuaguccacgugaauucagauagggugcaccaaacaucagaaagagugugaacaugaccagcauuaucugcugagaguaacacaggagucuucagcacaaaaucgauggaaacauaaacuggauucaacaaauacaugggaaaacaugucuggguuuuucucugggaccacaguuuauuggugauccuccaugaaagacacaaggcagauacaagcaccauaacucuagcaaauggcacacagugccagacaucaguaaagucuagagaauuugagaaucaacagaggucauagaaugagauccugcagaacuuguuugggcacgugugugugugugugucugugugugugugugugucuguguguguagagucaaugaugugagugauaaccuuggacaaauagaaagggccaaacacuauggaugccagcucaggugucuggacuuucucuguuucuagggagucaugaaagcacggagagcugugucucaggaaaggcagcgcuaauggagaugggucagaugggaacugaaagcagacagugaggcguggaggcuccugccacagccugugaaacagugaaugaaaugcagccucagugaaagcaguggugcuguggugaagaggaggaggcagauucucaugcugucggacaggaugcuuguccagguggaaguggagagugaaagagaggggucagguaacucugaaguuucuugccugaauaacugaaaggaugaaauacacuuucagagaaaacaauuguggugagugcuaguuugugcaguuacgagaauuaauucacuucaaguaacaaaccuguacauggacccucgaaucuaaaauaaaauuuaaaauuauuuuuaagaaaguaaaaacaaaaaagaaguaauuaauuaaaaaguuaaagauuagaucuauggaucauugggcaaacuguagacaaaacagccuagaugacugaaauuuuugcuuuuugguccaucaugggggcaucagcuggauacaaaccaaaacgugcucaccuauaaccagcuaauaauuccuccaaaaacacccuuggcugauagguuuggcuugaguggucauugaagacugcuaaauuguaggcuucuaauauaaggaggaauagaaaaagguagcaauugcuuuaaagguaaaggaggccauggauauuuuuuccuggacagaucauauuuugaaggacuaaaugauaaagccuuaguaaggauggacuuauuccuucuuuuguucaugccuuuugcuuuuccauuuguuuuuaguuuuuaauuucuuauggaucagguauuuauguguugauuguggauuaauuuuuaaaauaacgcuauuccccuccuuugacccugaaagaucaauucugucuuucaaacaagaccacauccaauuggaauacuaagaaauuuuuucuggucaugucggauucuuacgugcaguguuuuuguuuuguguuguuuuauuugagcaugauacuaaaacuacccuggaaaucacucccugaaaauagaacacucucgggaauuacagggguuuauaauuaaaauauguuauaaguggguggcgaaguggccacauuuuguccucuuaaauuugaauuucacuuccaucaugagcccauaucauuggggacuucagucuguaguugagaaggaacagggcuguaaugugugaaaacacauuucccuaaacugcauucacuaaaaguaccacuuucuaucacuaaaagcaagcuagaacgcauaaucguugucauugguuauguuucgaaacuggcccuauguaaaacaugaaugaaauugcauuugcuugggaaagguuuuuauuguuauguuuaaacccauaaaugagauuuuuaaaaaauguauauuacaacuaaucuaaugaauuuuuauugaauaauuuuauucuuucucucucuucucuacggaauguggguuuuuguuuuucuuguucuccaacacaaacugccagccauggccuaccaggaucuuuucccaaacacugcauguaacuucagauaccaugucuauuuuccucaguaccccagacugacauuucaacaaguacuucucaucauagcuuuuucagaagcucugaaaaagcaucugggggcauacugacauuaucagauuuuuaggguggaugauggaaauaggacauuugcuuuaacccuucccaacaauaaagcaagaaaccaacgaacugucuuccuacgucaaucaagccgaauugauucugaaauuuaucucuucacaguguaugaugggugaguguggcaauucacaaucacaaaugcuguuggaauucauugcaaaccucaauggcuugugugaucuaggccuaaucuggugguccaaugccauuggucuucauguuccaaagggggauuggcagcccauaugggguuuucagggcacuggacagcccugucucacagaagagaucuuucucugugggauccaugcauucccacaauuguuaugaucguuucauaguucauauucagagccuucucauauauuuccuacacaccgcacaugaguuuauuagaccuuuuccugaggauaggcggaagcagagaauauugggcaagaaggauggagagcagagucuucaggcacaggguccuggagauuagggacaaacuuuggccccugacaauuuugcauaaguucagcucuggcacaagucuaccauguugagguuagccaaucugaguuaaccgagaacacacugggagagaauuacucgccuuuuguuauuucugaaaccugaacugcuuuuagaaauaaaggcuggaauguuccauaggaacucggagcauggggcacgggcauggcacacacucgguugggcuauuuaaaaaccagucccuuggcuucccucugugauucuaaauacgugaaaucacauuacccugcagcagccgguaacuauuucuauaacauuguccagcaucugugcuugccgugacuggguccacccaacaaaaacaaaguggagaugugguaauugauuagguuaaucacuccaggcuuucugugccacagcuaauguccaucuagugucuacugacacuacuccuggaauuuuaaggacugaucuauguaacuagaucuauguaacuuccuaggggaagggaggugccuuagcauaucaaaaggaugcuuuuuaaaagagcuauuuauucauuuaacaagugaggaccagaaacacaauuuaucacuuucucagagacagcaaauucuuauccuauggaaggaucccagcauuagagacucugccccuuucugugggaaagaaucuaucuuuuuuggauuuguuugaugugcuaacuaacacuucccccagucacaccacuagccaucaaucaaacagauaaaccccuuaggaauaucuagucaauugcuaaucauuugaagacaucagccaguagaagggcauuagccaacaucauuacauaaugucaaaacaacugaucaaguuugugaauccaaugaaacagucaaaccaguuuaggaauuucauauacacaaaacaauagaugagugacuuuuagcuuuuuagcuugauauaaaauuuuuaaacccuaccauuuauaaauguguaagcauuuggcacacccuaugccaaguguuuuaucuacuuaaaccuuggaaguauguguucucacuuccauuuuaaagauaagaagacugaggcuuagugagauauacuaaucugcacaagacuacauguuuagguucuaugaguggcagggugagguuuaaacacuugucucuccaacguccacuccaugcuguuugccucuguguauguaacuucaaacagccaaaauggccaaguaaggcaagaaaauaaaaaaauaaaaaacaaacaagugaaaggccuggguccugaaucaugcaguuaagauagccaagacucagcugauccacaauugucuaauucugcccauauccguccagcuacaaaccaagucugcgaccugauaccugaguccugggagaccucuugacccccaugugauaccgcuguaaggacuaggacuccaauugccaaacauuacacaucagaacaaauuuuauguguuccauuaugccugugaacagaucugauuucuuagucaaauauuauuuuuuugaauauuuucaggcauagacugaguaugugguucccuuguggccaacucaaaacauauagcagagaguaauccuuugcacuauccuauauuaauauuuucuuucccuccuuguaauggaacuaguuauaaauuagaugagauuaaaaaacagucucuugagaauuaacauuuuaaggaauuaccuagaaagagcugagguguuuuuuuuccccacaugguaaaucauacagaguagcagccugccccagauccccggagacaacaucuugagcgcauauguuaugcuggguucuguauugacuaauucaaaaacuccagggcaaaagaacccaaguucccaaguuaaaaaugaaaguaaaauaguggaauggaauugggaucauuguugcaagauuccaacaacuucauaaauagccauuaaaguagacagcaugacagguuaacagauuuaccauuguaagaaucaaccugcacuguuggugugaagucgcaaacaaacccaucuaccucucacuuuacggauauucuguuuucucagaaauagaaucacauuugacaaaauuaauauugagaucauuuuacuagaaggcuuauccaaauauaugccauauuaaaaauagucaugauauaaauauuucucacaagagcugcagcgauggcgugaauaaaaaacucccuucugagauuucaguaaaaccagaucucacaaaggaucugaaagaaaacaaaaaagagaaaacaaacaaacagacacacacaaagagacacacacacacagaacaaaccuuauguuaauccgguuuagcauaacagugacuauuuugacacuauuuuaugaaguacgauacuauuccuucccagaugaaguaagagaaaugaaucggcuacagguuucucaugauaauguucagggcuggggguaucuaagcauguucaguagcagcuaaaaaaaucaaaaauucuaaaugcagcaaauguuagcacugucaaauggccaagcaugcaagaggaaucucucucuccaugcccuucuacaaauacaugcaaagccccaaauccaccggcuggaauuuuuaaaucguaaauuagauaucaaaaugcuuacgggccuuacaaugagauaacaucaggaggaacggugcguggaauggaucuggcauucucacauaaagcauuaucuuugguacaaguacacacggcagggcauuuuggcuucgcugguuucuuccccucagucagcaaaagcgcagauaagagacauaggaaauaagcaauucuuuucaggggaaugcaggcauuucccauccuuuugcuucuuucugauuccaugcagucgagaaaauauccccaaccaugaacagggcuucuggaauucagauggugauugucuugcucuaagaacaggucacauaggaguccacccuuuuccucugc

SEQ ID NO: 21565 - RNA, 299940 nt, Homo sapiens
uuuuauuaaaaccuugacaugaucaccagggaggaaaaauagagcaauagucaaaaccuguguguuaguccaagaugacuucugaagaaaugacagcuucuguucucauaccugugacucagagaaaagugguuucugcccagucggcugcagaugaaaguagugaaaaggucucagacaucaauauuucaaaagcacauacugucagacgaaguggggagacuucucauaccaucucacaacugaacaaacuuaaagaagaaccuucuggaagcaacuugccaaagauucucucaauagcgagggagaaaauagugagugaugagaacaguaaugaaaaauguugggagaaaaucaugccagauucugcgaaaaaccuuaacauuaacugcaacaacauauugagaaaccaucagcauggccuuccucagagacaauuuuaugaaauguacaacucuguugcugaggaagacuuguguuuagaaacuggaauuccuucuccacuggaaagaaagguguucccuggaauucaacuggaacuagacagaccuuccaugggcauuaguccuuuaggaaaucagucagugaucauagagacaggcagagcacacccugacagcagaagggcaguauuucauuuucauuaugaaguugacagaagaaugucagacacuuucuguacccuaucagaaaacuuaauuuuagacgauuguggaaauuguguaccacuaccugggggugaggagaagcaaaagaaaaacuauguggcauauaccuguaaacugauggaauuggccaaaaauugugauaauaagaaugagcagcugcagugugaucauugugacaccuugaaugauaaauacuuuugcuuugaaggcucuugugagaagguugacaugguauauucaggugauagcuuuuguaggaaagacuuuacugacagucaagcugccaagaccuuuuugagccauuuugaggacuucccugauaauugugaugauguagaagaagacgcuuuuaaaagcaaaaaggagcgauccacuuuguuagucaggagauucuguaaaaaugacagagaaguuaagaaaucuguguauacuggaacaagagcaauugugagaacucugccuucuggccacauugggcugacugcauggaguuacauagaucagaagagaaauggucccuuacugccuugugggagaguaauggaacccccgucaacaguggagauaaggcaagaugggagccaacgucugucagaagcccagugguauccuguaagcauuugaguuucuuuuuaccauuucuuuaaacuugcuuuuuuuuucaaaaaaaaguccaaauuuccauugucauaauugaugagaaauuuuaagaucugucaaauuaugauucuuagguuaagcauuugugguuauugaaaacagauacuccaauugauagcuaucaagauugaguugauacugcaacaacauaaaagugugucagaaaauaauguuauugggaguggaggaauuagggagauuuccugguaguggaaaaauggcuccauuuguugcuuaucuguuuguguucuuuugagauaaaugccuggguccuguucuaugguguaguucauuauuguuuuuaggucuccagaccuaacagaacuuaauucuguuuuuuuucauuuuccaacuaauggccccacuuccuucccucuuaaacuuuuuuaugcccuggauuccuuuggcaaagugaugaaaccuauggauucagaaugauguuuuuaaaugaaucagaugaaauagaaaucaucauaaaggacaaguuaugcggauauacauuuaucaugauuuuuuuaaauuaaccugacaauuuaggugcuucuuuauuaauacauuuaauaauaauaucuaguuaugugauaacuaucauaauuucaaaauagaauuagcccucaucuguauccacagauucaaccaacugcauauagaaaauauuuuuguaagaaacaaaaaauaacaauauaacaauaaaaaauaacacagauuuuacaaucuaauacacuguaacacuauuuacauaguauaagguauucuaaguaaucuagagaagauuuaaaguauacgggaagaugcauguauguuauaugcaaauacuaggccaucuuacauaagggacuugagcauucuugaacuuugguguucgaggggguagggggcaguucuggaaccaguuccucugagcuauugagggauaauuguagugaugaauauaaguccuuauauucauaaguauagauuguauacuuaugcauauauuggauuauguauauauacuuauguauauauaguauggauuucuugaaauuuucucaauuuuagcacuguaaauuccauguccuggaaaacccuucagaccaaaccagagcagucgaucacccuaaauaucaauaacauuuuaggauaucuaucacaacuguaauaggauauggaaauaucugugacuucuauuggugacaagaucacaguuacuauuacuacuacugaaguuuguugcuuauauucagaauuaaaggaaaugcuaaauuuccuuuuugagauuaaugaaaauaaugaaucacuuuuuuuuccucaaccagauuuccagguccucugaauucuauccacagucuccccucuuuaagaauccugcucuggaaauacacaugaucaggcugccugcucucagaccuuaucuguacaucugaggacagugccaugugccaucuuggauuuuuuuauccugaaaacucuugcuuccuucagucauucucuaugugaaacuguuucuagaacucucacauuccaauuuuucauaaguccuuuaaaaccugacccuagaaauaagcaccuggucuagagaaacaucauuuuuauugaaauauaagugcuauauuuuuacuuucaucaucaucaucaucaucaucauuguauuagucuguucucaugcugcuaauaaagacauagucaagacuggguaguuuacagagaaaaagagguucaguggacucacaguuccacaugguugggcaggccaaacaaucauggcagaaggcagaagaggagcaaagacaugucuuauaugguggcaggcaagaaaucaugugcaggggaacacccauguauaaaaccaucauaucuuaugagacuuauucacuaccaugagaaaacuauaggggaaaccgcccccaugauucaauuaucuccaccuggcccugcccuugacacauggagauuauuacaauuugaggugagauuuggguagggacacagcccaaccauuugagucaucaaucaggguagcuaacauuuauugagcauucaacaaaugccagauauugggcuaaauaauuuacauauuccauguuguacaaucaucuuaacuaccuuaggauuuugauaugauaauuaacacuuuuauugcuaagcaaacugauuuccugagaaauuauguaccucaucaagguuacuuagcuaguaagugaaauaacuaagauuuaauccaggcagcugacacuccuaggugguuucuuaagauccagaaaggaauaaaauucagaggaagcuuuuaaaagaacggaagaauucuguucguuucagcaucuguugauugagugaccccauucauugaugcucacgguaucucagacuuggccauguuagguauggugauuguaaaccugcuuacacgucacagucacuguccagaccccuccucaggcccuuugaaucagaaucacugggguagggcacagcaugaauauuuuuuucaaaguucccuuggugauucuauagauucuauggaguugggaaccauuggcuaggaguuuaaacagagcucuuugcuuuuugaucaggacauuucaggaauauuugccuuucccuaaaaaagacacugcuuggguucuuaggaacauuugggcugaccugggaaccugccugaaaagugaaagccugcagguccuucucuauacaguugaccacucaccccagccagugucuaaggauguguuucugugucucuugaccugauuccacaugaaaccugagucacagacaaggagccccucaccagcaugccuguccugcucagcacuagaugacuugcacagcaucucccugccaugaaacugcugcugagagcaacgugucaucuuaguuaaaaaugcagugguuuaaaaaaucauguacacucgaacauuaagagcacaaucgaaauuuaaauauagcaaagugaauggaaauagguugcuuuagaaccuuuaucauuguuucccuaugaggguugugaaucggguguaaauuucagaauaauuuuugguaugccuauacccuccuccaguuucuucuuuucuauagcccugcugcuguuucuucugagcuuguucacugguccccagcucaaaccugcccuuguucaucaaaggccugggaugguuaauuucuaauugaaaaggacaaaagggaugaugcaaauugucucuucccugcuucuuagucucuggaggcugggagagguugccacaccugucagaguagacuccaggaacuuuuauccccuuggucugagcaggcuuggaggaggcuauuggcauuuuuauuaaccauuaagaugcggcuggggaauaggcugguuguccuguccuuucuuaagggagauuucuaaagggggggcccuuucugaauauucaaaccacaccauaucagcaaugaaucaguauuuucuaagguaugguguucuguauaucuuguuuuuuaguuuagaaucugguagaaauucucaaaaguugcacaggugaauuauaacuaguuuuucccagcuccuaugaauuacuuccuucaaagaugcggaucuuaaugauaugcuccuuuuccuguguuuugguaauuacauauguguccguucugguuccucaaucagauuguaaaucgauuaaggacaagaaauaaguucugcauuauuuuacucuccauaaugcaagcauaaugccaaguauacagagaauaagggcaauguaaugguuacaaauacagucucuggagucagucgaccugaauuuaaauugugacccucacuccaucacugacuggccaugugaauucugguacacaguuugaccucuuuguuucuaauuaccuuuuuuauaaacugagaauaaugguguuauuguggcguuaaaugagaugcuacccaccacacaguucuagcaaggagugagugcugcucugcucacucuggccacuguggauaugcuuugucgagaacacauuuccaccaccuucugcugugugucuucucacucagggauguuuacagugguaugaauuugaauucauguuucucaaucuauaaugagguaguuugaacaauccuucccacacauuuaaagaaugugcuguuuguacaauuaauuccuuggcccucacauuaaacauuuuuuuuucuuggauaccuuggucagaaugacccauuuaauuuauauuugcacagcuguguagagaagauuggcuuugaauggaaaacauuaaugaagauuaaugcuugcugacauacuaacuacugguauccuccuucuccuccucauaagaaauuaaaacccuaucccuuauccaguuacagucauacucccucucuccugcucugaaauaagacaggauauuuugauggguggcuaaagucuccaagcuaaagauugguuagggguguuuuuccuuuaaaaaaaaauucucaaccugccugaauuuugaggaguuuagauacauauaguuaucuugaaugugaaguacaagaaguuucugcuucugccuugcuggaauugcucauguaaccugagauccacgugcacucagagaaugugaaggugccagggcagaaauuccacuggcuccuguauuaucacuuuacuuauuucccuucuuuguuccacaagauuuacuguacaagaauauguaugacaaaauagaaaaaaaacucagauacacuaaagaguaaaaaacaaagaauaaaaauguaaagauugaauaaaaaaauuuuacaucagucuagaaaagcuauaauuuaaaaaggaaggucaaaagcagcuucuguauugcugcuucuuauucugcuuucuuccuuuuaaaaguugccuuucuucuucauacuuuacucucaagaacagaaaauuaaaccuaacaggcaauuuuuuuuuaguguuucacaaaaaugccuuuguugguauacauguccuugauucuauauuuugucucuuucaaauugaagagaccugaaccuuaggggagagauaaugucuguugugugcaaagggaccaaccgcuaauaaauucaucuucugaguuguaauuuuuauggaugauaaaauauccauugagccccacuguucaauguuguaagggauugcuguugagauagcaacaugucuuguuuucuggucuggaaauuugguugcccuggagcuaggguacaguuuggaccuugagacaauuaaaauuucguggggugcuuaggcuuagcuggaagccugugcuuggugauuugccaggcugccucuuucauuacgaaggguagugauggguugaugacauggguauaggaugaugcuggccccuuccugcugggcacagugaaagggaauccagcuuccucucagcuccugugcaguuuagucaugucuagugccucaguggaaaaugugauggcugucagaguccagcuuugugaugauuggacugcuuucccuuauuagcugcauuggugcacuauaggauaaauguccccccgcaucucuguaguuauaccagcccuuuggcuaagauuugguaagagcgggaaugaaaaaccuugacucuggauuccaguguaagguaaaugcacugguggccacuguuauucucauaguauucuuuggacaguaucagcauuaggauuauuauuauuuuucuuuucccuagauguccuacauaaugggaauuagcagcuggagaggccccaucccugaaaaugggccgugguaguauguggccugaaaagaauuagauccagugggcaaggauaaaaccaucuggugaaacccugaucugcuccacaaccuguauuuugcagaccagagacucaagcugcccuuugaaugaccucugaaaagucacgagucauagaaguggccccuucugagcuuaagggaguccugggguuagagaggagguuuccacccuguugaucaaaugauucagcauucaaggauuugaagcaucaguggggggaggugcacccacugacccccacgacuagacuaacugguggcucagacagcgcccucucucaaaagcuguucuuagacagcggugcugggcuuauuuucuggcaccaugacaaccaaauggugccccuuucagugguucuuuauucuaguggcuugcuuaaacacauucagagcuucacauuaaauauaggucuucuagagcucaggcaccagaacccugaaccccuaaccccaaggcucagucccuuacaaggaaccccaaacccuuccuucuuauuuaggccaucacuccucaaacccugagaaagcucagcagaaaaccuccucagccuucagcaauacaaagucaugcuaucauuguucaaggauagggaaagccaguccuuugaaacacaauagcagauuuccuugaaggggaggagaaaugcuuuggugucuucuuauuuuuuuuaacagcuuuauugauguauaauucacauaccauacaauucacccaguuaagguauacaauucagugguuuuaaauauguucacagauaugugcaggcaucacuacagucaauuuuagaacauuuucaucaucucaaaaagcaacccuguuucuuuuagcuaucacccucuaucgccccauccugugccucucccccagcccuaaggaaccacuaauccacuuucugucucuauagauuucccuauucuggacuuucauaugaauggacuuucauacuguuuggucuugugacuggcuucuuucacuucgcauaaucuuuucaagguuaaauauucauuuauacgguagcaugaaucaauauucauacuuuucacugcugaauaauauuucauuguaugauuaugccccauuuuauuuaucuguucaucaauuguuggacauugaguuguuuccacuuuuggauuauuaugaauaauacugcugugagcauucaugcagaaguuuuuguguggacauaguuuccauuucuuuuggauaaauacccaggauuggaauugcugggucacaugauaacucuguuuaaucuuuucaggaauggccagacuguuuuccaaagcagcugcacauuuuacauucccaccagcaaugcaaaaggguucuaguuucuccauaucuuuuuuuuuuuuucccggagacggagucuugcucuguugcccaggcuggagugcaguggcacaaucuagacucacugcaaccucugccuccuggguucaagcaauucucaugccucaaccugaggcaugaguauuugggauuacaggugcgugccacuaugcccagcuaauuuuuauauuuuuaguagagacagggugucaccauguuggccaggcuggucucaaacuccugaccucaggugauccgcccaccuuggccuccgaaaauggugggauuacaggcgugagccaccacacccagccugauuucuccacaucuugaacaguguuucuuauugucugucuuuugguuauagccauccuaguggguguaaacugauauuucauuguuuugauuugcaucuuccugauggcaaaugaugcugaacaucuuuucaugugcucuuagccauuuguauaucauagaaaugucuagucaaauuauuugcccauuuuuaaauugagcugucuuuuuuauuuuugauauauauucuggauauaaguucauuaucagauaugugguuugcaaaauagauuuagauauauguauagguauagauauaugaaugaagaucaggcaaguggcaaaggagguuuacaauuuuauuuacaguggagcuuguuaaacaugucccuuggacauucaucuccuucucaauauuucucacauuauucuaccagcaacaacuuucaaauaugauuaaaaauuuuuuuuguagcagcaagaucuugcuauguugcccaggcuagucuccaacuucuggccucaacugauccuccugccucagccuccgaaaguacugggauuacaggcaugcgccacugugccuggcuccaaaugugauuuuaaaaauuuuccaacuucuccagauucucccaaacuccagucugcauagcuuuucuuuuuuuucccuccucccuuucugccuaaauguuguuaucuaaauuguuuuuuuuauuauccaaacucugcaccccagagcaguggcugggaaugagauugucaguccacaaccuugggcacaaggacaucauccaacacagugaugguugaggaagaggucgccacaucacaauaaugcacuccguuaugcacagguacaagcagggccaucacuagggugagacaagugagugucucacccuugugcaccuucucucagggucucagaagugccacccauauacuucuuagugagugccuccuuaaauugugagugcugggcagcucccuugucccacucuaguccuagccuugguacaagggccuaagagagucugugguuuagaaaugaauaccaucuuccuaguucaggaaugaccuugacugaacccucagguacaucaauacagauauuuguaaaauaaaagcuaagaguggcuucugcauuuuuaaaugguugaaaaaaaucaaaagaaggauacuauuucaugacaugaaaauuauauagaauugaaauuguauugcucauuaauaaggguuagggagcacagccauacucauucuuuuauguauugucuguuggugcuuuuacccucuaauggcagaguuaaauagccacaacagacacuguaugaccugcagaaacuaaaauauuuguuaucuuguccuuuacaugaaaccuuugccuauccuuggcuuagaacaucccucgcuaccuggcuaacucccauucagcuuucaggccugagcuuaguuucacuuucucuugguggucuucucugccagcccccaacucccacccuggacccuaggccagaguuucugacagucagugcucaauauguauuucucgaaugacucuuugaauuauaaaugaagaagggcgguuuccacccacuucugcugucuccuucuuuccuuccccagaacuacugcaggcuuguuagcuguccuccgccugacccucagagcuuggaaccaguucuuuugugcaauaccuguaggacggaaucaggauuuuccauugaaauuugaaaggaucuuuuucaguccugcaaacccagcaauccaugcuugucaucuccccagacuuggccugaaaggucauguuugcaucuccuugucccuggcuccccauuucaacuggcuguuagaacccuugagaaaguuucuggauccuuuuugcuuacaagggaacaccugagacagcugugugcuucagugggccaagaaggaaacacgccucccgaucucaagaccccagagcucugucucugcucuucagaacccccagugcuuccuagacagaauuuuccacauggacuggagggaaucuagcuucugucaguggggguucggggauggacauggugguggagggauagggacagcaugcugucguuguaaguuggggagaucauuucauuccugggguuuggaagguguuugucuaguuccuucaaaccauuugacaccaauacuuuugguaagagaccugaaacagcaccccucucuucuaaaaagagccaaguacuaauuccagcucugccauuggcugcuugugugacuugagcaagucacuuuagggccgagaauuuuagguauuuuucaguauuaaaaaaagagggagggcagacauguauucauugccugcuguaugucaggcacugugucuauaauuugcauauaguaauuuaacaaauuauaaauuaacacuuccucuuaagucuaaaauugugccagucuguggcuuccugauuuaaauccugacccugaguuucagguugaguauucuaccucccucagcaaugccuccuugagguuugauuuggaaugaaucuugugacucacucccugacgcuguguaguagaagggcagaggauuuggcuaagccuggaaaugucuguagaaguaagaugguaaguacuggcuggaugcuuucugugucuuacacugggcuucccagaugucuugucuuuuaucuuuucuuuccuuucauucucauggcgacugucuaugagguuaaacacccccauuucauuggguccugugugaccaaugucacaccauguuagcacuugaacccaggucuggcuaccucuaaaguccauacucauaacugcuccuaaguuccucuggaagauucugaugcaacuuaccccuauaacuuggcagaaauucuguucucuuauuaaaugugcaaauguugagcuggaugagucccugagcucuuuuuuuucuucaaaugugaacugggugugacuuuuggaugaaaugggagaugcagggaacaauaccaauucuuaaugcgagggguguguugucuauugaaauggcuaagauuuauuuuuuaugacucagccugcuaggaggaggaaaccaagccccaagguuugaauguuuuacagaauugcuauaauuuagaaguacaguuaagaaguuuuauaaguaaguaagcaagagcaaaguccaaagcaaacugcacacaucuugagucagaaucuauagcuuauucacaaucaugcugagauacccaaaaauacuggcaacguauguuaguauuuuuccauuuuaauuuaguuuucugugaucucucaggguucugaccaaccgaccuaaguaugaaagacaugacucaguagcauuucuuuccauaaucacaccauuagaaugaaguuuucaccuacuucacaagguugugaggcgguaggaaaaagaucuaagcguguuguauauuaaagugcuuggcaaacacuauuuaaaccucccugcaaguauaacuuuucuccucuuacuccaugcucuaaaggauucagagugaggcaccuggaggaaaaacagacacaaaacuacagaggaggcaacaaaacaaaaccagaggcacccuguuuuccuuucauaaaugcugcaagcgcagucgaacccgcuauggaaacccgacgcuuugguuugccuuucagggugcuggcaugaaugaauaauaacuucauuuucaacuugagauuagauaacuuuuaucaccaacaccuacuucauuuuaucccuauguuuuaauagaauaaggaauagagaaucaauuuguugguagaccaugcugaguagcuuagcuucagaaagauuuagcaccaaauuauaaauggugacacuuuaauagugagugugaugugcauugggagccagccugugggaguuuggcaguuggaaagccccauagcuucauuuuuuccagauuuuuguacccuuccaucagauaguaacuccuuagccuugagaaacucucuuccaggacaaggggaaaguuuauuugaguucuaaauuguuuaauagcaaaugcauuauuugucucuuuaaugagaccaagaaaauggcuucagacccugguugaaccagccaguucuccuuuugauggccacaaaccaaauaugggcaguguaaugaugguaugacucuggccugacuaauauuuuugugaggagaaugccauuauuauggugaccauauuuuccaaacaaaaaauugggaacuuuuuauucagaggaaagaggggcagaauauuugaaauugagacugacccaggaaauccagaaugaauggucuugguagcuauugaucacagcauaaaggaaaaagaaugugaaugaaccagugcaaaucuaauugguugcuagaaaagucaggagccucaaaaugaaugacuugcuagugguggcaaagaaucaccaucuacaugcaaagaaaacacauuagaugcccugagaauccagugacuguuuuucucagaguuuuuauuuuucuguauuuuugccgaguacauuuaguagcuaccauguuuuggaaaugugaaaguaaugaaauagauuuaaacuccaggucuugcucagcuaaauaaugucccuuuccaaggaaucaccuugaaagguuguccccacuuuccauuuaugcugccauuaugcacaaugucucaacccuuggauugagauuuuuagaaacaauccauucaagcauccuggcuaauggugguuuggguccauauugacaugugauuauaaaggacaggauugguuuuauuagagaucuuaaaaacugaauggaggugaaaggagaugucuggaaauauuuuaagcaaagguaaaacuauauguuuuguauacaaaacacaaacuugaacacagacuuggccguugcuucacaguccuggccauggcucucuucaguguugauggacaguucagaggcacucacaaacucagaaugcagcuuugguuuggacugagccucaugggcacaaagcucaugccaaagggcagauuggaauuuagcccugucucuuccaccuuccucggcuagaugcccuucuacagggcacaaccugcccagccccacauggucaugcuagcuagaagcacauggaacagaagcagaagagcuucugaagcccaaaacuucgauuuuuuuuucuuggauucauacauuauaugcucagaacaguggagucuguugaguuccaauggccuaaaauaugaagacauuaaauuaauucaggugaaugcuuuucuacaugaauauaaaauaauuauuugguaacuuuacgaacuauagauucuugagcuagcucaucuuuuuuaaaaauuuuuuauuauuauuuuuucuuuagagacagggucuugcucugucaccuaggcugaaguauagugguucaauaauagcucacugcagucuggaacuccugggcucaagcaguccuccugcuucagccuccugagaagcugggauuauagaugcauaccaccaugcccggauaauuaaaaaaauuuuuuuuguagagacugggucuuguuuuguugcccagguuggcgucaaguaauccucuugccucagcccccugagaagcugggaauaugggcucgugccaccacaccuggcuaaucaaaaauauauauauauauuuuuuguagagguagggucucacguuguugcccagguuugucucaagcuccuggccucaagugaucuuuccgccuugaccucucaaaguguugggauuauaggcaugagccauggugucuggccuggcccaucuucuauaaucacguucagucccuugcuuuauggauaaacuggccaaggcccuagacaggugaaguuacuugaacagguuuacauagcuaaugauggaagauccagaacuggaaucaaggucucuauagacucucucuccucaucucuaaaauauuauaaaaaauacauuucugauacaaauagcugugucaccuaguagguucucuguugauguuggcagauucugaacccuaaugccuuuacaguuccugggaugcauacauuccugaaacagagcaccagcccuggaagaguucauggugggauaguggaggcagacaugucugucucucacuuauuucauccucuucccaggcuguaaauaaccuugguugggccaggcgcgguggcucacgccuguacucccagcacuuugggaggccgaggcggguggaucacaaggucaggagaucgagaccauccuggcuaacauggugaaacuccgugucuaauaaaaauacaaaaaauuagccaggcgugguaaaaaaaaaaaaaguaauaauaaccuuaguuggugcauaguuucucagguuuguccugccuucucugauccauuaugguuuucuuggcugauccugucuucauuucuuuaagaaacuggcacaucuuguugcaauaacauugucaauucuuuaagugcucagagaugcccuuuuaauuuggauguagccagguuuugugaguucauuucuccccuuagucuaguuucuuuccauccuucacuuggcagguaguucucucugguuaaugagugugagugcuucaaagcauacagagcagccauggggucccucccagucucucaggaggauauuucccguuguucuuuuucuuuuauuugugagaagcagagccaaaugcaagacacugagcccagcaggaggggccagaccuggcccaggaagagccaguauggucugggcugcaaggaauugagccaggaaccccaggcucauaaaacaucagcacugcaagggccuuagagaccaucagguccaacccuucauuuucagaauaggaaacugaggcucaaagagacaaugaccuuucacaggucuggucaggcaucaguuucagagccaggccuggagcccagguugcucucagaucaacuuuccugcccugugccuggaugccaaacacuauuucugacccauuggguguggagcugaacugaucaaauuauaacagcuaaguaauggagggcuuaaggcuccauaaugauuaaagguaugagguuaggggcaugccuaguuucaaauucugaccuggcacuuacuauuuauagcucugaggcuuaaugcaaguuacuuacccucucugugcugcuauuuauuucuaaauaauuguaccuaccucuuagaguuguuguaaagauuaguagacuuuuauacguugaauguuaacauauguuaacaaacacguuacaaauguuucagcauuuagaacaguagcuggcacuauguagcuguuguuguuuccuuuuauucuuuuuuaaaauuuuguuauuuuuuuauaaauaaccuuuuuaaaauaaaaaaccuuuuaaaaaauaaaaagccaaauuuagcaguggguuuuguauaccaacuuuagugacacuguuaauaaguucugauaacccacuaccauuggaccaaccuucuuugauucuugucuugauuuuuaaccacaaugcuauauuaccuccagguaaauaaagauuuuucucuagggacccugacagaauagcuauaaaacgugguauacugucucuuaagugcuauaugaguggcaggguaauuuggguagucuuagaaggcuucaugggagaagugggauauuaguuccugccaggggccagaauugcuugucucccuaccagugagaaggcaaaguguuccgccauaagaaaauugaccaccguuuucuuucacaggaguccaugggauuuauuccaaaaauaauauugauuucugaggcccuuuugccauuuuguuuuagccaguucuuuuccucccgccuuuuaugacuucacauaaaauuuaaagggauauaauugcucucaauagaauugaaauuuuccuguuguguuuucaaagcaucuauuuugaaaauugccuucuacacuuugcagaaauuguugccagcaucuguugaugugaggcaaaggggaccaauguauuuauuuuuauuuguuuuuuuguuuauauaguuagucauuuucaguagugaaauaagcaccgaugaacuuaacagccaauaguaaaacuagaaccuugacaaacccuaugccuagccauaugguucccugcucuugaccaccccaaaccucuacaugucccucccuucccagguaccaucuuccuuaauucuguuucugucauucccuuacuuuccuuuuauacaguguuauugcaucuacauguauucuuaagaacuguauauuuuaauaaaugccacugaauuguacacuucaaaauggugauuacuaugugaauucaugucaaaaaaaacuucagauuuuaaauuuuaguuguuuugaaguuuauauaaagguacacuguguacaaucuuuugggacuuauuuuacacuguauuuuauuccuaagauucauuuauacuuuuguagguugcuguaguucauuuguuuuaauugcuguauuauauuccuguaugugaauauaucauacuuuacuggugcauucuccaguugauggacauuuagaguguuucuauguuuuugguauuuuaaacaauccauccaugaauauuuuuguauauguucuuuguuauauguguccaaaauuuucucuuggauauaucccuagaaagcaaacuguugaaacacaggguaugugaauguucaaauuuaggagauaguaguaaacuguuuucuaaagugguugcaucaguuuacacaccccccaacccuugccacuaugauguacaaaauauucuuuggaucuacacucucucuaauacuuuauauguuucaacuuguuauuuugccaaucaaauggauuaaaaaauauuucuuuguuuaauuuugcauuuuccugaucacugaugauguuuaccauauuuuuguguuuuaauuggccguguaguuuuuguguguguaaaaugcccauuuucuguuggguugcuugugcuucuuuauugauuuguaggauuuauuaaauauauauaugugcauauauacauauauauuuaauauauuuauaaauaauauaaauauauauuaaauauauauguauauaugcacauauauguauauacacacauauauauagagagagagagagggagagagagggagagagacagagucuuacucugucacccaugcuagagugcaguggcaggaucuuggcucgcuacaguaucaaacuucuguguucaaaagauccucccuacuucagccucccgaguagcugggacuacaggcaugcaugccuggcuauuuuuuuuuauuuuuaguagggauggcaucucacuguguugccuaggcuggucuugaacuccugagcucaagcuaugcuccugccucagccuuccagaauacugggauuauaggcaugagccagugugccuggccagauauauucuuaauauuaucuuuuuuuguuuguguauaguguuaauacuuucuccuauauuuuaauugucuuuucuuuuuuguaagauuuugaauaagcaaaauucuuaaauuuuauagucaaacuuauuaaaguuuuaugaacacugcuuuuuguuuauuaaauguuuucucucuaccuaaagucuaagauauucacuuauauuuucugcuagaagcuuuaaaguuuuauuuuugacaucgaauucccuaacccauuuaaaucuuugauuuuguauauggugugacguaggcaggaauccauugucauuuucugugucaauauucauuuuccagcucuaaucugacaugucaccucuaucauauaccaaaauuccauacaugugugggccuucucugagcccuuuaauuuaguucauugguuaauucauccaucacugugccaguaacauuaggaaguccuaacaacauuuuuuaagaagugucuuuacuauuccuggcccuuuaguuacccugucugucugucugucugucugucucucucucucucucauaauuauuguugaaguauaacacaucuacagaaaaauaugcaaaucauauaagguguacaggucaauguauuucacaaaguaaacacagauuuagccagcacccaaaccaacaaauggaauauuagcaccccagaagccuuuguuguaucuccuuucagugucucucucccucccacaaaacaaacuaauauugucuucuaacaccauucacuuggccuauuuuugaacauuauauaaaagaauucauaguugguacuauuuuguaugucuccuuuuacccaaccuuauaucuguaagauucauccaugucgcuggauguaguuauaguuuguacauucucauugcuauuucccauuucauuucaugaauaucccacucuuuauucauuccccuguuaacagucauuugguuuguucaccguuuggggcuucuaugaauagugcuagucuguuuccugccagccuuuaaguccuugccugagcuaguucccucuucuugucauaucucuauuuacuccacguauuaguccauuuucacacugcuauaaauauacuacuggagacuggguaauuuguaaacaaaggagguuuaauugacucacaguuccacauggcugcagagggcuuaggaaacuuacaaucaggcggaaggggaagcagucaccuucuucacaagguggcaggggagagagaaagcaugugaagggggaacugucaaacacuuauaaaaccaucagaucuuaugagaacuuauucacuaucaugagaacagcaugggggaaacuucccccaugaugcaaucuccagucaccucccaccaggacacucccucaacacguggggucuauggggauuacaguuagagaugagauuuggguggggacacaaagccaaacuauauuacuccacuacuuaagauccuggccauuuaacaaaaccuagguaaguacaucccaucccuuuugugaagagcucuuagacuacccuaaucuaccaaguucuucucugucagggcaucuaaccuuguagcuuaugaguugaacuauaaguguaauacuuggaagguuuuuuugcaaaaaaauaaaaauuuaaaagaaaacaaaaaaauaauuaucuagcacauaugaauuaagagaaguuuuuccuaaacauguaaacacugaguuuacuuguagucauaauaugcaaggaaaggagggaagaaacagcuuccaagaguuuguucaauucaaagagaugauuggcauaaccaacuugcauuucaucuuucuucagaagaaagcauaggcuagguucacagcaugaagugauggagaaaaugaucaagguuguugacuuacaugguucugcuccuaacucuggccaguuuaugggaugggauacuuguaagagcugaggcagaguauuaauauuuaguuugugaagcugucagaucacuaggcaauggaaacuugaaaagaucuccucaacuacuuuuucagauuaaggauuuugggguaccaaaaagccaugugacuuaguagugguuugaagugcaucauuuucuuaccaaugggacaagauaucugaauacacugaauuagaaaauguuaagauaaaagcaaaauucaagccaaacaaauaagacuuucagaguuaccagccugggugauagagcgagacuccaacucaaaaaaaaaaaaaaaaaaaaaaaaaagacuuucagaguuacuuagaagaaauggaaauugcagaagagauuugcaguuuuucauguguaagaaccgugcaugaagauuuugccagcugcucuggucuaguuagaugauuaaacaucugcuucaucaucgaagcucauuguaaaagaaacugauccaucuaaaaaagaagucaugcccauccaaaggauacgucauucaaauaauuuuguagauaaguauaugcaucccaaaacuagccggaaauuucugauuauguggucaaacacuuggcaauguuggaggccaaugggcauuguaaaauuacugcuaagauugaaacuuaaaguggcuguuaguaaaauaggccuggauucagaauugaaaugcgcuggaacugaauacaguccacaguuucuaaaccugcuaaacaucaguauucucaucaacgugauuaaaauugaacagugacaagcacacaucuacauaccuacuugugaucaugugacucacuacuuggcugccuucauuuguauuuguuuaaucuuaccuaacuuggcuuuaaacuuaaaauuauaaaaguaauacacucuccuuguaaagaaaaaucgguguauaaaacuuuuaaagugaccucuucuccaauuucucccaccaagugaacaaacaguucauugguucugguuucacacuuuccugugaauucugucuagguuuucagcuccuucggggcaugaauuucuuauuuaauuuuguaauccuuuuuauccagaauagugcuuugcacaaaacaaguucucaguacauaacuuauuugacuaaugauugauugaauaaggauuggaggggagaaugcccacauggaaaccuagaggcuuguaaccaaaccaaaaagcaauguuuucaaaguucaauucaguugcauuugacaagaaguauuacuaauaaccuuuaaaggagcacucuaauugcuacuuuucuaauuccuccuucccccuaaauaccaacucacaaagagauaauaaacaaaucuuugagaaaagguaagugugagucccuccucccuacuucuccuucuuagagugagggacaugaggcaggagaggcuggggaagacaguagagguguccucgcaguagauaaaucuguuacucuguauugccugacuguaaaauuugcuguggaacauuuuuauugguaauuucuuuugcagauguuucuggagaaaguugaaauuaugcugguaaaaacauaucuagacuccacauugcaaauuuaaacauauuguauuuuauuuccuuaagcaaaaagggaacucuuuuucccccuccuucuuuucuuucuuucuuuuucuuuuuuucuuuuuuaagcuagaaaaaaggaaugaggaaaguccaaagugucuuuuccuauuuggacugaaaaauuaauuauggcuuugggaauaaagguagugagcaucauaucucauuucuaguuaaccgguaguucccuuuacauauaaagagcaauuacuuuugaagacucaaaaaauauauagucuuaaggugugcuucauauuauuuccccaugguuucauuuuuauuucauuauccucugacuccaugacaaaauguuuauuuggugcuugcaaauugaaaaaaucuggaguggaauaagccacuugccauuucugauuaauugccuuggauaugcuuuuaaauccucccacugaaccugaagcguacugucccaaauaacgcuuuuugaagagaaaacuuuuggaaugcccuucauuucuuugaguuuucauaagaguggaauguguuauacaggcagccuagugagcaguuaagagcugggcucuggaaggagucccggcuccaccguuaacuagcaguggagccuucagcaauuuacuuaaucucccuaagccucaguuuuucucaccucuauaaugagaaucaugaaaauaacaccuaaucuagagagucaugaggauucgguaucugaaaaagcaacauggcacauagaaauuguucaauagauuuuagcugcugcuauugucauuaugaucucugugacuacuaaucguaagaaugaauugugaagaucuuuaguacaggaaugugcucuuuaugucugagcaaauauuuugcacauugccacagucuuuauuuguuagcacgcaugacauuuuuacuuugcuauguggucauuuauagucgguugccccuccuagauuguaagccugcuggccggagggagcagcucuucuagauuagccuuugcaugcaccaguagacucagaaggccuugcacuuagcagguccucaagaaaggcuuauugaaugcacugggaaguuauagguggagggcugggauccagcuugcuccagagugaggucucugccucagaaauauccucgcagcaguugaauaagggccaggacuaggguuugggauuucgcauuucaaccaggaauuggagcugccaagaugcuagucacaauagugagagccagccuuccagucgcugaaugaaguugaaaaguagaacagauuuggaaaacagaaguuauuucauuuuucagggugaccagauuaguuuuucuuuauuuuuuuuauauugcauauuuugaauuauuaaaaaguaaaugguucagaacaugagauucagauuuguaaacugccagaauccagguugaagaaacaggcaguaagagugucaguagaaauuauccaaucaucaagggaaaaaugcaagucugagagucuccugacauaauuaaggaagugagucuuccuuauggucuaguggggccuuccuucugucacggcaauuaaagacacaucccuaggcacaaaaacacaucacauggaaaguuggagagccccucauuucucuagucuuuuaauacagcagaaaagaaaagguacauaaugcgguggucugcuuggugaaggagacugguuagcuauuuaaccaaaccuauuuucucuuccucuucagugcccagcuagaccauauuuccagacucccuugcaguuagaugcauccaugugccugaauuuuggccacuggaauauggaaagaagugaaguacaccauguucuaggccuagcccauuaacagaaccuccugggcaauccuauacccucccucuucccaucagccugcugaaagggaaggauuggaguuucuggaauaguuggagggcaagaucuaaggagcuugcucccugaaucugagcaccugcaggugacucagagaccgagaacuaaacuacuuugugaagccucugggagaguucaggguuuaucucuuauaguuguucgaauuaauaacauucccucagccauuaauaacauucccuuauagugcuuuacaucuauugggguggacagauacaaaguaaucacccaaauuacuuaggcaaaagaaaaaugccguguucaggccgagugcaguggcucaugccuguaaucccagcacuuugggaggccgaggcaggcggaucacgaggucaggagaucgagaccauccuggcuaacaccuugaaaccccaucucuacuaaaaguacaaaaaauuagcuggacgugguggugggugccuguaaucccagcuauucaggaagcugaggcaggagaauggcgugaaucugggaggcagaacuugcagugagccgagaucgggccacugcacuccagccugggugauagagcgagacuccaucucaaaaaaaaaaaaaaaaagaaaaaugcccuguucaguaacacaauacaagggcaagccuaaauagauuacagagucacuuuuaaggaguugaaauuucaacugugaucugaaagaggaaaaugaauuauuuuauuauaaggaggcaguauaauaaugaagauaauaauugguccuaugugacagaguuguucuaaggauuaaguuaauguuuuaaauaaccuaauaauaauuauauauauuaauaaauuagucaaaugcacagaacauugccuaaguuguaaauguuuauuauuuuuguugucuuauuuuuuuuuuuggagauggagucucgcucugucgcuuggacuagagugugguggugcgaucuccacucacugcaaccuccaccccaccccccggguucaagugauucuccugccucugccucccaaguagcugggauuacaggcacccacuaucacacccggcuaauauuuuuguauuuuuaguagagucaggguuucaccauguuggccaggcuggugucaaacuccugaccucaagugaucugcccaucucggccucccaaaguacugggauuacaggagugaaucacggugccuagcuguugucuuacuuuugaguuguacuuccuagguguaagucccagcucugccuccuacuuguuauaaccuugggcaguguacuuaaucucucugauucucauuucuucacccauaaaguauugaugguaaugauacauacuuuacagaguuauuuauggaucccuucucagggcccaacguaaugaguaacaaauuuauggccuuuuuacuucaaguuguuuuaggauccauagagauacuccaagaucccuguucagagagaccuugcugucauacgcucaagaauuaaauaaccauucaaggcauugugugauuucauguaaauaagagugcuuguaucacuguuguggucguauguuaauuugaauggucaaaggaccuuugacucccuucugaggugcugcuuaguugaauagucuacaugccaguagauuucuguaguguggcuauucuauggauaucuguagagcaagaucaucuuuuuuagcaaacccuuuucugugucaguuuguuugaauucucuaaaagcuagagauuuauuauuuugguuucauuuuaaaaaugcagccucuuguguuuaaauuuauacaaauuacucuuagauuuaguccauguuaaaaagagaggauugaaaaaaagcagagagaggguuggauuagauaagugcuuuucagaugggguuggaagagccccuagaauuuaugauugucuuugucaaacaccguguaauucuguccuuugaaacauaaaauaacuaacaguauaauuguguacuaaauaccuuauuauucuuuuaaaguaauugauuuuucagauuuuaauauauuguguaucuauucaaaaaaauuaaaaauacaacagagagaaaaaaucuauaauccaaccacuaaaggaugccuaguguuaauauuugguaaauuuucuuucaauuuucauuuuaugcauauauauuuuuuucccacaaaauuugagucuuaccauauauaaugcuuuuuuucuuagccuuuaaaaaauaaugacagugagauaacucacauaauauaaaauucaccccuuuuaaaguauacaauucaaugauuuaauuuaccauauucauggaguuguacaaucauaaucguaauuaauuuuagaauauuuucaucacaccaaagagaaacuccauacccauuagcagucacccccauccucuccuuuccacccacccacccgucccugguaacuaguaaucugcuuuuugucuuuauggauuugccuauucuggacauuucauauauggaaucacgcaauguuuggccuuuugugacgggcguuuuucacuuaguguaauguuucuaagguucaucauguuacagcauauguuaguacuucacuacuuuuuaugacugaauacuaccccguuguguggauauaccacuuuuuauguauccauucaucaggugauagacauuuggauuguuuccaccuuuuggauguaugaauagugcuucugugaacauucauaugcaaauuuuuguguggauauauguuuucaauucuucugguuauauauaucuaggaauagaaaugcugggucauuugguaauuccauguuuaauauuuugagaaauuacccaacaauuuuuaaaaaauggcugcacuuuuucguuuucauaggcuguuuuuucaucuaccauaauaucaugauuauuuauauaugucuuaaauuuucuucaaaaaaauuuauuuuccuuaaaacgcucauaacagauuaugaaaguauuuuuaauagcugaccuacacuccacugguuacauaagcaaauuaauuguuuuccuaauuuuggacauuuuacauuauuauuauaaacaaugauacaaugacauuuguaugcaugucuauuucuuuaguguaaguauguagagguagaguuauggggccaaaggguauagacauauuuaauauccuugauacuuugaugccgcacuuuucucucagaagaauuaccaaccuauacuuccacgaaacuguguccuuugcuaauuuuucuaaagagaacuuaacaaaaacuuauauguauuaguucuauugcugcauaacaaaugaccucaaguguaguggcuuuaaacaauagaaauuuaucaucucaguuucuguagaacagaaaucuggcaugguguggcuguaaucuuugcucagggcuaaaaucaaggugucagcugggguugcaauucucacuuggggcugggaucuucuuccaagcucacuuguuguuggcaggguucauuuccuucuccuacuuucuauucauuaaguuauuuucuuuuucugugaauuaggaaaagacacacuucuauucuauucaccuuuaguaguugaauaccuaugcucugcaggcuugacauuugagaaccagugaacuagauuaauuuuaagaaccuucuagguauaauauuuucaguuuguuagcuauguggccaucuuuuuacaauagaaacccaaccuuaacugaauuggugguccuucaggggaacuccuacaauuaacaaugucaaagagacauuuuuuuaaauagagaguuaacauuucuuuugcuuguuacugcauguugaaauacuuuuuuaaauugucaagugcuccauaaacauuagcucuuauuggcauguauauuuugggggagcagugugcagucuuucucucaucgccuuucaggauuuugccugucucuggaauuagaaaugucaacagcagagauaucaauaaugauaacaaccuuucacaaguguguucuguggaacucuagcccuggaaaguauuuucuugagcaaagcauuccacgauaaucaaguuugggaaacaucacauuuccacaccccucugaaaagucauaggcauaugaaaaguucuucaguaaaaaauuuguuucaauuaguagagcaaguuuuccuugaccauggaaugagcaugcugugggcaaugcugacuuaugugucucccucccuucauuggucagguuaagcagaguugagugggucaucuaaacccugggugaugauuaagagcucaaaguccuggguucugguguccuagagcaaaucaccuaaccugucuaggaugcuaauucacccuugguaaaauggugauggggacuuaauuacacauuuuaaagccucaguucuaacauuauggcauucuaucauuuacuuuauuauaaaaguauaaaggaaaaaaguucucauaaacacaaccuugccaaaaauaaaauaauaacgaaaaccauagcaaaaccaaaaaauaaaaaucaccugcuggaccucucaggagcaauuggaucaugagaaucuuuacucaugaauuuuugcuuagucacauagcguaaacacauguaccuaugggcauauaguuugugaugaucugucuaaaugacagucagguguauguuccuauaugucagacccacaaaguuggugguaaugugcaaagaaaaaggagaaaagaaguuugacuggauagacacagucaugauggagaaggagaaaacuagacauguggaaaggaaagagcugagagcauugaaugacuuggggcuaaaaggcagcccuuguucauucaugaggauaggaauaacauuaugaacgguaugguuuagaccaguugcuuaggcuguaguggacagauggaucagaagagagaauugccacaaaaacugggacugaggccuugacaacaacauggugggaagagauggacagugccagguugaugucuagagaaauguagaggaaggguuauuggaacaugaugacucauaaggucugauuguugagggagaggaagaaccagugggaacaccuggguggagaucucagaugagggaugugguacaguugaugauacggggagggggugugugugcagaaauagugauuuagagguaaagugaaaguuuuaccucuaaauuuuacuacauguauugagaucuggaggggcuaugaggcagacaaauggagcuggccaggcaagcacaugggaagugggacugagaaaaucacaguugcuuugcauauuagaaauauguguguuacaugcuaaucuuauuuacucaugcacuauugcacugggcagguaccucuguacuccauuuaacauaacuucuaacuuguuugaggguaaauuuauuaguguuucaaaacaucugacauuuauacugcuuuucuagccccauucuauuucucuuuuagugaauguagugagugguugcuauuucaacccaagcacuugguguucacgucuugcuuguuccuugguggcuucuguuuguuaguuucuauuguggcuuuugaagaagguaccuggguuugauuaaauuuguuacacccuucaauuauaucaaauuauaguggaaguguuuuuuguguuuuuuguuugcugucuuaaaaaggcagcagaaaacaauauccacauggacaggucuuuaacuugcaugauuuugauggcaugugguauguaggucaggauuaggugaugugagaggcaguguggcuuuuaauuaaggcuugcuacaugcuggucuuggucaaguuuuuuuuuuuugucuaagcuucugcucuuuaagcuguguaauggaaauacucaugcuacuuauuucauuauguguucuaagacuucagugaggugauacauggauacuguacuaaaggcacacaguucuugguaccaaguaaguauucaauacauuaggaauacuauuuuuauuauuauuggaaauggaauuaugugaggccuacaacugauagaacugguuagaaauuuuaauuuauauagaaaagaauaaagguaugaaaaauaaaagaguaugggaaacaagauuagcuugcuguaaaugucuguuucuuaguuuugugagcuuggcaagacuuuacuucccugugccuugaaugaguacucguguggcuugccuuacaagaaaauugcaaggauuagugaauuuauauugaacuccuagacucucugauugcaaaguaggaaauauuuuuugcagcugugauacauuaacguuagcaugaacccaggcacaauuacuggacuuagacauuauuuaacuuuuuuuuuuuuuuuuugagacagucucacucugucacucaggcuagauagagugcaguggugugaucaaagcucacugcagccucaaccucccaggcucaaguaguccuccuaccucaucuucccaaguagcugggacuacaggcgcaugucaccacacccagcuaauuuuuguauuuuuuguagagaugggguuuugccauguugcccagccuggucucaaacuccugggcucaaugaucauccacccgccucggccucccaaaaugcugggauuacaggugugagccaccacgcccagccugcccuuauuuaacuuaugaaaccuuucagcauuucuuagucuccguacugagacuaagcagguacuguacugccucccagggguucagcgaggaggaaacuguggggcaagggcacuggaugcucugcaugucagguuucaagcaaaaccugcuuuuugguuguauuuuguuucuuccugaucagagagaacuuuccacaaaacuuccuucucacuuagacaaagcucaggaaaccaguuguguaagauuauaacaggauguacugcaacugaaacucuucuauuggagauguaaagauuagcuuaagcaggugaucaacugacaguuccccaggaguccauggaaaugggaaagacaauagcaaacccauacuaugaaucuguggauggggacugaaauguucuaagggcuaggcccuuaaggaagguguccaggacaaaugagaacuccuugauggcuuuucauuaacauuacaccaagcaauagccagacuuucuuaugaugugcauaccauuagccaaagagaaacugacuuuuguacuuacaugaucaagaagauaaugcacugucuagguguggcucaugccuauagucccagcacuuuaggaggcugaggcaagaggaugacuugucaggccaggaguucaagaccagccugggcaacacagagcaaccuugucuuuacuaaaaaaggaauuaaaaaaaaaaaaagaaguuaauccuuaggauuuucugucuaccuuuuguucaggcaaauaaggaagugaaaguuuuauccaauauauuuaaauuguagcacacugaaagcucaagugcaaaaacuaguuuuugcuguuacaugccucuuauaacaccauuuggagggacagcucaugggaggagucagcaaccugaguuagaccaaaaacuccugagccaaacugccugagauugaauccaggcuugaccucuuccaacuacaugccguugggcaaguuucuugaccuuugugucucaguuuccaaaucuuuaaaauggcagaauagcaguaucuaucucagaguuauaaggauuaaaagaauuaauaaauguauaauguuaagaacaauacuugauguacauaguaagcacuagauaugaguuagcuacuauuauuuugauagguuggugguuaaaacuguugguacuggacucagauggcuugaauuuguguccuagcucucuuacuugugagcugacuucacacaguuaucuaacuucuuagucuuuauauuugcuaaaugguuagacuccuuccuucuuguuuuuuuucauuuuuggaggugagaucucaugaaguugcccagauuggagugcaguggcuauucacagaugugaucagagugcacuacaggcucaaacuccugggcucaagcaauccuccugccucaaucucccaaguagcaguccacucugcccagcucaaaugauuagacuuuuugugccuauuuuauuggacuuaugugagaauuaaaugagaauuugcagagcacuucauaauucacaccaugucugguauauauuaaacacucaauaaguguuaguuauugguuucuugguuuuguuuuuuuuuuuguuuuguuuuguuuuuuuuuuuagaucucagagagaaugcaauuagcccucaagcagaauguuggaaaaucugagaguaauaucuuuugggggcuuaucuccaccuucaguugcuggaagauuguucccagauuuguaugcuugccacugaaugacauagucaacuguugucuuucugaguucacccuccagaccaugauguucuauagcagaucuuggcaacacaucagguuccgggaaaguacaugaaucaugaugggacucuuuaaucuguaccucugaacuucauaaaaaacaugugauucuauuagcagaucccuagcuaaguuccaucuucccugcuguucucacauccuuucaucuccucucuuuacccacuggcacucaccuuccauugccuucucaacucuucgcuggucuccauguccaagccucccuuccuguugucuuugauccaauccccaauccuuucccaccuggacuccucucccacaugcucccuuccuaaugccucuucuucccauucuucagaacaccuccuaugcuaugcgcaagcucuguguacuucugccucacucaccacucucccuccuacucuuuuccuuuauggugguuuuguuuuuaacugaagacaucacauacucugcuguauucccauguggaagucccaccuucuucugugggaaaggggggaauuuuacuuucucgucgcucuguucugagaguggaugauugaacugccacuuucucccugacucucaugggauguucaugucaucuuccaaggcccuugcuaucgcauugccacaucucguuuccaccauccuagauggaauauugacaacagagccuggcacauaguaggcauucuaauaugugccacgugaacauaauaaaugagcgagugaauaauugauucuuccuaaaagguuuuagcaacugccacacugcuuuuugccuauccuaagcacauuuucuuguccuuauuuauugauucacugaauagacaucuguagagaugcuagguguggcuugccacugggaguacaguggcaaacacgaugugguucuucucuuggagcaugccauuuagugaggggaagauauauuacauacauaaauuaauuacaguugugagaaguguuugaagaaaaaagugcaggauuuuaugcggccuaaccuacgggcgaugaggguagccagugagggcuuuuauuagggagugagguucaaaucuguacuugggaggcaauaguaauuaguuaaagucaaggaggguggagaagaaggaagaguaaagaguuuuucaggcagagcauguugcacguacaaaggcccugaggagugaaggagcaugguacacauugaaggggcugaaaaaagaccagacacgcaggagcaggaguagggggagugggugaggguacugagagguggacuggggucaggucuaggggcuucagcacucauuuuguuaaccuugauauuucuuaacaucauggcuauccacuguguacaaaggauuuuugcccuccauguuuuuacacauuauuuauuucuaucccuguaaaagcucuuugucuuaucuucaacucaagagugaucacaauggugaguuuggaaacaaauuagucauaauaagucaggcuaguuggacaauuaagagcgugagcuuuguucagacgugguggcucaggcuuguaaucuagcacuuugggaggcugagguagguggaucacuugagcccaggauuucaagaccagcccaggcaacauggcaaaacccugucucuacaaaaaauuagcugggcauaguggugcacacuguagucccaacuacucaggaggcugaggugggagaaucacuugaucacaggagguagagguugcagugagccgagauuguaccacugcacuucagccugggugacagagugagacucugucucaaaaaaauaauaaaagaaagaccaugagccuuacaaaggcaaagcuggguuucaggucccagccucgucaccuugcugcuaggugauccugggcaaguuugaccucucugagcuuucauccgaaaaugaggacaauaaucuuuaccauguggauuuguuaagauuaaauaaacaaaugugguaaaagugcugaguacagaaccuggguugcaugaauuguucauuacauggcugugcuuguugagggucagggagcauucagagucccugugcaguaagaaacagaguagcccaagcccuuuuucagcugugucccaccuuuuccuggcagagcccugagcaauaacuggggugggaguucagguuuauugauguuuuauucugugacugcuuucuuaggguaugagccaaaaacuuuuucucauucuuuguucuaaacucaagaguauuuggcaccagguuuaguccuagccucuguuucucacuugcuccuuagggaaacuaucuguuuuuccucuguuagcuugugucugccuccuccuauuuuuauugucucuggcucucacaucaccuaagccugacuccccauauuuuuauuucccaccccagcuucucacccaacuccugccuucacccguccuggauucuggaccuuugucuucccuggucacuggaaccugauugucuuuguuucaacuguccaccaauuuggucccagacucuuggauugcacuggauuggugauaccauuuauuccuuuuccucccuuugaccucucggcucuggggccauagcucauguaugacacuugcucuauggagaaacuuaaaccuuguuuuccaagcuuagacccagaaucauggccaaucuucucuuggccuuaugugcugugugcaaaaccuuaugcuguugcugcuuuuauuucuuccuggaugagaaagacaugacccguggauuaucaucaugaauucuacaggccucacucuguuguacuuuagucagaucgcaggcaugaggcuuauugcaucauauuugccuacccccauaaaauuaugaaaucucuggagacagcaguuguccuuaauuaucucugugucuccaguauuuuguucagggccuguuauacaaaagaaggccuuuaauuaauguuuucaguauuaauuggaaauugacacucugccagaaaaggucaacccacagcgucagggaggaguaggaccauuggcuguuagagggcagcagggaccuuggaauaauuccagaaaugguaucucagccucaaguuauuugggggaaugucccauggccauuugacagagucagugagguggccaaccucucugcuuggggaagacuuucuagauaaccauuaaggcacaaaaauugcuguguuaauagccuuucccccuccuuuaaccuguaaaagauaagucuguguuugcuuugucaguguccucucuuuaaagaggcaguauuuuggcuagcugagagagagaagcuaaguucaucuauaaaacaaucuauacucucagggggaggagaagaggcacaaaaaucacaaagaucuauguggagacagcaaacuuuggggaggucauuuugcagaagaguguucugcagcagcuaaaggauaaaaggaauuggagaggaaagggaaagggugaaugggccccucugauauucucuaacaaaagcaaauaaaagauuuagcuugugaauuagcuuucucugucuuuuucauuguucugucccuugcaucaggcacaaugcuuggcacauagauagcucucaguuaauauuuauucaauuaauuccuuaaauaauauuuguggcuguuggaauuguauccuucaacaaaugaugcugcccagacuacaagaccuauagucacacaauucacaguguuauggggcuuggagcacgaucuuuugagacccuaacucugguaugguggagguauuaauggagaggcagggagacauguaccaacucacucccaacuucacagugaaguggccaugcccuucugugcguuaguucaggaccaaggacagcauuccuuggacgcucccccucacauuuuaaugcacuauucccaugcuugcgugugauuucaacauccugggccccuugucuuuccauuacaccugcucugcaacuucccgacugggaucaaucuaauacugacuucuccacuucuagauauagacggcuaaguacugcuggagagaaaugacaaagcuaaacuuuuggaugacacacaauuucaugguuuguuaucucagcuccaccaagcaguccuaaaaugucccuuguagucacucuuuaucccauacccacaaugguauuccaaaccugcaucacuccagcuauucgcacguuugccuuccuguucugucuccauauaugacuuugucuccuauuuccagggggaauugagguuacaaagugugaauuccuucaacuuccuuuuuacacucacuuugcuuucuuuguucacccuuaaaggaaaaggugucccuuggccucuucaaaacaaaaccccuaucucugcuucugauuuuccuccccaacccucagguccucuaggaccagacccuguuaccucagauauucucuccuucuucuugaucucugcuggaucuuccuaacauacugguuagugacccggacaaccaugagacucugucauaaucacaaggacuucuuauuuaaauauagagauuuggguacccuguuucuagcugacugaaucagaguuuuuggaggugggcccuggaaucuacauauuuaaccaggauuccugguucagaaagcaccauuaaaagcucugccuuuacucuugcugcccccaaacauccugaacccaggagccagaaagaccucuucauaaugcaaaucugaucaucucauucauuccuuguuaaaagccagaguuuuuguuuccuuuaaauaagucagguucaaggcaggauacacauggcacaucaaacuggacaauaugaagagaguuuaaugcuggugauauuuacaaaaguguggcaggaugugggacacaaauaaggccugagcaacaccccagggcuaacagcaaagggccugaagggggaagaggagggagcaauuacuugugcaaugaaagagggcugcuuggccagaugugaaauuaguggaaagagucaucuagccugcagcaaguggcaggaaaguacagaguaaaagaaauacuccuucuuccucugcuuccuccuucugaaccuggguuagugcuggccuuuggaugaggauaagggagacugguacaguguuuacaggccagccuccagcauccagagcuuggagcagguggagaagggaggaguaugggucuuggggaaggggaacaugcaaacagaaguuacauagcaugguuucuaaccagcacuccuaagauaggggcugaacccccaugguggcacauaauguccucuuccagcaggcuuuguccuccugccuugcacccuccccuguaaccucuaugcagacuggcagaaguggggcucugccagucccagguuguuuaauugcucacaucugucccaucucuuugcucaugcagucaccuaugucugaaaugcccacucugcuuuuguucaccuaaaaacucccaaacuuccugcaaaaguaagcccaagugacaccaucucaaugaagccccucuuuagccuucucagcaauagaauugaccacugcuucuuucgugcucccaucauacuccacgcuucuccaccauuguaauaguacaguugacccucuguuaugcauccucggauucaagcaaucacaaauagaaaauauucgggggaaaaauaacaauucaacaauaaauaauacaaauaaaacaaugcaacauaacuauuuacauaaaauuugcauuguauuggauauuauaaguaaucuagagaugauuuaugcuauacaagaggauguguguggauuuuugcaaauagccauuuuauauaaggaacuuaagcauguggauuuggguaucugagggggucccggaaccaaugucccauggauaccgaggaaugacuguauuaacauguauggaaugcuuacuauaugccuggcacugagaaguuugcauguguuaacuaauuaaguccucauaauaacuauauuauccccauuuuacaggugaggaaacugaggcgcagagugguuaaguaaguuucacuggauuaccaagcuaauaauuaguagagacaggauguagagccaggcagucugcuuaacaacacugccauaaagcuuuauggcacuaguaccacucgacuguauuaauuuguuacaugccuaucuuccucuacucgaccacaaacucaccaaggacaggacgguauuuuauuuaccucuuauucacuacccucuugcccugccccugugcuuagcacagcuuggcaaauagggaguauucaauagaugaaugagggaaaugaaugaggagugaaagaaaaggaauccuuuacaaacauuccuucuuuaugguugagaaggcugcaacucagagaagcuaaauaauuugcccuaaguccuagccuaugcuauaauuucaguccaggucuuccucacuacaauacaucuuuuugcccaccauaucaggcugcuuucaaaaggaacacaaaauuuuaaugcuauacaguuguccccaaauaaaaaauauggcaagcuggcaaaauauagguucaauucauggaauugaggucaagauccaaagcagaaacucuaccgagggaccaggcauggugguucaugccuguaauuccagcacuuugagaggcugaagcaggcagaucacuugaggucaggaguucaagaccagccuggccaacauagugaaaacccaucucuauuaaaaauacaugcacacacacacaaaaauaaccaggagugguggcacaugccuguaguccgagcuacuccggagccugaggcaggagaaucacuugaacuugggaggcagaaguugcagugagccgagaacacaccacugcacuccagccugggcaacagagugagacucugucuaaaaacaaacaaacaaacaaacaaacaaauaaacagacuagagauauggaacagaaagaaaguucuaggucagaauucagguuaauauccaaagaguugggauuuaagaaccacaguucuggaagcagaggacagacauuugaauagcggauuauuuugacagcaucugagacaauccccucuuuuugaagcuaucacuugagcaaacagaggguggucaggauuuaaggagugcgucuucugaggagcgggguggagucuaaccaaagccaggucuauaggacagcucucugggggcuccaguuccguuauuggaaauaaaguaccaguuaacucagagcucaacuggcaacuccuaaaaugaauagggaaagaggaauuucuccuuucuuauauaagccuccuuccuucaauuaaaaacuguuuuaaagcgugcuuaucaagguuggcuagucuccaaggagugagguaaugugcuguacccuacagccacaggcauauaccagccaauggucagcugucacuaugagguacugucagccaauuuuaaaauggaaaaaugcaugccaugauaaugacuuaucuucuuaucuaaauuuuaaacaguuaagaugccuggcuuggaauaguaauguaugcaaucaaucaauaaucccuuauuuuuaaacauaaagaaggaggcauacauuuucuuauuaauagaggaucaguuuuuauccuugccccccaacaaguaaauguucagcauauauguuaagaacauuaguguaagggguccccaaauaucugcuauuccacucacugaacccaccccucucugcuaauggcuccauccuaaggaggaagagaugggcuucccucucuuucccaggaaugcugaucccccagcacaggcuaguuuguucuuccuagugccucucagcuggccccuucucucuuuccuuuauuacuuucucagucuagacucuaauuguucaguuacugggucaauugccuucaaggcauuuucagcauggagauacgcuuuuugagcaaaacuuccaagccuguccacaauuugaugccucuauacauugaacacuuuucuugacuauuccugcuauucacuuuaauugggggaaguuuccaccaugguucuuacagacagaagaucuggguucauuguuuauucuauaccuucaagccaugucuccccagcuucuaucuuuucccuacauacaggcucaauucccauaucucuuuuuucuucaaauccuccccaucuuaggacccucuuuugcuaugaagcuuuccuuggcuguacuggccaacauuaauccgcuucuccugauggcgaccuuguacaugccaggcaccgugcuagacacuucauacccaaccgcaugcuuaaucuugccaacaaaucugggaggagagcuuccccuuucacagaagaacaaagugaaguucaggaaggcuaagcagcuugcucaagaccugauagauaguaagugcugcggcugagcccugauccuggaguuacugugaaauuaaccccuauuccaccaagacguagucauccagcuugggccugacccaugcacggaccagaagggcuggaaggaguguccugcucacauccugcuuccgugucccucucacaccauccuggcuaggaauaguuuccuccaaaccagaggcaucacugaagcucuucaucuuuuuuucuccucugggaagaggaguucauuaccucacuucuuacuccccgcacauuccaccucaggcugacuuuccugaaauauaugcacacaucuuaagccuccuuuacucucuuucugccuuugucuaguuacauagaaagucuuccucggguuuugucuguguguguguguuugguuuucguuuuuuuuuuuuuuuuuuuuugagucacucucacucuguggcccaggcuggagugcaguggugcaaucauaguucacugcagccuugaacuccugggcucaagugauccucccgcuacucauccuccccaguaucugggacuacaggugcaugccaccaugcccagcuaauauuuuuuuaauuuguagagaugagcucuuucuguguugcccacgcugguuucaaacuccuggccucaagugauucucccaccucagccuccaaaagugcuaggaauacaggggugaaccacugugccuagccuuccuauuucuuucccccucagugcuccccucccccucuauuuguuaucacucuuauuuggcccuguccucucucuuaguauuaacucuuaucuucccauuuuugucucuuuuaacguuucucuuucauuucauugcauugaggagcugaaaaacccuggaugguguuugaguaagagcugugcuccagggcacuguucaggagguccagcaucauucugccugcauuuggcucccaguucugccaguuucuuaccuuaggcaaauggcuaaaacucuuucugauuuuccucaucuauaaaaugugcaugagagaaguuacugaggcugaaaugauacuccuuuaauguuugucuguuguuauuguuugcauuugaauuugaauguucuuggacagggcccauagucucuacucuuuaccuuuccuauuuccaccacuuugccugaauuacccauuucuuucuuucuuucuuucuuuuuuguuuuuuuuguuuuuuuagauggagucucgcucugucacccaggccggagugcaguggggcgaucucagcucacugcaagcucugccucccagguucacgccauucuccugcaucagccuccugagcaacugggacuacaggcacccgccaccaugccuggcuaaguuuuuuguauuuuuaauagagacgggauuucaccauguuagccaggauggucucaaucuccugaccuugugaucugccugccuuggccucccaaagugcugggauuacaggcuacccauuucuuuuauuugcuuggcuccuauagauauuugacuuugugaccuauacagacgaaagcauaggaacucuucagaaugucucuuucaaauugucauuuauuucuuuauucuccuacaaauagaccaguuuauuuucaagcaucaauagugauacuuacuuauuuuuuguuauguuucaucccuagaauuucaauaagaguuuucugucuucauuucuuauguaaugaagaggguuagaugagucugacccaaugucaccagguggccuuccucuuugagcucucaccagaagugucuacucacccacacagaugcacuggugagcaauguggagaucgcugaagagcccauggugcugaugggggagaggguguacaccuucccucucaguagcagcuugggccccuccucuagcauuuccagcugcagagccucuuuugucagggagcacaggguguuuucuuucccucucugccccccacuuccuaccccagggcacaccaguuauccuggcuccugucuucauccuuccauauccaguuucccaccccaaacuuccagcauuuucuaggaguguaacugcuccccccaccaccccacccaccaaccccaggcaguucaugaucguuucuuuuuaaaugaacauucuggcacauacauuguuuuuccccaugucauuacuuagauuuuuauagacuagcauaguauacuaaucagcauuuauauuaccuuuuccaugagcaaacauguuuugaauuccaaguaaccaacuuacuuuauaaacuucuaaauguuaugucuaaaguuauauggugcucagugaggacuggaaauugucaggaauggcuucauggaaaguggggcuugaguuagaccuagaggggucuguagaaggaggucagacagggaaauauuccagguggaagggugaagauacggaagcagaauugagagaagacaguuaaaaccaguauggagaagacagcauuuuaugauucaauaaauagaagccaaucgaucaauuuaguucauuuccucuucccuuccacuuuaggguuuuaagucaggaauggcaauacugggcacaugugcuaccuccagcccacugcacccauggcagaugcuacuaaucaugacacuuguuuuucaugaauuuguuaccaaaacaccagagguuugguuuagguccuacugcuccccacacagaaugccaaucaccaagucagcaagcauugccagggaagaaggcuuuaaucggugcugcaaccaaggagaugggagaugagguuucaaauccagcuccuggacugacaaaaauuaggguguuuauauagcacagaaggcgggaaaacaggaauuagggaauuaaucaugaucaaugagggauuugauaucucacugucugguuguggugaucuauugaguuucagucccuugucugagggucaguuccugaggaaggcacucaguuaagacaaauacaaguuucaaguguuaagauggagggccaauuuuuauguuuauucagugacccauaaauaucauuucuaugggaaaacugggucaguuucaaguucagacagggccuaaaauuuuuuucauaauguaucauaccaagcaguucuuuuuuuuuuuuuuuuuuuucuuguagacagagucucccucuguagccaggcuggagugcaguggcucaaacauggaucacugcagcuucgaacuccugagcucaagugauacucccaacaucagccuccugaguagcugggaccacagauguacaccaccacaccuggcuaauuucuauuuuucauuuuuauuuuuuguagagacagggucucccuauguugcccaggcuggucucaaacuccugagcucaagcuauccuccaaagugguuggaccauaggugugagccauaacacagggcccaucccaaacaguucuaccaguugaucagaguuggcaugcaaugugaaauccauuuucuauucauguccugaguuuaguaaaucuggugauuuuuaucucuaaauggaacugcuuuaugaguaucuuuauuaaguccaaaauguaaacagccauuuagaacaacauuaauauaauuacucaaaugcuuuacgauacuaucuugccagaacauagauuucauagugauaaaccaaaacccacuuaacuaaugcuuaaauauauuuccuuuuaaaaggugucauuggucuaguuacuaaugauauuaauugcuuuauuuccucagaucccaauuuugcauugauccauuuuccagggcuuaguauugauuuuuuaaagaauaacuuguauaauauuaagugagacagccauaucaaucaauuauaguccucuccucaacuggacaauuuaugccuuguaaaugugggucuacacauaauguuuucuacaaugucaguaggauuucaagugccugggguucuguucuugucuuuguggauuccuuucucugccugccuucuuccccuucucuucuuggccuaauuauuaucuuucaagaacuaacacaggaauuaucuuucugugagaucuuucuggaauccccacauucaccaucacaauuaguuucucucuccucucgguucuguagugcuuuguuuuugcaccuuuagcagaauggcuaguuagucagggaugugcccauguccccagcuagacugggagcuccuugagggcagcacgugccuugucaccuucuucuccccuccaucuaauacgaaguagguggcagaugcauccuuuccaaaugauugacaucaauaagacauugaaaaaauauugggcuaguagaauuuuaauuuuguuugaacauguuaauguccauguugguuuacuugagaacacauaauugguguaaaauuaggugacaaauuuguaaauguggauuuagggagucauucacauugaaagauugaauucuacugcugacuucuacugacuaaacugcuggcauucuguucuuuacaguaaaagugacauugggugaaagcauugguaucggugucuagcuguuuugagcugaggcuaccuuuguuugaaugaagggaauauuuggaucaucugacuggaaauauguaugucaugagacaaguaugcuggcacuucuguuaugacaacagaugauauccucuuccugagugaacugggaaaggcagggaguuuggggagaccugcagcaugaccugggucacauucagaaugcguucugcuguucagaguuuccuugcucuugaguaucacccuuugccucaguuuuucagauggaaaauggguggaagucaguggaauuauuguguaauaaaaacagcuaaugcuuauuuccuaugcaucaaguaccaugcugaauacaugaguucauuuaauccugacaacagcccugugagguguuaccauuaggaugccuacuuuacaggagaggaaauggcaccuuggagagguuaagugaugugcucaaggccaaauccuagucaauggaaaagucugagacccaaauucaagucuuuuugaccauuggcccuguguguguguuugugugugugugcgugcguguguguguguguguguguguuaccuccaugcuaagcugcuucugcgguagcucuagagagccucauaaaagagcuaaauaaauaaaagggguacgggauauccuuauuagagagaagaguguuuaguaggagguuauuaucuguuuucuugagagaauuccuggcuuagaguaaagacagauguuauaaaaacuguacccugguugauuugauugacaccucaagauguuuugaaucuaguuacacuuacauuacugucaggugauuucugagauguugcuuuguugcaguacaaguucagaggacaaaggucuuccaggguuggaggggucagugugaauggagcauuggagguugugccgccuuuucugagcugugcaugguugucuuuuuuccuaccaguagguggaaauagaacugaaucuuucagcacuugcucuuucagcugaauccuggcaggauuccuuuaauuucugccaugaaggaaaaaaauaaaaaaccucaggagaauuuuggaguguacaguuggaggacuguuauucugcagacuggaauacuuccagucugauggucagauaaugauuucagccuccuagaaggccagggugcuggaagcagcugcuggcagccgugggugucccaugagcucugcuggacacccaccuugaggggggcuuuuccuauccugaccacacauccuuuuacaagacuccucccgucccacccguuuaaaccuuugucuuuacugugaaguuguguaucauguuuauuuucagaaacugcauuucugaaauuaaaaucuaccaagcugaaacagcacauaaguggauaaaguacaagaggaaagccucccacccacaguucccucacuuucucauuguauuaacuguuuuuugcauaccuauccagacuuuuucuauaacauaaacaauuauauaucucaucgaaauaaaacaggcauuauguaacaaguguuguucuuugcuuugugcacuuaugaguguaucagggcugccuaugaaugugauucgcucugguguuucccaguugggggcaguuuggcccccgaggugacacuuggcaaugucuggagacauuuucaguugucaacaacuggggugacgggaugcuacuggcaucuaauggguaguggccagagauguugcuaaauauucuacaaggcacaggacagcaccucacaaagcauuauccagccccuaauauuuaguacugagguugagaaacccuuugcuagguaaccucauucuuugcaauggugcacugaauucuauagugugaauuucucauccuauguuaauguuuuccuacuggcagucacuuaagguuguuuccaacucaucucaccuguaaucccagaccuuugggaggccaaggugagagaaucgcuuaaggcuagcaguuugagaccaguccaggcaacauagugagaccccaagucugccaaaaaaauauaaauaaauaaauuagccgggcaugauggcaugcaucuguaguacuagcuacuccggaggcugaggcgggaggaucacuugagcccaggagucaaggcuacagugaacuaugauugugccacugcacuccagccugggugacagagcaagacacuguuucaaaaaaacaaacaaacaaaaaaacaguguuggaauaaauauugguuuacaucuuugugcacuuugagauuuuguuucugcgagauaaagauacaaaauuaaaauaucugaggauagggacuuuauuuuaaaaguaaaaaguacucuuuuacacccagaaucccuaauuugcuguuccaaaaagcaaaagaccuaaaaacaaaguuuaaaaauucacagcaaacacaggauuugguggcaaaaccuuaguugaacuugugugaggcuagucuuuauuuauuacauuuaaugugaauauuuagacaucuguugcagaaaucuuuauuugauuauggguuacugucucagucucugaugauguaguuacauaauauggcaccuuauugacuuuuuaaaaauaucugaauugaauucuaaagcucuuucagcuuuuuggcaaacauugccaucugauagauuuguuugcauuagaauggcagccucgggaauuuaauauuauagugaugugcagcauuuaguccuuaauaauucuuauauguugaaaugagcagguuguggugacuucagugauuuuguuuucagcaucuauaacccccuuuuaaaggugauuuuaguccuaugaagaaaaauugcauguuuucaggucgcaauucuugccuugugcuuuuccguacaaauuagccccucagaaaacaugaagcauggucuugaaaaucacuuuuugcucauuuuuuuuuuuugagacagagucucgcucugucaccuaggcuggaaugcaguggugcgaucucaacucacugcaaccuccccucccagguucaagcaauucucugccucagccucccaaguagcugggaugacaggcacccaccaccaugcccggauaauuuuuguauuuuuagcagagacgaguuucaccaucuuggccaggcuggucuugaacuccugaccucaugaaccacccaccuuggccucccaaagugcugggauuacaggcgugagccaccauguguggccugcucauucuuuaaaagauuggcaauagcuacaacauuuugcaugcuugcucuguuucaugcuuagcaaacauuaccaaaucugaccuccacaacaauaccucuaggagguagucuuuuugucuuaguuuaucugcagggaaugggcuucuggaaguugaggaugugugcaaaguaacaucugggaagaggcagaacccaaaucugcagcuguaggugcuacaucccuccacgguguaauuagaauucacuuuccccaauguggacagaguuuuaauauuucuauuaaacuguaauuaaauuaauuaaauuguaauugguagccguuacaaaauuuuugagaaaaaaaauagccccaaguugcuuuuucucucaaggggcuacacuuggacuugauggcaaauaggaaaaugucacuugagucaaguggauauuuucaucacaacauuaagagaaagcauuggagcaaaucugaggucacgaagcucucccaccaaagaacuaagcauuauuugaaaugagaaaacauuaauguccucucuggagccuggaauugacaugaaauuagggaaaagcauugaguuauauuuauuucuuuugguuuaaucccaagaugucgguuuucauuaugaaaggggaggggaacaucacacaccagggccugucgugggguggggagcgaggggagggauagcauuaggagaaauaccuaauguagaugacguguuguugggugcagcaaaccaccauggcacguguauaccuauguaacaaaacuguacguucugcacauguaucccagaacuuaaaguauaauuuaaaaaaagaaauuuaauuuaacauaaaaaauuuaaaaacauauuaucuucuauucuuuauagcagagccaguucaagaacccucaggaaaaauucuugcccuaagccaacuggaauuucugacuucugaauuuuuuuaugugacaggcuuagccugggguagaguccaggaaggaugcuucuagguugguuuuuuagcuguugcugacaugauucccuuugcugccuccuagcucucgagguuucuccaaaaagcauaugcaaggaacuuuccuauuccuuccuuggaggaguuuccaauguuccuucuccacuguguccucugcaacucaaucuaccgauuuguuuuaacauuucaaguuuauagcugauuuuacuauugugauggggaaucccaggguaugaacugugugcaggacaguuaacuacuccuguuauuucuuggcuugcuagguuuuuauuguuacuuucagcugucuuucagccuuuuacccaucguccuucaccuuugaugaguucucucugguacuuuggucuuugagaaagaccuaaguacacuccccuuagucccucauuuaaaugcccauucucacagcaccccugaaccuugagaugucuuuagauucugcaugaacaccucacagguccaaacuccucucugccucaggcccuuuguaugugcuagucccucugucugggacacacucuccuagcuaccagccucuuuuuaccugguuguuaacuucaguuuauguucucagggaagccuuccuagaccaccacaccccuucuccuagcuaagaucagcuauuaguugugauucuuucaugagucagucucuaccaugagauuggacaugcuauuagcccagggaccaaguaaaauguuucauuucagugcaaugacuauuugugcagugaaugaacaaaugaggccuguacuucucuggauuccgagucagcuucucugcuuuuagacuuuauuuuccagaccuacauucuuacugaaauauguguguuuccucacaucauucaccuguccuuuucacuggcccccuucaccagccuuuacacuguuuccauuguaggcccagccugcacucucaaaaacagaguuauccaggcacuucuguauucuguuguuucuuaauaucaacagguuguuuuagagauaguuuguuugcuuguguuuauuuauuauggauauuucaagaauacugggaaagcacaaggagcuuaugacaaauagccauguaccacugcccagacuugcagguggaaacauuugcaguauuugcuucaaagaaauaaaauguuacagaaacaguugaagcuccuacucucuccucuccccucagagcuaaccacuguguggacaauugccacaugaauuguuggaacaccucaaaugaaaguaaauaggaaacuugacauuuuggcuagauuaugggaggaaaauguuaucucaaucuuguuuuuuuaaauauuuaacugauuucuaguaaaguugagcauuuuuaauguuuauuggcuaccugggcugcuucuaugaauuacauguuuauaucuuuuuccauuuuaccuauuugccauuuuucuauuuauuuuucuucuugguuuguaaagaucucuguauauuuggauuauucuguugccuguaauauguguuacaaauaccaacuucuaauccauaacuuuucauuuaguuuuguuuauauuaucauguguuguguagaaauuuuaaauuucuuugugaucuaaugaacauuuuucuucaugauuucugcuuuuuauauuuuaggaaauccuuaugcugagauugugaagguauucucaucaaaauguuuuaaauguuuuguuuguuacauuuuaaccuuucauucauuuggaauuuauuuuuguaauuagguagaaaucuauuuuaaccaagcugcaguaugcaguugaguauauuucuuccuuugcuaucuuuauaccacuggcuuguuuuucaugucuuauuacacugccuaguaccucuaguaugauauuaaauagacauguccucaggcauuugcuaaaccuuacuuaacuugauuacacuaauaaucaauaauguaggucuguaucagcuuuauagaugaagugacugaagcuuagaguaguuaaguaaccuuuccagaaucauacagcuaggagguaauuaacagagucuggggucaaaccccagucccaguaacuucagaguccaacugccuauacugccucuuggucucagaugacuugggggaaagguaucccuuuccaccuugccugcuugugcaggcaugaaauuuuauugaagugaugccagagaagcacuuccagugugucugaagaaaacuaauagacuuuguuuaauuuagaccugccaagaguagauuaaagaaccuuauaaguaugaaacaguucuuauuccagauaauauaagcauucacucagguaauauaaucacaucucaguggaacuucagcuauagggaguagaucuucauaguaaauuaacauucugaggaauuaacaaguaacugcaaugccuuccuucccagccucucuccaugaaaaagcugaggcaccuuacaaagaucgaccuaaaacaaggugaaauaagaagaugagaaaauuaggacaaagagaaauaauaugguaaaacagaaaauaauuauugccuuagugucauuggcuagaguuuggccaccacauaauccuaagcuuccuagcaacugaagcaaagaaaaccuauccagcucuacaauucacagugggcacgagaugaaaauagaaugguugcuagggggauacucagcuuuuccugcucccgggacuggagagaagcuugugcuuugguccccagggaggggcccugugcaaucacagggacagcgcuuacagcaucuucucaguggugggagugcaccucaugugacuacauuccccucuacuuuaccucaagcuccuugagggguguguucuucaucauauaucagagcccagcacagugccugagacauaguaggugcucauaauguauuuuugaaugaaugaauguuauuuguaauuucugucaaugaaagccaauggguggauacaagaucaauacacaaaaauuaauaauuuuuuccauacauuagcaaugaaccaucuggaaauaaaauuucuaaaaguuccacuuauaauaucauccaagcaauaaaauaauuaggaguaaauuuaucaaaaaagaugcaagacuuauccacugaaaacuacaggacauuguagaaaaaccaauggcaaacauuugaacaaauucauuaaaagcaauucuaugugaagcaaaaauacagagauuuuuagguauauggcuuucugaugaucugacuugaucaaaagguguaauuuaaaauuuuaagaggaauauuuaaggugaacauaguuuuggcaauucucuaugauuauuucuuuuugcaaccaagcuccugauaagaaggaaucacagagaauuggaguuugcauucucuguuugcauugcaucagauucuuggucaagaaucugaauguugccaauaaagggugcuguuaggaauuaaggugagcccauaacauauguuccguaauugcuuugugaauuggaaagguguguauuggauaaaauaacaucaggguguaugugaaaaauacacugccucaaauguuuagcaguaccuaauuaaagacccuuaagauuacugauuccaauaauuaaucuguauucugauguauaaaggugucggucguuuucaucagcccauuuuuuuggggcccacaacauaugcuuaacaguucccuaaacaacucuauaaaggaggcacuguuaccaucuccuuuuacagaagaggaaacugagggcuagggaagauaagccauuugcccaggguuccacacuagcaugugauagaccagaaccugcacccagacauccauuugcccugcugugcagccccucucauuucuggccuaaagauagccaacagcaguuuccucugauuugcuagaaguauuuuuccuguuagguauagugugugcuuggacuuuggaggcuucauuuugauguugugcucaguaugccacaauuaaagaauuauccuaauuuuaagaucaucuuuccagagagucccucagaacuucaggauaaccaaguacagucugaaugacauuugccaaguguuggccucggaaaauuuauugcuucaacaggggccuguugccaguaaugauuggccgacuuuuuucuugccuagcaaagacuuucauucuguaaagguaacugagaguuuguaguuaagaucuuggacuccagacucaguggacacgguucaaguccuggcuuaauaauagaaccuuccacauaguauuauugggaggauuaaaggaggcuaucacauagggcacuuagcaccauggggugcuuagaaagcuuuuaagaaugguagcugcuaaaacauacaauccuuuaaaguuggacuuuggaguaaggagugcgcuucgacaaccagcaguagcugccagcaguuuagacugagaauggcucugugcagccaagccuccuaaagccaccuggaagcucuccagucuggacuuugaaaauuuaaauauuuuucaaauuuauuuuugaccaaguuuaaagaaaagggauucccacagugugaaaggggcugccauagcuuugccguuuccccuaaggaagggccugagggaagcuucuuuuuguugguggaagaaaugaggggagagggcaagaguuugggguagggaagaacuggacuggaagcugagucugguccucuuuagucugccucuucaggcccccauccccggccaccuauuccucuucuguaaaaccagggcgcuggacuaagaggcccuuccugugccgacauucugugaaaccauaaacgcuugucuugagcuacaguuuaaugugagcccucagggcccuuguaagucugggccauuggaaagaugucuccgcaucuuucaugugagucaagagguggcuuugucuuuuaucuugucugguguccauacaucccagcuuuaaauuccucuuaaaauuuggagccagggaaaaauuucucuugcugcuuaaaucuucacacuguuucugauuggacaaugccaaugauacaccucaggguauuucuguuauuguuucauuugccaagaaucucagagcuaaaugcagugaccagcaauugcggcuuccuucaaacaagucaggucucaaaaucuaucuuaaaacuguauguugcuguuuaauuuuauguacuuuaauggagaagccacaucaaauccauuuguggcauuaaacaggaaaaaucacccaugcagaaugacauaguaaauaaaugcagaaaugaaugaauaccccuccucacugucagcuggcuccuucucugccccuagugaguaugaaauuacaacaacaauaacaaauaaaauguauaaaggaccuacucuggaccagucacuguucuaaguaguuuauguauauuuucucauucaacaaucuuguguuuggggguacuauuauuguauuuauuuaaacaugaggacaggcaggauuuggggggacauuagacccugcaaaauucuuuggcuuuggggguccuagugguagagaggcuuugccccaucugguacuggcuuguuuauguggcuaauuaguaagcuaaccaaagucaaacaaccaagaaaaagacaaggaggaggaggggagaauugaugaccacagaaggcaggaaaacccucucuggcuucugacuauccugagaucuacucugaacuccgguacugacuugaggaaucuguggcgucucagaggcaguccauauuuuggaauguguuuggggguagagcugugcuuggaggagucaucccgaguuccugcagacaggacuguuaggaggccagcugggcugcaggguguuccacauguccauugaggcacccugccuacaccugaugaguuuguagaaacauuccccagcgguugccugacuuccagggcuggcacuaaagggggaacuagucagcccaucugaccaugaguccuaaauaguucccauggaauauucagugcucugcacuuacuucucuuagcacugaaugccagaacggccacuagcaggggcaggaugggaaacuguaguagccugucacgagcaggcugaucauccagggccuggccuggaagacagacuggguaaguauagucuucauuuggccauugugcucaacuggcaaugugcccacagucaauaugcagaugucuagauguggccaaauaauaauacaauuuuaaaaaacaaauaaucgagaauuugcauguucaaaauaucucucagucaacaaauauuuguugagccauccccugugcccaguacaaugccagauccugggggcauggcagcaagcaagcucguuggggaccugcugauugggagcucacagugagcaggcaggcaugugauuauucugcaggcagugacuucuggugugguuaagugcugugcuggggaagcuuugucuuuuggaaucucuuuggguagcucuuuaaucuggagaugguaucauugcucaaaacauuuuuggagcugcccuuuaggaauugccuuuagaacugauuugggucacacaguaaaaucuaucucacuuuuauuuuacggccacacccagcuugugaccaaaaaugguauugcccagcuugacgacccauuuuauuuucuagucuuggcucugauuugcuuguaagccaaaauuacauccacccuuuaaagauggauauuuaugaccacugagcauauuagcaguaauuuggauaauuuugaagcaauuucucacuugccuaagcucccauuguccuuuauaucucuguuguaacacuguccaaucucucuugcagcugaauuaccuccuucugccuguguuuuccccacuagggugggggucuuggaggauaggcccauaugucuacacucucugcagugcccagcacggagcacauguucaaaauguguauuuauuauaauugaauguauggguugaauugaaaggaauccaagaggugucucaggauugcucugaguaacaggagcacuguuggaaugaugggcagcccagugggcucuggaaucucacaggucugccuccagucccuauuuguccccuugaccagcuguguggcccuaugcaaaucauucauucccucagauccuucauuuccucaucuguggaauagagauaauaauacuugccuuacuggggcuauuauaaggacaaguggaauauucacauagugcccuaagcacagugccuaaauggaggugauuaguauucuuguaauauuggagcgaauucuuguuuggaugcauaaauucugauuaaaaaaaaauaacucacccagaagucacauuauuuaaaaucauuugcuggccaaacacaguggcucaugccuguaaucccagcccuuugggaggccaaggcaugaggauuacuugagcccaggaguucgagaccagccugggaaacauagugagacccuguugcuauaaaguuuuuuaaaaaauuagccaggugugguggcuugcaccugugguccuagcuacucaggaggcugaggugggaaaaucacuugagccugggagaucgaggcugcagugagcugugaucacgccacugcacuccagcuuggaugacagagcgagacccugucucaaaaaaaaaaaaaaaaaaaaagaaaaaucauuuaucauagaaaauguauucugcaaggaacccuagagcccaucuaaguccaaccuccuaauuuucuuuuucuuuuguagagagagggucuugcucugacauccaggcuggagugcaguggugugaucacagcuguaaccucaaacuccugggcucaaguuauccuccuaccucagccugucaaguagcggagacuacaggcgcacaccaccaugcccagcuaauuuuaauguuuguagagguggugggggaggggucuuaccauguugcccaggaaggccuugaacuccugaccucaagccauccucccacuucguccucccaaaguguugggauuacaggcaugagccaccaugccuguccccaaccuccuaauauuaaugagauucaaaaagggaaguggacugacuaaagucauugguucaugacagaacugggccaggccagagcucuuuucaugugacguuugauacuuaccccuacauuuggaggugccaccuuccuugcaagggccuugcauuuaggccaggagcucggauacuggcacuucuggacaaugguagccaagaauuuaggauaugcacuuggggagccacagcacaugcuuugcacacccuuuugcagcaacacuuugucccucugcaggguguugagcaugcugcugugguuguguagcucacaaagcuggcauaagcaauacaaacuggugguuaggaagcaugcugacaaaccugguaccauuaccuaauagcuuaccacuacuugaucucucugagcuucaccuucuucaccuguagcauaggaacaauaauggaauccacccuauaggguuguugugaagguuaaaugagauaaugcaugaaagugcuuacacauugccuggcacaggauaaacacuucuuaaaauuuacuauuaugaucaguaauacauccaaaccaaauauucugccucuggcaucuccacuagucucaagcuaaccucuaaucugcaaugaagccuuaccaggucucucuuccaagcaggugcuguugacagacuuuuaccccucccuucacaaacaugaccucucacaucuccuguuucaccccaaccauggaccacaagauccuaaaguaaucaauagcaguugcccaucaauaauagggcuaggaacuccuggguuuucuuguucaucaucaguuauaggaagaaaaauuggccacuggcuuaaacaaauacugucuuucuuaggaguugucuuuacuuugaaggcacuuagacccuugggaggcucugcuauucugcagcauggcaggugcccacauaccuggauggcugccuucuauuauuauucccuugauacuggguucuuugcacauguauacacuuuggguucuauuugcuacccuuuuuuuuaaacuugacuaaaacagugaguaauugggaaguucugaauuucuauuuggaaaacaaauugaugagaucagaaaaauccaaguaauccuaaauuuacagaagccagauuacuaaaacgcaaggacauuuuuuuguaauguagaaaaguuauguuucacagagguuuuugcaaugcccugacucuggaucgcagcccucccucgauucuggguauuacaucauuucauuucagcuaauguaaacacucaucacccugcacguugcaggauuuuucacugugauuugagauugggcuucauucagugggucguggugauuaaugguuucagaaggaagugcagcaggaagagacuuugcaggaauggaagaggugaggcagcuccacgugagauucugcaaagggauuaagauuuggcaccaggcuugguuucugugcagccucuuaggcagagagccccaggagagggaagcaggcugucagcuguggcuuugcacgcucucagcugucuugaagguugguuggcucuucccgcucucugagguacccaauuuuaccuuguuaaaggauggauguggaugcuggaggcuuaaagaagaccagguaaggguucuuguugucuaagaaaucccccaguguucuuaaugcauggaauccuggggacuguuucuuuacuagcaccauugugcaguguuagccaaaauacaauuccucugagacauuuuacaaagaagaucagagaaguuucuuuccuuguuaagaaaguuucuaaaauguuuuaaccuaaaauguuuaacuauagagauacaaauuauuuuucuugcugugcaauucagcuuugagauuuuuuuugcauguuaaucuacaagaucucgauagguauccugagaguuuauuagauguuuguuuucauuccuuuugcaauggccuaugguauauuauguaucaacauuuaaugugaugaaaacgucucacuuauauucuucaggauacucgcuuuugaauaaauugcucuucuuuuugcagauuugguuuguugcuuucuuuuuuaccuuuuggcuuuugugauuauaauacuaguaaggaauauccugaaguaguuauaguuuuuuuucuaagaggaaaaaacuauacucaggaguuaaaugcaaacauuugauagcaucccugauuaaaaugagcuacauguuuuuugguguuucaaauaugcuuuuuaaaaaauuuucaguguaaauguccauaguuuugggaaagguaaugcaguuuaucugaguggucauuuacuuauaaacauuaaaaggauauuagaccuuugauaagauuagcugaagaagaggucauugaaaggaguaguuuucugcucaccaccaacucauuuccaaauucuguugcuuuucuuaaaaaaaaaaaggaguuaaaaauaacccagaauaaaacuugaaaacuguuuuguuucucuguauuuggcuaacuucaucccaaaguacuguguuuaaggaauucaagcuaugaagacuacucuugaaauggcucacauaauucuaucugcgaauuuccauaauccuuuucaagagcauaugauguuuuaugaguguuaggguuaaaaauuucaauuaaguguucauuccuucuacaacccugagagauggauaacaacccucagaaaaauaacaugagaaauuguguccguguccugacgcaggcucauuuuuccuguccaaaguuguguggaaagggggcauuuggcaucucuccuuccuuauggaaggugcggggugucuugguagaagugaaugucuguggucuuugugguagauggauagaugcagggacuccugaucacuuuaauuuauuggaaaucaaauguuuucauuagauguaggggacugugacucuccagcuuugguugagugggacgaggucuaugcacucagugguucuucuuguuuuuguucggugagcccuuucagccuaugucguccuguuuuucuuuuuggaaacagacuggcagcagucucuugcguuuuguguuacuuuaaucuagcauuuuaaccauuguauuuucuuuuagugggauggcuaauaguaagguuggcuugagccucaauuugagaaggugugagaauagcuguaaucuuuaggaaaagaaaaucauuccaagaguuaaaacaugcagacucuuaauugugcuguguccauucuauuuuagaggaaucuagacaagcuauuguuacaaaugcuuuuccucaaauguuuucagaagaccaaaaaauauauauauaauuuuuugucaguguauuacauuauccucauucugucuuuuuucuccuuaucugucauuuuggagagagggaaaauuguucagguaaacaauugaggaacaauugccagaaacaucugggaacagucgccauggauuaucuuuuccuucuuaaugugaucuugaugaagguuuuacuuguuuggucuuuuuauuucuauuaaaaugguaagacaugugcaugguugaaaaaaauucaaacaguacaaaaaggguaaacaaugaaaagccuccuccauggcaucuuaacacucaguucuucccucagcaguaaacaaugcuuuagaucugugcuuuucaaacuuucguaugccuaagcaacaccugcagaguugguuacaacacagcuucugaggcucuuuggggugugaggaguagauugagaggggagagaaagauaacuauaguucauuauauaacuauagucuacaguaccuaagagacagguggaauuugaggauucuagugacagcaggagacagggguauaaagaaaaaaagacuguugaguuucuuaggaauugaaaaugcucuugagauaguuggcaaugaagaguaagaagccagggucaugaaacagaguauuagaguagugaagaaauccaaggagcuucagcauaaaaaugccaucaggagaggcccaguggguggaaauagggaaauagucaauaguuaauggaaaauauagcaauagaaggggguuaugggccaccugacaaggauaaugagauugagcuggaaacuggaauaggacuggccaagcuaaaaaaaaaucaggccaauuagcaauaaugagaguguuuauucacuuguagauuggcaaaauaccucccuggaaugaacuaggacaaaugaucauuuccugugcuaaugauuuuauagcagaaaagaaaaagaaauaccauagaagguacagggaggugucugugugugagccacuguaauuuaauaacccuaagaaauguaagauuaacggucugaugcaaggaacggaaaaccaagauaauguauaccugacgagaauuuuaaaagcaugaauaguaauuaugaaaaauagucaauaaaccucaagaaucuugucaaugaauuuuuuuuaaaaaagguuaacugccaaacaccuuuucagaaacacaaaauaugacaggauucaaaaaaucauuuugagaggcacgggugagaagaacuagguuuuuuucccuaccccaccuucuuuguccaauaaaguaagaagaaacaaccgacgcuaaacacuuucuuuguggcagguauugugugaaauccuuuauguuccuuaauuuauuuugcccuuauagcucuggagguugggaucauaauuauuauuuacagauacagugcaaagagaauugcucaaggaagagcauauuccuucauaaggaagggacaucuuugaaaaaauaggaaguucaguuggaaaaccagagaaacccaccuagaaagcccaguaaaaaaguucacauaauuuaaggagcauucuauaagaaacugacauuaaagcaaaaauaagagagacuuuuauaggaaucgaagugaaggagcaaggcaaagauaaggaagagacuucaauaaggaagagacaucuuugaaaaaaauaggaaguucaguuggaaaaccagagaaacccaccuagaaagcccaguaaaaagguucacacauaauuuaaggagcauucuauaagaaacugacauuaaagcaaaaauaagagagacuuuuauaggaaucaaagugaaggaaccaggcaaagauccagcagaaccuuugcagaugcucagaauacuccuugggcgauagaaaagggagccagcagacacaauaaauuauuugccuuggucuuuucagaaaaauauaucaaaaucaucuuuagaagcagagguacuagaucaaaaaguaguaaaugaacagaauguucuagacugaguugacaaacuggauauggauaaaucacagggacagguuggccuucauccaagaguucuaaaggaauucaagggugaaaucauggagcuguuguuaaaagcaacucauuuuuacuuuugaaagucuagcagcccccuaaaccuugguugccugguaaaauugcccagcuccaucucccugcaguacauuauuuaaacauaaauuauaaucuguauguaaaauguaaaauauaauaaaucaaauaauguuuucaauaacugugauuuugaauucccaaaccaugucaugucacuguuuugaaagucuuugugaacguuucauucuugaaauugcugagaauuaccagccccuuacaaucauguaaaauaagcuuaucauaauucaugugaacucaguagcaaaagcacaaagaaacaaauaggcagugacucaguugcaagaaaguauucaucauacaauguuacuucacuaaagggggaaaagaauccugcagccucagaaacagacagucaguguccauuaauuaaauaaaugccaugugaaggauuugaaaacuaaucagcuuuugaguuccuagcugcacagucccacugcccaauuugccugguggucuggcccugcucccauuuaucucaggccuucuuccauuucuuauggucuugacucugccuaggucugcagcccaggugcucuguucucugcuuuacugcagguggcccuaguuuucuaucacucaugaccugcacucugugucgcagaguagaauagugaugguggucugggaagacaggauuugugcuggguaagacagagagccaaguacaggguuugucagggucaaaagcuagcaguaaaccagagauguggaguggagaugaaggucauucagucauuuaaucgguauuucuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccucgguauuucuuuugagcuccuagaauguaccaggcauuguacgagguauacaaauaugaacaagacagccaccguguuagagagaaacaguaaacaauuacaguagagcagaguuccucaaccuagacacuagguugacauccaauuauuuccuagaggcaaaauugccucuguuugagaaccacugugggagaguaugacaggugcaugaauggagaaagaauaggccauuaugggaguucauagcagggcuuccuaaugcagaccuggaggugaaggaagacugccuagaggaagucauauccugcaagacaucugcagggugaguagcccucacaugaaaguuggaagaggacagucaaggaagggaaugauuagacauggagaccagagggaggaaacccugggucagucauggguaacuacucuuaccagugguggacgcuccuuuuggugccagccuuaucaaucccaagugccagaguuucacacccggcaucugacagcaugcuuucagaggcugugcucaugcacguagcugccacuagaugaggagugaugcugguuuagagauccuuaggcuuaguggucucgggugcaaaaggggaggaaaucgauaucuaauuccauagaaguagaauucucacuaaauuaacugccccuuucaacuccaaugccuauuuuugauuagcuaaaucuaaguucauuugaccaagauuaaaaacuuauuagcaaaaaaacuucuuuucuuacauggcuacuccacaaacuguuuccaacugcugguaacugcagaccauuuuggcaacuguuuagcaaagaauacauuguaaucauccuuaaaauaccucccuuuucccucuauuuucuuuauagcuggcuccuuucuagagagagacuggucuguauuucugccagcaaagacccguuggccacauacugggucagccucgggacucaugcaaugacaggcacauucaagaaagaugcacuuugugucuucacaucguaggauccccucugcagcaugccuuuuccuauuggcuccuugauccccuugucccucaggggccuuucaauuucuuucuuucuuucuuucuuucuuucaauuguuuugcuuugguuucgguuuugagacaggaucucucucugucacccaggcuggagugcaguggcacaaucuuggcucacuguaaccuccaccucccagguucaagcgauccucucaccucagccuccugaguagcagggacuacaggcaugcaccacugcaccuggcuaauuuuuguaauuuuuguagaaaugagguuucauuauguuucccaggcuggaaauuucuuaauaacaaugauugacauucagcacuugcugugugucaccagccacagggccgcaugggagaggagagagaggcacuaaaagguaggggaaaagaaaauuaaagccuagcaccauacuagccacuucaaguaagcuauuucccuuaauacucccagaaaacccuuaauggguggugucuuccucacuuuacagaugaggaccaggccugauuuuauacagcuauuaagggguacaggugggauuugagcccuuugucagacccugaagcccauguuccuucuacuucuguguuuggaggaacuauccaggccagugggccuuuuuguggcccagcucccaggccauuaggacaauaucaucaggggucuucaggcuacaaggcagaucuggaguugagggaggcugucaucuucagcuguuauugggggcuucuugugaucuacauacauccuuauuugggccgugacuucauugcccauucccagauugcugagauggcuucaaaagcaaggaccccaguucuccuuacccucacagcugucccacugccuguuccuagggcaguauggaaugauguuaaagauuccagaaccaggauuuagaaaauauggagacuagguaccucuaccuuccacuugcuaacacacucaagacgaagcaacaaauaaaucuguugcuuaucuaacagauuguuuugcaaaaugauaaaccagcuguauuaguccauucucacccugcuaauaaagacauacugaagacuggguaauuuauaaaggaaagagauuuaauugacucacgguucugaagggcuggggaggccucaugaaacuuaaucauagcagaagaggaagcaaacauguccuucaccuggucgcagcaaggagaaguaccaagaaaaagggggaaaagcccuuuauaaaaccaucagaucucgugagaaaucacucacuaucaugagaacagcaugaaggugacugcccccgugauucaauuaccucccaccaggucccucccaagacauguggggauuauagaaauuaaauccccagauuugaguggggacacaaccaaaccauaucaccaaccauaaacccuaccugauugucucaacugauugcccugggcacgaaaucacaugaugguuaugaagacaggcugaaaagaugcacaacuuaccaucguaaagagauacugugucaacaauaaaggggaaaaauuccuuauugaauuugcuuauaggagagacauguuugcugagcagagggaugaaggugacuccauaagaaggugaguucuagagagaaacauucauaucagcgagucugacuuccucaugaggcuagcaauuggaauuguaauaaagggaaacuuucuauacuuagguaauaaugacauuuugggcacaagguauuguggcuucuaugaaagaaaguaccaagaaguuuauaacugaaaggaucacacugauuacccaacuaccccucuccuuuaacugaugaugaaacugaggaccagagacauggauggguagaccaaguucauguguagucagagcuaaagcuaaggcuacuugaccuauaaauagagguuuguuuacacuguguguaugggagaagggaaacccuagaauaucuuuuauuuagauuuuacuugaaaauuaucuuuguagggagauuaugucucccuccagaggcucuuaaagauuuggucaucaugcacuggagguaugcuguguugaaaagauuaggaccugugcugaagaaagcaccacacaggcacacaucaagggggaaaaaaugauuuuuuucacagaauuuauucauuaauaaaucuauuccuuuauccaaccaauauuuacugugcacccacaacagugugccaagcaugaugcuaagugccaggauguagaguagacagacaagccuccuucccuuugagcuuccagucuagcugugaccagacuuauucugaaaugauuaaggaagguauccagugagcuaugaaagguaguaaggcggagcuuaaccaugagaacuccugagaggccuauuugagacagggauguaacaaauggguuucaaaaugggugauuccaaguaaaagcauuaagcuugguggucuaguauuuuggaaaguucagcuauuugcacagaaaggaaaaaugucaaaauaagggaacccagcaggagccugcugccaucguccaaguauguggugcugagccuuuagccagagcuggggcagucagaauggagaggaaaugugucaucugagucaugcuccaaaguagcauuggcugccuggccuagggguugaaggagaggaaagagacaaagguggugcugagguuucugaccuacagcaguggacaggcgacagagaugagauuauggagacaguguggauauuuggggaaagugacaaggucagucugaaguagccugauuuggaagggacuggagaaugguccaggugagcuguccucacaacagcugcuuagcccucacuuggauaaguacauuuaggacccuuaggaagagaaugacuuuucaugucgucaaggagacugaacucucguggaagacaaguaguugcagaacaaaauggaagauugcuggggauucaccauuccuuccuuuuuuaacaaaaacuuacuguguaaaauuuuaaacaaacacagaaauacagagaauaguauaaugacccccucuuuacccaucaccuagcuucaacauuuauaaacauugccaauauuguuuuaucaaucuccccucaggaguauuuccccucuaccuugcuggaguauuuaaauccuagauuuuauaucacuucaugcauaaauacuucuuaguauauuuuuaauaaauagagacuucauaaaaaagagaacugcaauauuaucauaccuaaauaaauauuuccgaauuaugauuuaaugacaagccuauauucagacuucccugauugucuuuaaaauggcuuuuaauauuugguuuuuggaacaggaaucagaugagguccaaauauuacauuugacugauaugucuugugaaucuuuucaucucuaauagauuaucucuuuuuauucucucuuuauauacacucuuuacuuacugaagaaucuguggcuauggaccuguacgacauucagcuuucuuuggaacaccuugaguuacuguuugaggcuuacuucuuacgaauacaacaggcauaaaauuguuagguaauucugcaaugaccuaucuuguauuccuucuguuuuaggauucucaguccuccauagcugauacuccucgugguucuagggagcugagugccaggcugugcaagggcagcaaggauuuucuuuacuagagguauauugagagcacagcacgugugaggcugugccaggccaucugggaaaugcaggcaaaguggaagugccuuugcuuggcuccaaggagcuuaucacgaauuuggaagaaagaagauugcaugaaacuaacagauuaacauaggcagcucaguguugggaagucaaguaaagcuacacuuggcucaaaccccaaccuugacucuuaacagcuggguguuggugaacaagucacuuuauauuucugaaccuaauuccucuucuuuaaaauagcgaggaaaaacucugccuacuucaggauuauaugaaaagcaggcaucaugggcccuggaguuagacuuuaaacccugcuuccuucugauauuaagugccugcagucaaugggcacuuuacuccaugccaguccugugcucaguacuucauacacauuaccucauuuuaggccucucagcaacccuguuuuacagaucacaaaacugaggcuuagagaagcaguuugcauacauuuaccuacuuagugaauuaggauuuaaacccagacaaagucaaagcucaaacuuuaaacugccaagauauauuauuucucucgaacacauaugucaagguucaguauucuuguuuauaaggagggagcuaucauaucaacuuuauggaauuaucauggaaauuaagacaaaaccuacucaacagauaacaaaugcucaaaaguauuuguuuucaugguuguuauuauaucaaugguugaacaagucuguaaaacaugaaauuguacagaaccaucuauaaacauaauaggaauguggaaaauggagacauuaacuugcauugaggcccuuauggugagagagggggcagggaggauccagugggucuuugguuaucacaggagauaaaagcacauucuaggaugggggagcagcucaggcagggagacuagaugaaugggguguuaaauacccucuuuaaacuuccuauuuguccaguuaaugccagugaggguuuaauggucagggagaacacacaugugcaccccugaugccauuaagaagacugugugggaaauuacaaaaagagguugugaugaagagccuggugcucugggugggucucagcacaaccucugucugguucuguggucucagcaaguuacuaaacuucuuugcaucucacuuucuuuccagguaaaacagagaucauaaaggacuuuaugauauaggcuauccagggauguuugaggaauuagaugaaauacuuuagggaaagauagugccagaaagacccagggcagaaaccaagagaagccaagaacugaaguccuuccauucucaccucuaugucaccuucccugcuucuauugggguugcagucuucaccacccccucacccucccuaaaucagggguaccacagaguuaggcugcuaaagugacauagugaaaauguucucaaggguucccuccuuucugcagaaacaggacccuggguaauacaugugagaaucaagaggagagagguuggaugugcucaucuaggcugguuacuugcuuuugcuccccaaauuuucuugcguaagaaguuuauucccaauuucuugaaaaauuuagaggagggauauuugguguaaaacaaugaaaucauuggucuuugggauguugacugagucucuucuggggaaagagaaagcagggaaggugaugcagaggugggaauggaagaacuucaguucuugucuucucuugguucuuccccggguccuccugcagauaagagagauuuucaagucacuaacacuuuggugugaguuaauugugucugcucuuccucauacuguaugcagaccacuauggaagauggaugcaacaggaauggccuguuggaagacuggugagcaauaccagcuccggagggcauacaaguuucugcaggggccacaggggaggguucccugucuggaauuggaggcucagauggggcuuccuccaggaagcauuuagagauggagugugacuuagcuguaguuaccacaaagagggaacagcauuuacagaagccuagaagugagagagaggagugaguccaugauggauuugggaccccuguggggagcuauuucugcagauccacaggccccucagagcucuccacagaggaaauauggucauuguuugucagaagcccugccgaggcagcgugaggcuuaugaggaaauggggcaugagacagcaaggcgcuagaaggguacuuccuagccucaccugcgcaccucaccccugugugcacagcacauggcucaccccucggggcuucgguguucucaugaaugaaaugaggacuuaaugaaguccuuucaguuccucagcucuuuggcucucugaaaauauuuuuaaagcugaggaaaaaaaaauaaaguaauacugaaaacagauuucaguccuuauuagguugcaaaauggaaacagagacagaaccugguauugagaaauaauucaaagaagcauuuaagaagagacaucuuugauauugaguagauaaagaauuuauggcaauucuagucuacacugggcuugaguuaccaacaaacaagaaaugaaucaaaggagagacgugaggaagaggagaaaaccccccugagaagcaagugggcauuugaaaacaagugacacaggugaccuccuguccauggggugagcuacucgguaaauacagggccaguggcuggcacaggaagaugugccggagugaugguggcagcaggagugagucagagagccugagcucuuuggaggggcuggcuugccuuuggaggcagagguugugggcacgggaaggauguugcccccugcucuguguggaggcgcugaaggggucuggcccggaaggccauuuguagagcugagugaaugccaccugggcugggcagaacuggcaucucuugugcgguggugggcaugugauaggagacauguacccaggacauguacccagaguugccuggggaccacaggggcuaugggucagaaccacucggaugaguggggcugcagaugggcaggucucugcucagccuauugagaagugagauucugacagggaaucugagaaaggggggcaaauggguuuuuucuccuuggcauuauaacaugagccagaugcauugaaucaggcaucagcauugucacaucaguagcaacaauaagcaucuguucuaugccaagcauuaggcuaugcccauuaucuacauuauucacagaccucacaacaaccugucuagggggcauuguuuuuaauccccauuuugccccauauuccagugagcuucagaaacauugagccuucaaacuagugaauugcagagaugaggaaccacacccaaguguaccaauuucucuuucacgagagagacauagucuaaguuguguuuuccaaucccaagcaguugcaccaaugcugugcucaugguaauguaaaacauaagcaacauugaguauuauuguuuuucaguuuuuacuuuaauaaauauuaaaaugauaccuuuguccccuuuugcauuuuguugauaacuagugaaggugaacaaugugucugccaucugccuccuggguggauugucuucuuggcuuugcccauugcuaggcaacucaugucacacgugaagacaauacauuccaguguguuugagugaccugaccaaggucacacagcugguuaucagagaggccuaggccagaacucaugccagcgccucucccauggcuauccugucugcauccuccacaccccagcccugggcugcacucccaucuccucauccuggugccacgacgggucuuaugagaagcccacccauucccaggggcuauccagcaggaagacagaaugggacaggcggcucuuugaccaaagcaucccaaugugaaauccgucuacaaaaagcccuggaaucucuucugaugaauaauagguaaccacucaggcauaguuuaaaauaguuugguuuguuuugaaauuuuuuaaaaauacaaagaagaaaaacaguggaggaggcagauggcauguuuuaaaagaguucuugcuggagauuuuaaaagccaauauaaaaacuaacuaauaaacugcccaucacaaucuaaagauagauauaccaaaaauuucacuggggcaccuggggacaagaacagcuguuacuaugaaucuacuguuuauuaggcgcugacugucaggugucaugcugaguuucugagucuuccacuuauuccucacaaccaccugauaagacagauacuguuacugucauuaucaccauuuuacagauaggcaaacugaggcuuauuuuuacaagauaaauggcaaagcuagggcuugaaccuugggccugacuccaguguuugugcuguuaauuacugaugcuaccagacacccugagaaagcaucuaagccaggggaguggcagcagcccucuggccuucaagagagcaaucauuguaaaaacagauuaucccagccacuuugaauaauaguucuugauccagaaaaaaagcacgcaaaagaccauuugucaagauccuucucuucuuuuagauuaacaucagugcuauguuucaguuucaguaauugaggcucaagaaauuugcuguacaaaccaccauggcacguguguaccuauguaagaaaacugcauguucugcacauguaccccagaacuuaaaguauaauaaaaaaaaggaagaaagaaauuugcuguaggcaauucuaaguguugagcuaaaaugaagcaaacucaagcaucuugccuccuucuauccuuacccacacggugugugugcaugcacaugcacacacagugcaacucacacaccaaaacagcuaagaauaaaauggguucgaauaacucaagcaaagucauuugaaauuacagacuucaaggcuaguaggcaccaggccaggacauucucauuucgggucuaccaacaaacuaucuccuuuuuaaagagaaaugucauuuugauuucagccauccuugcaggagguuuuucaguguaaauuccucuuagccuuccuaaguaaaaaugaagaacagcugauccuugucuuguccaauguaugauuuucccuggaacuuuuaugagcugaguaggaugagcaagagaggaaguguucuuuaagagagucaaugugcggccacucucagcugcgugguguugccuauagcaacuaagauuuauuuuauaaacacauauaugguccuuacuguacagcaggcacugcucaaaacaguguacaaauaguaacguccucuucacaacccuaugaaggggaaagugaggcagaaaggagcuaauuaacuggcccaaaaucacaucgcuagaguggcaggugggggaucagggcucagguagcuugccuucggugugcauuacucgugguuaguaguguugccaauuucuucugacauagaguugauuaucuucaugcuguuuuucucacacagagauuaagccugaaguucauguaucccaugacccuggggagaaaaagaaaccuaacuacaauaagcaaugggaaaugagucagagccuguuuauuuugaugauugauuuugugagagugauuuguugaaugaaugaaccaaaugaaugauggccuuuugcggcuucuguuugccacuuugauauuccaggauuuauuucuuuugaucuucuaagccaucuaauugaaauacccacaaauucagauauuacgauuuauauuuggccuucagucccccaucugcaucuggcacgguggacucaaguacaguucaccucuugugcauuugaccucucacucuaaaaauaagggccagaugaauguucauauuccuuauagaacagaugaugguuuuacuagacgagugugguuuauacuuuagaacagcagcugcacauauggaaugaaauuaucugaguaaccuauuuucaaaccuugacacauacauuuggcuuaaaauucaacaugcgcuuucucaaaaaggaagcaaauguaaacagucuucucauauauuauccugcacaucugaauccuauguuuuauuuauucguuucucuuuugagucuggaauauaaucaguuggaaaugaggaaggaagccccauucauucgccucuuugugaugccaugaaaaugauagcauguuugagcugauggagggccuuggaaauaaucagaggagacccuuucauuuuauagaaggauucugaggcccagagaagugcaguuugccuggguuccuccaaucaaagguggugaacaugggcuuaaaaccagguugccugacucuaggccaacugaguuggacaguguugagguaaacucugaaaagcugguguuccugcccaccacagcuccccaccugaccccuccagucucagucaacacccagacaccagggaucaccugucaguuaucucagaccagagauaucucuucaggcuucaggccuguacucgcuuuguguauuaggcacuuaucaccacucacccaaacaauacauugacugauagcgccuccccaucguccugaucaucuccccuaaacacacacacacacacaaaacacuuuuaaggcacagacccauuguucucaaaaaguaguguugauuaccuuaauccuuuucuaaaaugcugccauuguccacuucacucacucccacucauguaucccaaucauuuagaaugauguuggcacacugaaagcacucaauaaauauguguugaaugaaugaaaggcuccucauuuccuacuaaagaaauuaaucuccauuucuuagcuugguagucaaggcccuuuaucaucuggcauuaaucuuuucccauuuugcucgcuuccucccuucuguccucugcuaauuaaacaaccaaauagcucuuuuuuaagguaaaaauuuauuguuuaccaauaaauacucaacuuauugaguguuuaugccaagccuuuuuucaccuuuuuaugaguguuaacucguuuaauucacacaacaaaccuauaagguugguacuaucauuauuaccauuuuacaaauaaggcaauugagccacaaguuaaguuaccucucuaugaucacacuuuuaagaugaggcagagcugggauucaaacucaggaaguguggcuucacaucccaugcauguagccacuauggcauggcuagcuuuccuauugguuuauuuuuaguuauaaacuucaacagucuggaaguacauaaaaaguaacaauuuuucacccacuucaaaaagaauuuagauaauauguauucuuccagaugcuuuucuuauguuaacuaguauauuuacauaauuuuaaaaccaaaauuauacauacuacaacaugccuuuuaaauuuacuauauuuuugagauauuuccauaaauauuccuacacauaucucuuacauauaucacagccacauuauuuuucauuguugccuaguauacucuuguauggauacacaccauaauuuauuuuuucagucccuguugaugaacacuucaguuauucccaagauuuuucccuuaggaacaaugcuggagugagcaucuuuauauaucuauguguguaaugcuaaauauuucuguaauucagauuccuaaaaaaugugauugcugagucuugggguauacacacuuaaaacugugauagauacugauaaauggcccccaaaaugcuguccucccacaaauagugucuugcaguuugccaauuuauccucccacaaauagugucuugcaguuugccaugauucccuuuuccucugcacacaaauuugggaauugaaugcuuccuucuuaaccguuccaguccucuccucucugggagcucauauucucugcuugucaugccucuaugccucucuuuuugcacagugaauguauuuuuucuuccccugcugccccauaauaucaaauccuccuuguuaacugacuggugcucguguugucucuuguuucucucucucucucucucucucucucucucucccccuccccucccccccccaacacccuuuucuccuuccccucuccccucugcuuccuugguuauauaaaaccauaguaguuucuuugauacaauauucacaucaaggagucucggaggcuaccuagagaagagugaguucugacuguugcuggcaguggcgacgcuuuauguggugccaauuggguugauguuuguagccucaguauuuggcuguguuguuaaagaugaccccauuugguauccguuauuuagggcacagcagugagugugauuaagaaaggaacaaagaguuacaaaggaaagcaaaacuggagaagagccuuuuaaaugaugacggagaugagaaaaaggaagauaaaggcaagacguugcugaacuccuccuucaugccaccccccuugcuuggugcuuuacauacauuauugcauuuaaucccccagugagaacagacuaaacagauuaggaauggucugucuggaagacaggaggaggaugugagcaaaguuucugaagucauaaauaguucuaguguaaaacuacaaagauaccccaugaaguuacagcagagugaguuuaggacaagagaaagguaguaaguaguacuuccaaauggggcuaguaaacaguggacucuguaaccaaaagugugaaaagauggacaauuuaaauagcuuuuuuuuuuaagguuuuagacaacugcaugguaauacauugcugcuggauuucuaauuggaguuaggaugcuuggagucuuuagacauucacauugaggucaaggagucuaaccguauguacagcccuguaguccaugaagguaucugggggagcagaagagaggacauucagggcuucugucaucucucuuuaaaccagaaucucucuacuucuuaucucuugaaaguucugggcuucuacaugagauuuccuuugugagggacaaaaaaaaguuguuauuuauuuauuuuuuuuaaagucuacaaacgauugcauuaguuguuugacuccacuauuccagacaagccgugggcuggauggacuguggaucuaaccaacgggaggaaauuuuacucauggaccaaggcuccaccauugcuucucucaauuccauagcacaagcuagagucugacagccuuguagcucagcccugaccucagugaggugaggacuuggugaggugagagaaggcaagugcagcagcaagaacugcuccuguuucugaaagaacaucccaguccauugguaaggccucccaaccccauuccacccuaucacaagcaaggugggagcuccccugcagccagugccccaagugccuugccuacugugugccuuugaaggaagagucagggaggccaggagccucagccugagcccuggcucacagguucugugcugucaccgagcuacuuacuucaccccuacucuugccuggucuuucccuugggcugugagucagaagacagugguugaagucucugcuuacucauuuugcagccauaagauucucuagcacucaaccucuuucuaacccaugguuucaucuguguuucuguaacaacuucuacuaaucaggcugcuaggaggacugacuaagauaaugcaaacaaaacacuuuucagggugccugcugcauggcgaagccucaguaaaugguaguauuggugguuguaguugggucauuuuuauacccccuccacccccugcuuccccugcugauaucuugguuccuagcccugugacuuggaagagacuugggcuucugcuaugauaccugcuucugagccaguaauccccaacccugacaucugccugcugccuuccagucccauggcuugccccaucaauacugauuuucuguccuugauuauaccugcagugacaucacaaagcacaauacaucauacacagugauacccaguaacagcccucuuuguauguuacugcauuuaaaaaagaacuuugucucuuaagagcacuucacauaugucguuucauauuugauagacuuccuuuucugcaauugaaauguagaaauaucaaugacuuguccuaaggugcaggcuugcuaguugauauagacaagcagaaacccagguccucugauucccaacuucuuuuuaccauuuccugccaucuuuugaguuuuuguaucuagauauauuggccuuugcuuugauuuauacagacuuguagguuucccugugaaucugggagcaggaugaagguaagaguuuaacuucugcuuugcaguuauacuguagucagcugcuaaaacauaagaauacuaucuagauguuaaugaaaaaaauauuauuuuugaccuauuuuuguuucaaaauguucuggacuuaucucaauaaauagcuguuaagauguuuaucaaauuuauugcauuccccaaaaucuaaauaaauaccugagauaaaaagaaaaugugacccacuugagguuaggaguucgagaccagccuggccaacauagugaaacuucaucuuuacuaaaaauacaaaaauucgccaugcaugguggcacguuccuauaguuccagcuacuugggaggcugaggcaggagaaucgcuugaaccugggaggcagagguugcagugagccaagauugugccacuguacuccagccugggugacagagcgagacucugucucaaaggagaaaauauggccaaaaaauaaaauuaaauacaauaaagcuaaacuuccuuaauaaauggaaaauggcauuaggcuuauaagaaagguauucuacauaaaauauuuugccucugcaaccagcaaauucuaccauauuaaagacauagcaguuuugucucucugugccaaaaaucacaagaacuuuuauucuuguucucaugauccacugcaauguucucuauucagaaagcucugggauguuuuuuuuuuuuuuccuggcuccuuugauguuccucagacaaagacucuugaaguugcagauuuguuguauguuuuuagaccagugcagagaugggguucagaggaacauuucacaugggcuuugauguuagaauccuuuggcaaaucacguuugccuuucaaauugauaucaggaggauagacccuuuccuuuuuuucuuuuuucuuuuuuuuuuuuuuuuuuuuuugagauggagucucgcucugucacccaggcuggagugcaguggugcgaucucugcucacugcaagguccaccuccuggguucaugccauucuccugccucagccucccgacuagcugggacuacaggcaccugccaccacgcccagcuaauuuuuuguauuuuuaguagagacgagguuucaccguguuagccaggauggucucgaucuccugaccucgugauccgccugccucggccucccaaagugcugggauuacagcugugagccaccgugccuggccaaggauagaccuuuucuaaggguugucaaggaaauaaccucaugugcagaaaaaguuuuaugcacaaauauguguaucacaacagcuuuacaauagugaaaacccagaaacaaauuaauaguaauaagagaaugguuacuuacacuguugugaaaucaugaggaggaaucucacauagaauugaaagugaggucuaaagaacuuuauaguaauauggagaaaaacuugguuaauacauuauguagaaaagcagauuauaaauguuguguaauaugacaucacaacuauggaaaacuacacagugguagugguaucacaggugaucuuuugcuuuucuuuauuuuccaguuuuucuguaauaagcaagaauuuugaaaauuggaaugggaaaaggguguuuuacugaaaacagaagcaucauccuucucuguugguaauuuucagcuugauuugguuuguagugcugcagaaagugcuuuugauuucucuagaacaguguuucucaaccucagcuaguugugggagcagcccugugcacuggacaauguuuagcagcaucauuggccucaacgcacaagaugccuguagcaugcccucaguugugacaaacaaaaaugucuccacacauugccaaaugucccugguguggguggucgugauaaaauaacgucugguugagaacugcuguucuagaaucaugcacugauacaucccaaauacccacucccugggagacucagcaagagguggcaguggguauucaguuguacacagcaauggaguauguagaaaucuagaaauucguucacucacucaugagacauuuauuuuccagaaagguguuuggcaucagaaaaauguggcaauaggaagcaggguuccuuccagcugcagggugggauucagugggaggaauucagccccuugcgggcagagguggagugaagaaagggccuggcaagcaacgaggcucacuaggacugagacaccagcaguuuuggucacaaaaggagguggaagccaaauucccagccugagaugggaaugaaagcagaaaugcaguugacuagacauuguggagccugcaccagagaacuaaagcuccuuaaauuccuccugacagggaacaggauuguccucagagccuagggcagcccucagcuugcugguggaaggaauggggacuuggauaaggaguuggaagaguggguggcuagagagccccugcaaggcacugcccacucaguagugauacuuacugugaagggccgugggucuagacugaggcauuuacacuugguucuggaagaaggaaagaagccaaaccaguuuuccuauaggaaagaucucuagaaguggaucaaagaauguacacuuuuugaauuucgauggguaguacucaguugccuuucuaaaugccaguauaaugaucaauggauuggauauuauuuuggcauuuuauagugcuugaauaauaaguuuauuauuuuaaauguuuguagugccgccgaagguuuauaaagguuuauggcugucgcaguuuugcuuucaugaccuguuguugaucguaucuuugauuuaugugaggccuagacaggaacagaaucccuaaucaugaaauuuuuccuaugggaaaauacaucuugcuuuaugacaaucuacuuuaugacgugcuuuccagaaauaauguguggcaaaauguagaggucaucuauaaaguuucuguuuguuuuaucuguugugaauuuccaugauuuuugucccccuuugauggcuaauuuauuuuccauccuguauuagagauacauauuuaauaaaauuuaaaauauucuuuuuuaaaaaugcaugaagcacaaggaaggugaaugggugauuaacaagauagugauucagauugaauauuaaauguaucucauuucaugaaacaaaugcauucaauuagguugaaugauaugaaauuuugauuuuucuaggucaaaaacagucaaauaucagcaauuuuauauggcucaguguaauaguaauguuggcuauaaagaaaauuuuugugaaaugaauauucuguuuuuuauugcuuucuuaaaaauuuugagguucauuucccugaagacagaguugaaaacuuuggcuguguaucaugcugggcauggcuggaauucaacaaauuauucuugcuuugaaugauuguuuccauuggaacaagaguucccaacgaacccuggcugcucauagaaucacuggggaaacuuuaaaagauauaauccauggcuccacacagauaaaucaguacauuggauaugguaugcaguggggcagggcucaggccucaguauuuuuuuguuccccacgugacucuaaggugcagccaguuugagaaccacugcacuagaauuucauuuuaaggagucucaauggagcuuuuguauaccuuagaaaaacacaaugccuuuguuccucaccuacuucucuaucuugcuuuggaccaauaaggucuaaagaugaaaugugaaaaaaauauauuuaacucgaucaacccccugcuuugguuuucauucaacagaacauuuauuggguaccuacuaugugccugguccuagggcuggggacuuugaugaaacagaugaaugcugaguuaaagaagaauuaugccucuuaaagaagccagggauuauaugaaaugucccaaacaggcaaaucuguagcgauggaagguagauuaguggugguugcuuagggcuagugaggaugggaaaguagggagugacuuuaaauggguaugagacuuaacuuggaggugaaaaaaggaccuaaaauugauugugguguaacuauauuaaaaacuauugacuuguguacuuuaaaugaaugaauuguauggaaugugaauuauaucucaauaaagcugcuguuaaaaaaaaaaaaaaagccaaggguuccuuuuggcaugaggacuucacacugaauaaguaaauuaggaacagcagagaagaaacucaguacuauacacccauuccuuucaaaacuaauagacaauaaaauggggacaauaacugagggcaaaauaaaguaaauccugguuggagauguuuaguuaccaccuguauuccaaauagcaccugaguguucagaggguggaugggcugggagccguaggugagaaaaagacaagaaccuucauagaauguacuguaugccaggcacuaugcuaagugcucuuuguauguauucauucauucaauuaucacacaguuaucuccauuuuacuauuuugaaauggaagcacagagaaguaacugcccuaaggucauauagcuaguuaagcagugacauuaagacugccuuaaagaguggaaguauucuaauagcaaugugacgaugcgggaaugggaguggcagugggcagggaagcuugggcuuguugaggggauggauagcugucacaauguguucaacuaggguaauaauggaggaggggguagaaggguggacagugagggguuacugaggaacucccuugaccaugcuaaggaaacaaaaugcagcagaugggcaucguugaagauaauugaaucaaaacaaggcuuaagaaggccaaguucaguuuucuaaaugcacagauacaugcaugucucaaugagugucucucugggucuguucccugggucuuacuaugaccugggcucuggggagaaauuacuaaaagagaagucacaaugaccuagggaaauugaaaagccuccauaggaccugccuuagaaccuuacauucuuugaaugguugcaaagucgcagccgaaggugacuagcccagaaugcucagaacauuuggcaucaaaccuggacuagaagguaaaccucuagaggggaaggaaaagucuauuguccccugaccuccucacuucccccaaaguggagcaaauugggcuccccagcuuuucuuuuccuucucagugagacagaugaguauagacaguaauugugcaggggcagaggaggagggagggacauuggagacuguguccacccaggaucucaggcuaacagucugaucucuaagccaaaugcugcacuucagagccagcaacuuuucauccacacgaauacauuccccuugaccuuuccacguuugcuuugugcucucagggcucaguucauucaugaagauuuuuccaagaucugcucuguucuaacuuccuuuuaugcuuggauuuuuauaccaagccucauagcaccucccauguagguagcauuuccuacuauuauaaucuccacauuacccccaaauaaucgagaguucacaguauagcuguucuuuucuuauuuuguugugcccuagaccucaugauagguuaauccucuuaugcccuauguuuuuuuuuguuguuguucuugcacaguucuuuuuuuuuuuuaauacuuuaaguucuaggguacaugugcacacaugugcacaacgugcagauuuguuacauauguauacaugugccauguuggugugcugcacccauuaacucaucauuuacauuagguguaucuccuaaugcuaucccuccccccuucccccaucccacaacaggccccggugugugaugucccccuuccuguguccaaguguucucauuguucaauucccaccuauaagugagaacaugcgauguuugguuuuuuguccuugagauaguuuguucagaaugaugguuuccagcuucauccaugucccuacaaaggacaugaacucaucauuuuuuauggcugcauaguauuccaugguguauauaugccacauuuucuuaauccagucuaucauuguuggacauuuggguugguuccaggucuuugcuauugugaauagugcggcaauaaacauacgugugcaugugucuuuauagcagcaugauuuauaauccuuuggguauauacccaguaaugggauggcugggucaaaugguauuucuaguucuagaucccugaggaauugccacacugucuuccacaaugguugaaccaguuuacagucccaccaacaguuaaaaguguuccuauuucuccacauccucuccagcaccuguuguuuccugacuuuuuaaugauggccauucuaacuggugugagauuguaucucauugugguuuugauuugcauuucucugauggccagugaugaucagcauuuuuucaugugucuguuggcugcauaaaugucuucuucugagaagugucuguucauauccuucgcccacuuguugaugagguuguuuuuuucuuguaaauuuguuuguguucauuguaaguucuggauauuagcccuuugucagaugaguagauuguaaaaauuuucucccauucuacagguugccuguucacucugaugguaguuucuuuugcugguucuugcacaauucuaggcgccaguagccauucauuccccauugaagucagccuguucccagugacuguggcuuccucuugacuccuggagcaccagcugccugaaccucucucuucucacuuauuguuuccugccucguguuaacuuucccucuuaccugccugccuuccagccauccuuggucaugcaagagacacucaaugcaacagggaugagucacugauuaaucagcaagcacuuuauagggccaugaugcaggcgauaacuguucugaugacagacacuggggagaacagcgggcaucuccagggcuugcucaucucugacaugcugucccugauccuuccuccugcuccuuccucucuccauccuuuucuucaaaauucuaucuuucugucuuucggugauucugucgucaucaccuuccuccccugccacaaauaccccugaguuucuuaacuacucacaauuuagaucucauuuauccuuuuauuugcuauaucuauagaacuuggcuuuucuuguuuucugugucuugugucugaauauaauaaugauguuuaacauucugugugugaccucugacugauuuuggaaaugggaaaaggauccauggcauugguaggaaaagguugccaagucugccuuaagaauuuuuaggaauggcagggcaugguggcucaugccuguaaucccaacacuuugggaggcugaggcaggcagaucaccugagauuaggaguucaagaccagcuuggccaacauggugaaaccccaucucuacuaaaaauacaaaaacuagcugggcgugguggcaggugccuguagucccagcuacucaggaggcugaggcaggagaauugcuugaaccugggaggcagaaguugcaauaagcuaaaaucgcaccacugcacuccagucugggcgaaagagugagacucugucucaaaaaaaaaaauuuuuuuuaagaauauuugcaggguaaaacauaaaaaagcugaugaugaaaccuguuggaugaacugaugaaaccccaaauuuacccagccaguaauggccaugcccuucaccuucuaaaagaagugcauuugcuucucccuggccucauguugaagaauuggaaaggagcaauuuggagagagugcaauaaaagaaaagacaaagaguuucugcuauuaucccugcaucucugacuucccacagucuguuuuucagcuguucccuguccacucccaggaccucugccuccugucuuauaguguaucauggucucuacuggauaacagauaagcaagguugagucaucugauauggucaucccuggauguggacuuucuccuccaaucaugagcacaacauauagagcucccauccucucuccuucacucucaucaagugaauggcucagcaagguugggacucuuguggugagaccagaagaucuugagaagagugugaggaaugagcuucccagugaauaaaaggugacccgacuuuugggccaugagugacagaacccuccagcugaaugugcauuugcuccugaaaaggaaccccauccaaaguagcuacagaagugauuuaaacagagauguggccccagcaaguccuuuucuuccagcucagcaucacauugacugucuucuuugacuccuaccagcucugcugggagugagacucagugacccuucccuucccuauagccuacccagcccacagauucaugccaaacacucguugcacugacuucauuugugccgucuuugacauuacugguaauguccauuauaugcagaugccaaagaccagcuaacaucaguucaaggaauauuucaggaguuccaccuguauacaauacaauauaccaugaaucacuagaucaugguggguauaaaagagagaaaauccuuggaacacccauaagcaguugaucccaguggguugguuaggcuguaguuaguauauacacugcuguugacacugccuuuaauuauguguagucacaccugcauuguguccuuuaugagcucuuagaaaauaaugaaugcacccaauuguuuagagcucccacaaagugaaggacaacauuauuucaaauuauugcaagaagcccaggguaucuggagacagggaaagcucuuaagucuacuuuuuauacaauagagcuucauaccauuauucuguauauaaucuuuucaccaaaacacugucgccugauuguuucaacaaaagaccucuuuguuuugauagccaagaaaaaccuuaagcucaguagagacaugagagcaagcuuuuuaaauuacaaaauguaagugcuaaaaccauauuuuuggaauguaaauuggaagguuuuuuaaaaaaaguuuuguuaacuuuaaaagaaguuacaauuuuuuuaaacuuaaguuuuuaaccuaaguuuuuauaaguuuuaaaauuuucauuaacuuuagcauuuuuuuucucuuuucuuuuuuaaugauuuccauggaguucuuugacaugcagcucagggugaccauaucuuucuuaucugacuauaggguaggcccagguaagcugaaaggugauaacuuucccauacuccugagcccucugaaggucaaauauauuguguucaacacucaaccucucaggauaauccuagcccugaacauaggcugauacaguuuggcucuguguccccacccaaaucucaccuuauagcucccauaauucccauguguugugggagggacccagugggggaugauugaaucaugggggcaggucuuuuucuugugcuguucucaugauagugaaugggucucauaagaucugaugguuuuaaaaaugggaguuucucugcacaagcucucucuuugccgcugccauccauauaagaugugacuugcuccuccuugccuuccaccaugauugugaggccuccccagucauguggaacuauaaguccaauaaaccucuuucuuucgcaaauugcccaaucuuggguaugucuuuaucagcaccgugaaaacggacuaauacguaugcucuucuacacacacauagcugagagucucuguaacaggacagagguagucuaucuggggauagauugaaagucccugacucauccucaugaacuugagugcaguuuuaaugccacgacccguccauuuuuuuguaguuccccaauauuuuggaaccuccuugaaggcuuaccuuuccacugcuaucuuacaaaaguggagagaaaggugacauuuccuauaagauguuccaucucuuuuaagaucuauaccuccaacuagacaggaaaaguccuaaguccucgcccacccugugggaugcuucugaaaguuguuacuuaccuugugaguacaaaugaaguauaucgucucucuccuguuccaggcugguagguaauguguacuuuguccuuucucauugguuuuuauuaauaaaaggaaaccaccaagcuauaggaaaucuuagaagucaucaucucuauuccauuggugccuuaagagaagaggcugugucuuguuugagguuauaucuucaauacuuaaaaaaauaccucuggaaggcaauggauguccucaggcauaugagauauaacccuccagcuguaugcauguccauauagcuugcauagguaguuugcuuaggaaauguuuaugaacagaaaugguucuggccuagaauugcauccacuuauaaggacucaaaagguuccuguuuaucuccccaaacucacugcucaaucucuuagcuucacccauaggaaaacuauuuugcauacacuguucccuuugcuuagaacauuucccccuuucuuacccuuccucaaccuugcccuagcuaacucuuacugucuuuagguugugucuuagauguuaccuccuagaagaaccuuccauggccuccuaagacccuccucuguguaucugaaacacuguaugcccacaccaauguagaauuuuaugcuguaauacaauugcccauuaucuugcuuaccuucccugaugcucaguaacuuucuuaaggacaagaagcucuuuuacucauuauuuuaucucuagcuacuggcaaacuauuuugcacaaaauagacauucaguaaauauuuguugucugaaugaaugaaugaacaaaguccaaacaaggaauauauucuuaggcauagacggcuuaucuuucagaaauuaaagugcggcuacuuugugucugcauugaaugucaguccaagcuucucagaggauuccucuggauaggcaccccagcguggguccuagcuauugcuuaggaccucccagggccugccuuucucuggguguagggcccaggauuuuccccacuaggcugggcuuuccuacuauucucuacccuuacucaacuccuccauccugucugggagacucaacaauuccucuuccaggcuccauguccuccugcccugccuaaacuuggugacagcucuagcuccugggaaucuggugaucucuauucacccaccacuaccuauuucauuugcucugccugagguguguucacuaacagguuguugaauauggcucuacccuuggaugaaacuugaaggucuguacugguugucuuaaacagcuuucagucuuauuggcaggcaugaggcucugcagcugcucaauuaaucaggaccagaagccaacuuauguuggguccugucucugagaguaaguccauguuagcucaacuacugaguucgugauccuugggggauuuggagaggaaugucccuagcuccucucugguggucauucacuugggucccauuggaagagaaaccuuuaagaauuaaaucacugcaguuuuccaguagaagaaauacagugcauuuaauaaggauaaauaacugucugcuaauaauuagaggaggaucucugcuugcagacccuacuaauucacacucuguccucauucucauccccucccuuugccccuggaagugaugcucaaaggaucaagaucaaaaggcaguggaaagaaaugaaggaugcaggagaaagauggacauugugaauaaagggaagagagagaggggugauggggaagguaggaagaucaggacagagcaaggaacaacaggaugagauucaaaagaaagcaacauggggaacaugcaaguggugagggcuaagaaaucuuaauaaugaagaaaccauggggacuaagaggaaguugaagaaagcugcuggagcaaccuagagagacagaagagagcagagaagugagugaaaggaauaaaccugggaugagagagaggaucugcacuguaacucugauauugaccaagaggauugauaaccucccuuuuauuaaaugccacauacaugccaagugcugugcugaggcuuugcauuuauuauagcauagugggcacuagcccagaauggaauccagaguugagcuguuuauggagcugugcaccagaaaacacuuagaugucuacacauaaguucacaugcaggagacuaggagaggguuguucucuccaccuccagucucagcccaggagggcagagguuggccagccacagagcccaguccagguacuucaacaaggggagcugaguggaagaacagaagcaaacuaucccugagcauaggaggggcuccaucaccuucagaaugcuaccaaauagcuaggagggaugaaggcagauggugauggcuuuuggggguaggaaguuaccugagguccucaggccagcaggcauggucuuggagcucuaaagauucagguauuuaugcuauuaugaccauuuggguauucagggcuggugaaacuagaaacagaacucacagaugucuuaucccuuugaaugcuuauuuauaacaacucuguuauaucuccauuaaagaaacacuaguuacuucccccaugcuacuggaugguggcacuaaguacgacaugaucagugugacgcaaagaccauacucuuuccacucuacccuaaggcaucucauuagagauggcaucucugcugucccaucucugcuaucccauuucugguugucagagcaauauauucuaggaggucagccucagccucaggccaucuuuaggcagacaggagguuaagagaagggaaaugcagugcugguccagaagcaaugaccaaggcccugggagccaugaagauagaggccacacuggacauuuccagcugggcagagagaggaagguuagaaaccaggaaaagaugagcaggaguucagccaaugaagguuuggggcacaggaagcaaaaagccuggucuuauagguuggcauugguccccuccaccuguuggggacacacagaagccuggagccacaggaugucaggaacuuucugucccuuucagcuucacacaugcacagcuuagcgagaacauuacccuugauccucugagccagggaucacagucuacgggauuugugaaaauuugguuuugucuugcagggaauuuguccccauguaauucauuaauugacccauugcuccuuagagcugcaaggagccugguaguucaggccauuaagucccuucuguaggccuaauucauggccugacaucacaauccuaaaaacauaauccauuuguccugauuugauuuuuucuuuucgagaggcucccuuggcagccagguuuucucauuaugauaugauucauccauaugguaauuaccauuagaauuaguaucucagacgugauucaucuuuggaaauauuaagcuggaagcaucacuuacagaaaggccuguuccauuuacagccauggggaaugucugcagagaugcuccuucauccagcuagcauuuguugaguuuugcccuguacuggauucugaacuaggggccuugaggcguauagagaugaauaggcccuagacugugcccucaguagcuuccauucuagaagggagaugauagggacguaagugcuugucagauggaugguacagucagagaugaaagguaacauguucuccuuaaagucuaggauacagguuuucaaacucuagcaggaaucaaaaucaccugaagggcuugcuaaaacacagauuauugggucccagcccagaguuuuugauucaguaggccugcgauggagcccaagaauuugcaguuccaacaaacuccugggugaggaggaugaugcuggucuggggaccacacuuugaggaccauagcucuaagucuucaauuauuucuccacugugcccuuucuccauugcuugcagcaugcuaagcagugcccugugcuggggacaaaauguuuauuaaagcuuggucccuguuccaguggggaaauaguaggagaguaaacagugauuucuguacuucacagaaagugcuacuagagcuuugcuuaaggugucauuggaucaccaaaaagaacaugauuauuucuugccggaacccagggaaggccacauggaggagguaaaauuuuaauaaaagggauguggauuggaagaaguuguauggaagggcauuugcagcugcgaaauucccaaguuuucaaauguccuggggcauccucuaacuucuucugagauguuccccugaagugauaaagguucagcuuacuucccauagaagccucuggcacaguucugguuaauucgccugguuuuagcaaagucuuuauguuugucuuuccggaguucuguuuggucagugucuugcucgugcauggucugaauacucucaguagaauggaauucucugcacaggcauuugaauggaauguggaaucaugagcagagcaaacagcagccugcuaccaaaauucuccuccccaucccugccauuuaagucuccaagcugcugcaacuacccccuccaacagccucacuguuuuuguugacucuucaggaaauucgacaguucuuauaucauugcauuuuguuuacacacagacacccaucagacaugaaacuucuaguaucuucaaccuuuuagaacacugcuuguagauuccaaaguuagaaaagaggcucaugagacuaguaaagggguuuccaaaccauagcgcagagcucuuacacuucaugcugugagaggccccugcguuguuaccaccuauuaacucacaggugacaccguuaaaauaaaugucauuguuuuucuagcucagggcacuuuaagaaccacauuauggggaggauaagggugcuauuagaagcacauauauagucacuaaugcgaaauggcagcugauacugaaggagaauaguaauaagagagagggaacaggagaagcuaauguauuagagaauaaugaucaucaaaauaaucaucaaaauuaaguuuaauuauacccuccaucugccacugaagaaggggcuggguaugauauaggguaaaaucccagcacgcugggacgcugaggcgggaggcuugcuugagcucaggaguuugagaccagugugggcaacauagcaagaccacaucucuacaaauaauauaaaauuagcccagcauagugguggugccuguagucccagccacucaggaggcugaggugggaagaucacuugagcccaagaggucaaggcugcagugagcuaugauugugccacugcacuccagccugggcaacagagugagaccuugucucagagaaaaaaaaaaaaaaaaagaaagaaagaaagaaaaagaaagcaaggaaguauggauuauagaacaguaacacuaaaagggaccuuggagauaauaacuggccagccucuucgugauaaagauaagaaaacuggggcaaagaguagguuaugaggaagaggguuucaguuauuugcccaguaucacacaauuacacaguacagacugugggucucuccagggcagagucuuuuuucuuuuuaaaaucauuguucuccagcaucuaccauagucgauguaacugcaacucaauauuuguuuauuuaaauugauuuagcagagucaauacauuaauccguaucuugguuucuuuuaaaccccaugauccuuucaaaugaucaauuucaugaaaaauuaguagagagaauagaucagauuaaguccuuugacucuaagcccaucagcaaaugauaaugaaauguuguuaaacuguugguggauuuaucagaaauggccaaguuugguuacuagcaauuaaauccacauuuggcuacagcuauucugaauacuuuguaaagauuuuaugccauuucauaugauuuauauaucuaguuuucagcaaauacaggugacaguagaaugucgccugugguucagaugaauccaauguagucagggccaaaaaaccagaggauucuagccaaguuuuuggugaagacauagaauugagaaauucacuuauucaaucaagaacuguucauugagaacuuauaaugccaaacacuguucuagacacugcagauacagcagugaaaaaaagaaaaucucaugaagcugacauucuaauggaaggaacagacaacaaacaacaaacaaacaaaaagugauggagggauugugacuacaauuaccccucuguugaaagugcuuccucugacaucuguaauaggauuuucuguuugguuugguaguuaacagcacuagcuuagacauggagagucuugauguuaaguccuagcugugugcacauuagcgccuuauuuuuuuuuuuugagacagagucucgcuuuguuccccaggcuggagugcaguggcgcgaucuuggcuugcugcaagcuccgccuccuggguucaugccauucuccugccucagccuccggaguagcugggacuacagacaccuagcgccuuauuuuuaaaugcugauaauaguagaaccucuucauagagcuguucugcgguuuaauugaaaucacaucucacuacucagggccugguucauuuuaagcauucaacaaaugaugcaauuauuauuauuauugagucaauggaccucuaaguaacacacuuucuuccuguugaaagauuucagaagauaugccaucagaucuuagaaccucauaauuuuucauaagugaucucaaaaagauagcuucugaaacagagcaaguacaaaauugaccccacuugacaauacccuuuuugacuuuaguagaagucaagucaagaaaaagcucuggcuauuccaaggagcuuuccuucugggugagugcuguggauguggugugucugguugcuucaugccuuuuagugcaugcaagucuuugccuuugucuccaucugaauuaccccagcucuuuucagccucaguaugcuuguuuucuuuuguuuugggccuaaacuccacauccuaguacuggcuucuauaaggcaucccucuuucaugagucacaaggaacugcaaaugccuuuuaaaguguuuaugcaaguguuaucuaagcauugcuugcuuuucucuaagucauuuuacugugucaaaucauuuugcccaaaccacuccaggccaugucauuucacagcaccuaccauaaugggaggaguguaaucccauggaaggauccauucacaguuugcaacauugaucuauaguucucuauauaaagccuacaucucuaaaaacuuagcagugaccaaauauaacaacuuugacuccuuuccuuuccucccaaugacuucagcaaguccuguagaaauauauuuugauaauauauaauagccuacaauuuuuuacuaauuuauuuggucuacuuguuuauugucugccuuccccaugaaaaugaagcucgucuugcucacugguagaacaccagcaguugagcuuagcacaguguaugugcucaguaaauauaaaucacuuguugaguaaaugaaugcucacauagcugucuagcaaguguggaugccauguugugauguguuggauuuuguuucaaaaaagauauuggccuauguagggcaguagucugucuaguuuucagaacuuuccaucaccauauuaaccuugaguuucucucauuugugacuguauaauuuaaaacuauaaaucuucacauaaaggaagcauauuuggucauucauuagacuuaacuugacuauuuucaaaaggaauugagaauggccaugaaaggaauuaucaugaauaaaaacaauaacaacagcauuguaaacaucaccuaaaccucuuaccaagaucaccccuaacagugugaucuuuaucccacuguugggcuuugagugugacaauggauagugcaauggauaaagcuggaccacagaguuagagaaaucuggguuucuauccuggcauagccucuuacuagguguguaaggcugacuguauuucucuacuucucuaggcuuacuuucccaucuacaaaaugaaucaacuuuauagauuaguguguggauucaauuguuauguaauuaaaauacuuauuaugguuccaaacacaucaucauuguguuaguuaacaucugcuguguagcaaaggacucccaaaacguaccgacuuuucacaacaaucauuuauuuagcccaugauucugugaauuaguuggguaguucuagucuggaucaacugaucucugcugggcccucucaugcaucuguggcagcaguuggacuggcaaguggaugaucuaggauccaggaugguuucauuaugugucuggcuguuggcaaguuaucagccaaggugacaggggugacugggccauggucuuucauccucccgcaaucuaguucaggcuucuucacauggcaguuguugcagaguugccaaaagcaacaagagagagcaaucuccaauguacagguauuuuucaagacugcuugcaucauauuggcuaaauuuccauuaguuaaggaaaucacaguuccagcccagugucagugaaggaaauaauucgcggccauuuuuguagccugccacaauccucaucaucacugucaucauaaaaacuaguauuuguugagcauuuacuaagugccagaugcuguucuaaucauauuacauuuaucaaagcuuguaauucuagccacaaccuuaugaggcagauacuauuauauccuauauuggcgaaaaggaaacugaggcacagaauggcaaagcaacuuauccaaggucacacagcugggaagcaugggagcuggaauucaaaccaaugcuccagagccauacuuguaaugaccguucucuacugucucuucuucacacucuacaugugggcuuuuccaugauuccuucuuuuucauaagugagugaucuaggaagagauaauaccuugacuuuuuuuuuuuuuuuuuuugagacugagucucacucugucaccaggcuggagugcaguggugcaaucucagcuuacugcaaccuucgccuccuggguucaagugauucucgugccucagccucccgaguagcugggauuacaggcaugugccaccacacccaacucauuuuuguauuuuuaguagagacgggguuuuaccguguuggucaggcuggucuugaucuucugaccuugugauccacccacuucugccucccaaagugcugggauuacaggugugagccacugugccugaucaauaccuugauuuugacagguucccugaacauugccauaucuaccaccaguuuguccacacuucagcauuuuuccaacaaagcaccuugaguuucucucauccuggauuggugugacugggaugcaucauuccagaucuugguaguaauuuuugaucucuuucugguucuuuguggugaggguauuggcaaucgugauggaaguucagagcuucauucacagagcacuucaucuuuuauuucuucagacaaguuugggggcuuggaaauguggcugauaacgauguugaaauauuacuuaauauauacauagcauuuauauauguuuauuaauaguuucuuggaggugauuugcaauaccuuuugauaucagagacuauggcuuucucucuauccucagcaacuagcacaggcaagagcacacagaggacacauuggaggagcucaguacauguuguaaauaucuacauccguaucuguauuuuauuaagacagggucaaaaacacauauacuaauggugaccagauauuggccagguguggucacuaaagaauggugggcacuggcauccaguggagaacucaugccccaucuaacaguagaagaucuagccauuugauaccauguaggaaugcucaguguuaccagauuguuucauuauucaggagaugcuggaacuucagauguauauguaaagcuuuccugaauuuaaacaggguaugucagaugaaacaggucuguugacugaaucuggcccauggucaauugauuugugaccucccuacauuaggcacuuguuggcaccuuucuauugcauuauaacuguccugaaggcccgagguggaaggggagaugcagaauaaggcggagauggaacaaugagaugacaagagaugaaagacuucaagaaggauggaugauugccuauuucagagauucugcagagggcaaagaaaugggaauaagaaaaggcuauuagauuaaaguaaauuaauuauuuggcacagcacuacgucuacaggcuguguucuuuaaagaaaugaucaaauaacaugggaaauaguuaagcaaauuaaaauacuuuguuuacucugacucucguaauugucuuuaauauucuauuaugcaauguaaaucuccaaaaggagaagagauuuacugagauuuuuuaaacuuucaugaucaaggaguccuuaggucauacaaucccuuguagauagaauguuuugaggaaaacaccuuggaaaagcuggauaagagacugaaugagucacugggagucuauggaggccugauguggagacuggaaugcacaugguagugagcaaaugcacaaugagccagcgcagcagcuuggcaaguaaagaaaguaggccaaccuauuaggaacuaggaauugccagcuuaguaaucuuuuuaagacaaaaccauuuuagcauuauuccuuugcugaaaacaaaccagcgaaaacaaaaacaaaaacaaaacaaacaaaaaacaaaaaaaagcaucaaggggugcccuccucugaugggugaaaucuccuugcuuuaacauuccaggucuccuuuaucaggccagcugaccuuucuuauuccccaguuguucccuggccuuucucauuccccaguuauuuccuaugcuuacucccugcucuaaacuccacuggcuguccuuauugcuugcauggugaguugucuccccagcugcuccaguuagagaaaugccugcuuuccaaggcacaggucaaacccugcuuugccuauuaagccuuccuuagccaucaagcuaccagucaguucuuuuccuuacacaacuggaucaguuacuucugaaggacuugcaugggacuuaguguguuggagauggccuguaugauuuggagccaagagaauaaaacuaugucuugagaucugcagcucucuacccccauuugcccucacaguacacccaaauaggguuaggauaauauugcccagaaacacagaagagcaagggcauaacuccaaucacauugcauuucauagauuguggucuauaguuauacaaccaccuauuauucauugaggguaaaggaguguauucucuuuuauagacuugcucaacaguaaagagcaucauuucuagacacuaggcugaguauguuacauguuuaucauggugaaucccagaaucucccuaagaauaguguuauuauucccauuuuacagaggagggagcugucuugaaacauucaagucagcuuguucacacuuaaugaccagcucucuaucuggugaaggucgagucagguguaccugaccucauguaccugaccccaaaccugggcucuuucugucccagcacaccaucuccauggccaugcuggccacuagaaauuuaaugacagagaauuaaagguaagaaucacacugugccuucaaguggcaaauauauaccaccagacagaggaagacagauaaaaucuaguuagggucuacacaguuugaauaucauaggacucggugcauucugggguaucauaaggaccuagcacagcucaagagaggcccucuugagugagauuuggaggaugcaacaucaugggggcacaugccuggcccgcagggcagugagagucuucuacucccuggccauucgucagugucaccgaaggaggugaccuucauuuccacccuacucuaagcucuuggcuuuucugucuccuuuacuagacugugaacucugaggagagaaacuauuuuauuuauccagcccugucauaguuucugguauauaaacaguaacuauuuguugguuugaugaaugaaugacaagucagccaaggcaaggugcucaaggugacaugauagagacagcaugauagagacagcaccuuuauucccccaucagagagcuggauuaccucacugcauguuaugugucuccuccguuuguuuauacacuauccagaagucucuggcuucucagaaugcuugacaaauuccaaguccucccuucaauaaugucaaaccuuauaauuuucaggccucaucgaagauugugaaauccugcagcagcacaagaggugucugcugccccucacacuuuccccacaucuuccaacacacugccuugcacagagcagggucuauauacaugcacauugaaugacugcauugaaauagauuggagacaugguuaggaaccuguccuaacagugcaaucuucuugagacaaugcuuggugaauucgggugauaaaaggagaagaaaucaggauagugacagugacauagauggggcaagaagagugagcaggaucugucaacuuauuggauaugggaggugagggaggaggaagagaaaaaaugauucaaauacuuugaucucagcugacaguuugaaggauuaugcccaaaggggaaauagggaaguucucuuuccccaugacccucucauccucauuucaguuuaagcauggagaaaagauuucccauaaaagucaggcugaaacacuccauggagggagacagaccugggacagucauucaguaauguccaggaaaaccagaaggaaagguuugccuucaucucucugcagaagagcuuugcucugcugaggaggagaaauuugagcugaauguauuucugguugguaugacuuguaaguucucuguuugauagcagaguuguuugaaugaccuauuuuauaacuacacagagcuuuuccaaauagauggugucuguagaauguucagguuaaugcaugagccgagugcucagaguguuugcacuuggagcaucugagccuucuuucuuaauaagucaucuuggcauuuugucaacaaguuaauuugcuuuccuaagaaacuagauuaauacuuccuguacuuugugcuauucacagaucuacaaugcagugagaagagaagaaacagaaaauacaguuggaucucuacuccauuuccucaccaagcucccagccuccgagacagcccauggaaggauaagcguugguccaugcuuaaagcaauguguccgagacacuguaugugaguaucgcgccacccuccaaaggacuucaauaucgcaguacaucaccgguucucuccuagaagcaaccacgucuuugggagcaagaaguggccuucucaguacuuuuggaggauccacuggacgaaugaugcugaaagguaaugccugaaauuucacuuuuaacuuucuaucuuugacuacagagaaggaucuaaguuaagauuuauguaucuccugauggaaaauuaaguucacuuuucagcaacuuuaaguaaaagucgcuucuuuaagagaauauaaaaagguggucccuuauuaaaauccccuaaggugucaacauuccaaauaguaaucauuaagauuuugaggccgggugcgguggcucacaccuguaaucccagcacuuugggaggccaaggcgggcggaucacaaggucaggagaucgagaccauccuggccaacacgguggaacaccaucucuacuaaaaauacaaaaaguuagcugagggugguggcgggcgccuguugucccaguuacucgggaggcugaggcaggagaauggugugaaccugagagguggagcuugcagugagccgagcucacgccacugcacucuagccuaggcaacagagugagacuccaucucaaaaaaaaaaaaaaaaaaaagauuuuugaaacuuuuuuucaaaugaaguaaaugguuaaaacgcuaucuuuaauuuuuuuuuaaaugauucaggcagguaguuucuccuagugguaguuuaugacaaaugucaauuacuaugacaagaugcuaggaaacaaauauagucaagcagucauauugaaaacccacugugguugggagcagagugaaauauagaucuccuucauacauagaauuaauaggugucuauugaccagaaaagccaaaggccaucuuccagcuacucccaucuuaaaggacaagauaggcaggcaucccacugaaagaugaaagccaauggaguguggggucccuuggcauaugaacuucccagcuacuucccaugagcagcagacaggcaggucagaaauggcagugcaccaaacaaccucagaaacuuguacacugcauagcugucacaagcugcuuggcagccuucccuggcaggaagcugccaaccagacagggaccaugcaaagcagcauuccacugccuggggguugccagaacucaaucugacagcagcuauugucccuccauagcagguccugagacccaaggccagcaggccaaugaccuuccuccuugauccucagccuucuccauuccuacccacacacacaccccuagacaggccuaagaggaauacuguaaccuccuuguguacuauguugggugccaaguugguuuguuuucuggaguugcccgaacuucaggggauugguuauaaaugaaugaagaauaacagaaggugugggaacacuaauggcuucauguuuuucagccauucaacacauuuuuugagccccuauuagguguuaggugcuggaaaaggaacaaaacauaauuccugcccucauggaauuuauagucucuaggugguaagcuguuuucccuacacacaagacucaagguuucuccccucugauguggcaccuagagaguaccaagccugcauucuucaucauacucuucccaggaaguugggcugagauuggcauguggaauuggcauuguuuuaaugcuugugaugguaugccagggccuuaucccaugaguuaaucaacauguguagacuaaaccccucccauuugguuuucaaagucuuuuuuuuuuuuuuucuuuuugagaugcagucuuacucugucacccaggccggagugcaguggcaugaucuuggcucacugcagccucugccucccaaguucaaguuucucaugccucagccucccgaguagcugggaccacaggcacacgccaccucgucuggcuaauuuuuguauuuuuaguagagacgggguuuugccauguuggccaggcuggucucgaacuccugaccucaggugauccgcccaucuuggccucucaaaaugcuggaauuacaggugugagccacugcacauggccuuaaaguuuuuaugugccucaguuaaacauauuucuuuaacaaucaguggaauaaaauggauuaaaaacccagauggguuucucaccacaaacaaugauaaguauguaaagcauauguuaguuagcucaacugaaccauuccacaagguauacauauuucaaaacaucauguuuuacaugacaaauguauacaguuuuuauuaacucauuuugugcucaguaguguguaggaagaaacggaucucuaggcugcccaaccaaggcaggcacgccucuagucuuccacaggucuguggagagaaauaaggaagcugcuggugugugcaucuauggcccugaucauaauuugacuucaauuguauuugcacuucccuguucgaaauagaaccucauagaucaauauuucuagcucugacacucaccagacugucagcuaauguguuaucuuuaaauuggcguuuuaugcaagaguuggaaguuucuuuaacuuuuugcuuugaagcucuuuggugauuucugagaacccucuagaaacuccugcugaauaauacaauuagcugguugccuucugcuccaagcuuauuucuguaguucugacuuacuaucuuggaaacauuuuucaauuucagcauccucucccauuugguuuucaaagucuuuacgugccucaguuaaacauauuccuuuaacaugcaguggaagaaaaugcauuagaaaaccagauggguuucucaccaccaaaaaugauaaguaugugagguaaagcauauguuaguuagcucaguugaaccauucuacaauguauacauauuacaaaacaucauguuguacauuacaaauauauauaauuuguauuugucaacuuaaaaaaauuaaguuaaaaaaaaagaugggucuucaaagucaaagaguguuuacagaaucuguaggaucagcauauugguuagugggucuugaacucugauggccauguacucugccagaggaucaggaguacaugcagcugcugugaugugguugugagcuuuuuuuucuucuuuaguauguguccuguggcauagauuuggccaacagcuuuuagcuauuggggaauauauaauacacucuuagucuucaguuuauaaauggguuauauucuacaaguucauuucccaggagcgauauagaacuuagaacacuuuccuggauaagcaguauuaaauguugugauuugguucacagacucuaguccucaaaaaccucuguaacccauaacacaguugugaucugcacauuucccacgaaauaaagaggaaaacacuauuguuggaauacugagcauuagccucaaagaaaaagcaauagaagugaguuagaagacauuucuuguugaggggcaauaauuuuauuaaagaugaguaaagaguuaaacuuuucagagauuucgaaaaggaguuuuagccauuucugagauuuuagauguuggcagcuguagcuuuuuguuauggcuaauuacacuucaaaacuuguaccuauaugaaggagucagaaaauugccccaguaauuuuuuccuaauguuuuuuaacgagauguuuauaaaugguaugaagaaggauggaaggagguagcacaagauuuaaauuuuuccccagagauaaagaaaaaggaauaaguucaaaagaauaaccucuuccauaagagaaaacauguuugaagugaauuaaacggaguugguaaagguagagaaaaaggaacagggaaaaacaaaugcuguaugauuucccuuauaugaaguacuuaggguagucaaaaucauagagaccuuaaguagaaaggugguuaccggggaugaggaagggcaaugggaauggggaguuaguguuuacgggcuauagaguuucuguuuugccagaugaagaguucuggagcuuacugguggugauaguugcacagcaauaugaauuuacuuaauaccacugaauuguacacuuaaaaauguugagauaguaaauuuuauguuguauguauuuuaucauaagaagaaauaauugggaaaaagggcauguuuugcaggucuuucaucccccucccuagucuauuaggauguaagaaagaaccgaaacgcuccucuucuggaagugguuaugauuaugagaugggggucguggucaccuguacuaggcgaaaauagaaggaaauguccaacaaguugaucguuauucacaagucaagaacugguaacucgaggcuugauuguccagaauucugcagccuuggggcuuuauggauugauacagaaggccaauaaucagaacacaaacaugccugcuuuucugccuucagugccaccaaaggucaucugccuauaaagcugaagguuugccaaauaaccagagacacuuucuuaugugaagcauugauccacaaggauaugcccuuaucauaagugugugcugucucaaaguggaaaaauagagcgccuuuaccuuucagucaggaaccuccacuaguuugauacauuaagauccuucuggccgggcgugguggcucacgccuguaaucccagcacuuugguaggccgaggcgggcagaucaugaggucaggagaucaagaccauccuggcuaacauggugaaaccccgugucuacuaaaaauacaaaaaaauuagccggguaugguggugggugccuguagucccagcuacucgggaggcugaggcaggagaauggcgugaacccgggaggcagagcuugcagugagccaagaucacgccacugcacuccagccugggcgacagagcaagacuccaucucaaaaaaaaagauccuuccacuuccugucccugugcccuuuucccucuccccauuaaucuuguuagaaucucaggacuaacaccuuauagcaguggcagucaaaagaauuauugacuucgauaauuaggaagaaauuuucaaagcuaucaccugcuuuuucuuuucuuuuaauguuuuaccuacugaaaauuauaaaaacaagauaaaguuaaaagggagagaaaaaauugagauaacugaugguaaugugaaguacuaaaaauggcaaaauuagaaaaauaaagugaugacaagaggauuuuucauauaaggcagcuaaguguuuucaaaugugcauauuguaccagccaacauaauaaauugaguguguuaaacucaauuuuuccuucucaaauuguugcugaguaaagcacauaaauuaaaggauuaaguguuacauauaaccgagacaaaacauaguuauucauauuuaaauuguguaauagaguggagggaagauggaccugcugaggccagcaagacaucugccaucuuucugacagauggaggccagcaagauagugcagacacagggugccaggaggaaagucuguuacuaccaugaugagaauguuggacaaagccacccaaugaagcuuuaccaauucugcaugauucauaauuugcugcucaacuacagucuccacugaaaaaugaaaaucuauugcccucacaaagccagugcugaggagaugaccaaguaccacagugaugacuacauuaaauccuugcacuccauucauccugauaacaugucugaguacagccagcaggcacagagauucaacauuggugaggacuguccaguauuucauggccucuuugaguuucgucaguugucugugggcggcucuguggcaaguucugugaaacuuaaugaguggcagacagacaucaccaugaaccagacugcaccaugcaaagaagucugaggcaucuggcuucugcuaagucaaugauacagucuuggcccuccuggaccugcuagagaaucaccagggggugcugcauauugaccuugauauuccacagugcauauugugcguauugaccuuccaugccacggugauggcauggaagaggccuucuaugccacagacugggucaugacuguguccuuucauaaaugaggagaguacuucccaggaacuggggaccuaugggauauuggggcuggaaaaggcaaguauuaugcuauuaaccacccacucugagaugggauugauaaugaauccugugaggccauuuucaagccagauauguccguaguaauggagauguuccagccuagugcuguggucauacagugugacucagacuccaucuggggaucaguuagguugcuucaaucugaacaucaaagggcaugucaaguguguggaauuuguuaugagcuucaucuugcugaugcugaugcuaggaggagguguuacaucauucgcaaugucaccugcugcuggacauaggaaacagcuguggcccuggacacagagauccauaaugagcucccauauaaugacuacuucaaauacuuuggaccagauuucaagcuucauaucagucuuuccaauauaacuaaccagaucacuaaugaugccuggaaaagaucaaacagcaacugucugggaaccugagaaugcugccccacacaccuagggcccaaaugugggcucuugcugaggauguaaccuagaggagagugacaacaaggacgaagacccugacaagugcaucuccaucuguuccucugacaaacaaacugccugugaggccgggcaucguggcucaugcauguaaucccagcacuuugggaggccaaggcagguggaucaccugaggucaggaguucgaggccaaccuggccaacauggugaaaccacaucucuacuaaaaauaacaaaaguuagcugggcauaguggcacgugccuguaaucccagcuacucaggaggcugaggcaggagaaucacuugaacccaggaggcagagauugcagugagcugagauugggccacugcacuccagccugggugacagagcgagacuccaucucaaaaaacaaaaaaauaaacaacaaauugccugugaggaugaauucuccgacucugaugaagagggaaaggguggcugcaagaauucuuccaacuucaaaaaagccaagugggucuaaacaggaugaaagagagaaagacccagaagagaagaagucacagcagagaagaccaaggagaagccagaggccaaagggguccagaaggaggucaaguuggcugagcaggccuuuccagcucuggcuucuugcuggguccccuaacaacuuagauuuuauauuuucuauuucucuagacuauuaguaaauuuuuauuuacuaaacauaaauaucuuggggacuagagugaaagacagaaaccaggguccugaguccagggcagcugugcugggugagcucuuccaggagcugccuugccccccuuuccuccccaguucuuaacuuugaaccauaaagggagccagggcugggugggagggauacuuguagguagccauauaguaguuuuggaaagguguccuuauuagcauucuagaagggguggcuggaucuccaaggauccucuguucuuuccagguuccuaagguaauauuagauguuuuagauugguucuguucucauaccuccccauuguccucaaguaagccaggaagcucacacugccugcccucuguguuccuccaauucugcaggugcagauugguagucuaguuuccuuuuuuggauacuauuuucuuuuugugagacuuuguaauaaaaugguacauuucuauuuuuaaaaauaauaauacauuauguauuagaaaaaaaaacuaaacuguucauuuuuaaccagucugagugugugguaugugugucuguagacuauauuuagcuauauuaaaguuauuuaucacaugucagcuauaaauagaauauugauaugaaaacaaaaauaccuuacagauacaauauuuuuguuugaaaagagggaauauuuuauuucagauagaaaagucuaccagcacuuugagaggucgaggcgagcacaucacuugaggucagaaguuugagaccagccuggcuaacaugaugaaaccuguuacuacugaaaauacaaaaaaaaaaaaaaaguuaaccaggcgugguggcauacaccugcagucccagcuacuuaggaggcugaggcaugagaacugcuugaacccaggaggaggagguugcagugagccgagaacacaccacuguacucccuccugggcaacacagugagacucccaucaaguuuucaacuuauuuucuuucacuacaauaagcuuguauauucuauuuguaucuuucucuaaaguuaauagcuuugaauaaaaaacaagaaguuauaguaggaauacacauacacauuugaacuacaugauuauaacucguaaauacuuuaguuuguaaaggcuggcuuaguugacuuccucaaaaucaaaacgauuacccuuuacaugccuacuaggcaaggaaggcaugugcauagcucuaauuccaagauuuguuuauuuaaagaaauauccugacuuguuaguauugugaccuugaaauuauuuucuugguauuuaaaaguaugcuuuaauguaauauuggguguguuucucuaccaguuaaucaacuaaaaaguauucauuagcugcccacuguggccuagugcuauggcaccuaagaauggagaagaucacaucuggaagucuucaacuuguaagauaauauuucucauuccagagaaaauguaauauuagguuucaggucuacugaaggagcccuuaccaccuaaagagaauucauaaagugcuaggcugcuacauuaaaggugguaugaguaggucauagggccaggaagcuugguaggcacaggacaaaaaccuguuuuaggaccacagguggucaaguaucauccaggagugugacacuacaccuggguguaaccuaagaauaugacuccauaccaguugugaccaaggaaugugacuccgucaccaggugugaccugaacauagcacuccauuccuaggugugaauacacccauuuugagcugggagacugauuccauuuaauucucuuaugugcccuaauuuugcuccaagaaacuagcuuaugaaaggaacaaauuauggccuaauucuccauaaaguuuugacaccaaaaagagagagagggagagggagagggaggagaaggagaagggaaggugaagggaaggcgaagggaaggugaagggaaggcuaagggaaggugaagggaaggcuaagggaaggugaagggaaggcuaagggaaggugaagggaaggcuaagggaaggcaaagggaaggagaaaggaaggcagaaggaggaaagaaagaaggaaggaaagaagaaagggagggagggaggaaagaaagaaggaagggagggagagaaggaagggagggagggaggggaaggaaagaaggaagaucggguaauugaaaguugguuaaauccuaaucaaugcagucagaaagaugacuggugaggauagcaacaccagacagacacuuuggguuuacauaucugagcugguuauaaaaaugucaaguccuaauuacagagacucagaauggaccauauugcagaaauuuauuugcaaaauaguuauuugaaacacugcauccaaaaaaacaaccauuagauuccaaaacuucccuccaaaacuuacugaauauuuaaguaaaacaauaguucuuaaaaaugccagagaauagcugcagacucugcagaagugguuaccuccaagaaaggccuuuaaaugugagccucauuguguuuuggauuugagccuugacuucaacauugggucauccuauucaggugauuguaccucuaggcuuuaguuucugcaucuacaaaaugggaauaaaagcaacaacuucggagaguuguuuugaggaauaagugugacaauguauauaaagaacuuaggccagguggcucaugccuguaaucucuguacucugggaggcaaagccaagaagaucacguuaggccaggaguucaagacgaguguaggcaacauggcgugaugcugucucaaaaaaaaaaaaaaaaaagccagccagaugugguggugugugccuguggucccaccuauucagaaggcugaggcuguagaaucacuguagcccaggaauuugaagcugcagugcgcuaugauccugccacugcacucuguccgccuaggugauggagcgagacucucucucuacaaaaacuuuaaaaauuaaaaauaaaaacagcuuggcauaguaucugguaccuaauguauguucaaccaaucuuaugaugaugauggucaugcuggggcugaugauggugaugaugaugguaguaaugaggauugccaccaccaucuugaaaugccagcauuccacuguucuuaauucaaagacucugcuguuagcucaguuguagauguacaagaaaagacaaguacccuccagguuucccuagcugugggccuagagcacuagcaacuccugggacaccuaaggggagguaucuaguggcuggaggccacaccuguguaacuccuuuagcgagauuuuccuuaguucccaugcauuaggccacugauuaauucaaucauuugaccaauauuuguugaacaucuacuaugugccaaggauauaacagcaaacaaaauacagucuuuacuuucgagggauuuacccacaaauggaggaaauggacaaauaaacgugcaaauuuuaagauaguauaaauguuauaauugaaauaagcacaggauauagggccccagagggaagucccuauaccaucuucauugacaucugagguuucuacaaccauuuaaguaccugaagaaaucuaaacagguauuuaaccagggaaaacaagcccugacccauauuaugaaacuucuguuguuuuuacuuaauucucugcugauaucaucucuauuuuauucccuccagaguagaaagaugcuaagcauuuacuccugguauugggagccuugucuaaaaaucuaugacugggacaaaauuuaguguuccaguuaaaauuuguauauuuuaaugaagaugacuuacucauuacaauaaaauuaaaggauuuuuuucaauacaugacacuucuacuuuugaguguuucuaaauuguuuauuguuuuuaaagaguaagccucauuuuaaugagcuaugaaaauucuugcucuugggaacauuuauagaacauaauaaaaugcuuauaaucuguuuauaauaacaugugggucaguagcaaauacuuaagaggauaaaaaagagaauaucucaccauagucugagucauaauuuaaacuucuacuggaauugagucuucaaaccaagaaauagugaauaaauuauuacaguuaaaguaacaaaaagauauuuuuaacgguguuuagauuuugguaauugaauucuaauuacagauauuauacuaucaucaggaaagucuaacaaguuuugucaacuggaaauauauauuugguauuuugucuuuuuaacuucauauuucauugugacaacaaacuuaaaaaaauauuuucuauaauguuaaugucacaagugauuccuugaacaaauguaugcucaaacaccacuaaggaucuaccuuugaauuuuacagucaccagaaacacccugugugacaguagcggguauuuugccccuguuuauacucagagacacauuuuggcaucaauaagcagacucaucuaaaauccauuucaaauagauguuguuguggaugaucugggaacauggaggguaagagagaguauaacaaguuucagagacccuagcaacucacaagaucuaggcugauacacuaccaagucuagacccaaaauccuuaacuaggguugaccagcuuguaggagcaaagccaguauuugauccuaagccucucugauucccaaagccauguucuuaacuacuaggaaacacuccaguauuaucucccacucagggaucccguguacugacuuauaccagugugugugugugucucugugugugugugugcauacauggaguauaacacuaaaucuuagauuugaauggagguucauuugacuacagaauugaucauuuucccacauaccugcugcccccuugcccuagagaccuccagugauuuugaggaugucuguggaaaugauauccuuccauucuuugauauagacaccuaugaggguagugggagucuucccacugaugguuacauguucauaacacagucaaucaaaugggaaaagaagcagcuccuguuagcugaugggccaaguaaaacacauuucacucugcaaaagaagccauugauuggacacaggcagagaaguggucaaaucaaugguaacuagagaagaggggcugaaagagugucugggcagaagcaaucauaugugcaaaggcccaguggcagcagggaguaugccaaguuugaagucugggcggagaguggugagcuggaggguuucuuaugccaauaaagucuggagaagucggaauaacaagcacuaacagguauugggcacucacugugagcugggcacugugacaaguguuuuuaaaguguuaccuaauuuaagccucauauuuuugccuaugaaaaauagagagaggcaaaacagagagaggcaaaacaaacugccagauaacauaggcucuuguuaagggcuguagaagcaaugggaagccaucagaggguuuuaagcagaaguagugacacaauaagacuuacauuucaaaaggaugauucucaucaaaauaaaguagggaugcccccaugggcaccaccccuuccagcccucauuguaccccaaauuaaaauauuuacauuugaaauggucauggauauugaacuugaaaauaaaugacuauucugaaauaaagacugagaugguguuaguugaaaugcucuuuaauuguuucgaggaguugggaaaaggaguaauggcuacuaacccagcucucucuacuuccugggaacuguauuucaagacguuggacuuagaaggaagcuugugguguagacuacaaaggggaauuaaaaaccuguucccuccaggcccagguggacuguuaaugcucccccuaccccaugccauacucacugaugacuaugaguuguagcaguguuuuacuuauacugcaggaacacaaauuccuucuucaugggccaaauccaagccacguguguuuuucuuugaccguugcaguacuuuaaaaauugggaaucuugcauuaaaauguucuggcuucucuggcaacccugggccacuauucucccuuggcccgugggcugacagugauccauacuaacccccacaagaugagacacaccagcucuuuaccacacaccuggccccaccuccaggugguguccuguucagcucuagccucauuuccuuuaccugcuugguccugcaggcaucuccauuuuggacccuggaguuguauucugagauucacacaagcuuuggggcacuucaguucaaggauuuaggaggcugaacugggaguugggacaaaaaggagaagggcuguaaauacagacaggucaucugugaacaaccuucugguuggguucuuccugggagauacaggaagcguuccaagcagggaaagcaagugagauagugccagggugagaaugugugcagcaacugugagacaaugaagaaaugaugcaguggacauagugagagguaagguccauuugguagcugugguuacaguuuggagaaugaggugaaaauuugaaccuaaagcauuagagagccauugcagacccuuaagcagguugaauuuugaauaguggcacauuaggaccaauagccuggaggcacccucuauaggaaggagaguggcacuuacaaaccugaaugcuuuucccuggauuaggaauugggugcacugaaaauagagggccagaagccagcaugggcccacuuaguuuucauuggcaugagacacugguuacaguaaaaggacuagucuugaaaauuuagcaucaccgggagaaaaaugaaaugcaauaaaaauuagagucaguuaagaauggaggaauuuuuacuaugacacagcaccauuguaaaaaaucucccgccucgugccaagggguccgugcugcuaaacuccuccccugaguuagugcauuugagugcucucagugcagucggcacagccagagcagcugggagcaaggccuucuccaggcuuacauaaagcauaggucuugaccaaaugugaaaaaccuuuagggacaugaaaaccauuagggauccguagcccugacuugaaccaagcagaauaaacaaaccccugcccaaauuggaacucacuggacgccuuucagaguuauccaaggggaaaggcuggaggccucaagggucuucgaguggguuaaugucuucuuucggcugccuagcucaagauggggcuuuaucugugcuuuccuuuguucuuuucucaaaugucuuaaugccucaguggcaaauccacaaauggauuguguuuugaaccuguaauguguaccauacuauauuuucccugcuaaugguauaguaaagcccguuagaccuuuuguuacaaaagauucaggaacugggcuggaaagguuccagguagcauucacauuuuccauggacagggucuugguaaguucccaaccuuauuucuauuuucaauauccuuugucacucuuuccagccucacgaucuaguuuucuacacgcauaauguagagaaacgcugugucucucucccccaacaguuaaguggcaucauuuucacucuuuuaaucccaguuuuuuuuucaaguugaggaggcagggccgggcaugguggcuuaugccuguaauaccagcacuuugggaggccgaggcacgcagaucaccugaggucaggagugcgagacuagccuggccaacauggggaaacucugucucuacuaaaacuacaaaaaucagccagguauggugguaggcaccuguaaucccagcuacucgggaggcugaggcaggagaaucacuugaacccaggagauggagguugcagugagccaagauggcgccacugcacuccagccuaggcaacagagggagaccuugccuugaaagaaagaaagagagagaaagagagagagagagaaagagagaaagagagaggagagaaaggaagaaagaaagaaggggaggcagauuagagaauuaugaauguucauucauccaguaaauagucaauugagugccugccguggacuagaugcuaugcuaggcacuauauugugacagcggagggggcuggauugaagaagaaugaaacaauacccuaguucccugauauucacaaucuguuaaagauggagaugggcauagagaugggaaaccaaagcacagagcagcuaagaaccaagcccuagauggucacaaauccauagcucacagaagugugaucugaacuaucauggagcucuuacccugccucuagucuaccuguaggaaauauaauagaauguagcacaauauaggaaacauuugcagaaugccugccaccccuguucuagcuagggaugaaaacaaugaaauaaagcacuguucuuaauucuaggaguaugauuuagauuaacaaagagacagacaugaaccaguguuuacauugcagcaugauacacaaaaggcaaaaauuggugauuaagaauguggaguuugaugacagauagaccuaagucccagaucaaccauauagaaacugcaugaucuggggcaaguuacuuaacucuucucuucuaaguuucaucaucuuaccuguaaaauaggacaaugcagacacuugccucaggucauuauaauggguuaaaaaguaaauuaaugaauauaaagugauuagaacacuguccaaaaaaaguggagauggagcgaagaaggcacucagaaauggcaagaacaaaggcuuagaugcaggauaugucucaggaugggggcuggaggguucauguuuggcaggagcagggaacauacagggggccuugagaaauggagcuggaauggauguccugguuugcaggugcauugggcccuaggucagggcaaaucuugggaagauaggcauccaggacagcagcuacugccagcucuugcuuucaagguucauuucuuccauucacaccuggcccuuaucacucuuccaagguguaucggccacaaucaguucucaccugcccuagaaggucucucuggucuuccucccuaguucaguuggaucaugcacgggcaaauaaauccuuuuucuccuucucuagcucaaccaugagaaaguuggaauuuuuuaaugcaaaauuuuccuuuccaagaaaaagagagaaaggauggaagaaagagaggguagaaaaagggacuauaggaaguggaaggaaagggaaaaggaaggaaaggcuauacagacacacagaaacacagaaacagauauguucagcaaagcguagacgucauaccucauuuaucaaaagugggucacagaucagccuugccaauggauuccacuuguaggaccuccagugcuuauucucuuccuugcuucugccuugaaugucuggacuuggagagauuaaacuaguugucugagaagaguuggcugccauggcuauuccagaacuuucucaccucucacacagcaccccggaucuuuaauccccuuggcccuguucauuccacucuaccuugacacugguuacaguaaagggacuagucuugaagauuuagcaucacugggagaaaaaugaaauguaaugaaaauuagagucaguuaagaauggaggcauuuuuacuaugacacagcaccauuguaagaaaucuacccccgugugccaagggguuccaugcugcuaaacuccucagucagugcauuugagugcucuuggcacagucggcauagccagagcagcccagaagguggcuucaaaagcuugguguggucaguucacagaggcuacuugaaucagucuuugagccuugacugaucugagccaaucaaguucacagaaaacugacuucuaacccaaaugccauuucucaauuucugagagcuacgugcagcucaguugcugcaaguaauaaaaacaacagcaauaauaacugccuuuuauugaaucaggcacuacaugucauaaacuguucuaaguguuuuaccaacaucaacccucuugcaacuaaaaguguggucccagaaccaucagaaucucaagccucaccugagacuuugggucagaaacugcauuuuuuaaaauaaaauucccagauaaaaaccuggguucuaguucuggcuauacaaccuuaaucuuuucuccucugccuucugucuuugagucucuuggucucauucaguuucaaggucaacuuuaaaaucucccaauucccuuccauagagaaaguguuugauucucuuuggcgcccagaguccauauucaacaaugauaaaacccacucagauugaccagaaggaaguucugguugaugauucuuccuucagagacagcaggggcugggcagucgggucccuucaggugaagggauuacagaguaauuagauaugauucaccaucugucucaaaguaguaucuucuuguauuuuuuauauuuauaucuguaacuguagacagaaaggaaauugcccugaaagaaauaacuggccaguaaguaauuaggacuccaauggagugaaugagccaugugucuuauguguauaaaugaccuauuuacccauguugcuaacuuucaugugcuuauaaacaaguagauguuaacacacucccgauguauaugacaaccuccguggaggucauauggaaacaugcgggccuuccacuacggccccgccgcugugcugaguguuguaugcaugucuucuguacuucucaaaacaaccuggcaagguagaauuauaauccucauuucaaagaugggaaaacugugacuuagaggcuaaguugaugccccuacaaauuucaauuauuuaagaaggagacuaaggagagagaagauagcuggugacuucagacccuuuguuguucugaaccccaaacuuuccugccucagucuauaagcccaaggcccugugguuaggcuuaguagguucaauuauuuuagcaggcuguuugaagaagauguagugaucccaauccacuuccacucagaggcacaccaaaguauuuguuccagccacauaggauacuuuaccuuugaggaguuuagggaaauucauuucugcuaucuuaucugugaagaguuuagggaaauugauauucugcuguaucaucuccuaucuuccaugguguuuugcaguccuucuagcugggaguucacaggagguugaccagauggccugcuguucugagugauuaauuagaggguuaagcaucuagggaguaucuaagcaaggauuugaacuugaguacaucccacuucagagcccaugccucugagcacucuccuuuauaugauaugaagcccuggggaggccucugguuggaggaagcaucugcagugagugaaggugcccaggacucucaggccugcagcccugauuugcacagugagagcuggcagcagucuagugggcauggggguucacagauaccagguucuggcagucugagcuguccauggucagcugugggggccaacaccuccuucgucuguacugcucagucucuccagagagaggccagcagcuguucuuccauguccuguuuuauaccaaaucagaaagaaacugaccucaggaaggaaauuugaggucucccccagaccuguauaacucaugugcauuuucuuuacaugucucauugggcuggccuccauccucccaccucccacugccaucauggaaaucaucucucacaaggccaaauagcccaucuaauccucuagacuuuggccuguaguggguuccauaaggacuccccuuggucuuucacagcauaggacaaucaggagcuuguugcaaauauucacuuggguggaagucaagggaaagcaaugagaauauacaugaagggaacaauucucaagacaacuggugggcaaauggacgcaaacuuagcccaagacaugaaagaauaacaaauaccuccaagauuuugguccuggggaaaugaagguugugcuauaaaaagaacgugaaaaguuagauccaguuuggauaucuugacuuugagaugcugggacauucaaauagacugccaacagaagcauuaggauuuuaucggggugagaggucaaaaccagagucacacauuuauaagccaucugcuuaacugcgaugguuacagcuugaggugagcuuucuuaggaugagagaggggugugcaaaggacugagaacuguaaguucaggcugaaaggcugcaagggggccagaaaugagcaccauggcuggagaguuaagaagaaagccacaguaagguaguguccugagccaagacucaaagaagguccuugggguugggcuuaaaguuguaguuucccaagcccccuccacaaaacaacucuauggugauuuuaaugcacccagugauaauaucccaaaaugaaucacuagacacuuuggcauagucauuuuuuuccuauuagaaguggguuugacuggcuagccauauaaagaagaauggaacuggacccccuaccucucaccauauacagaaauuaacucaagauggauuaaagacuuaaauguaagaccucaaacuauaaaaguccuagaagaaaaccuaggaaaaacucucuggauguuggccuaggcaaaaaauuuaugacuaaguccucaaaccaaaugcaacagaaacaaaaacagacaaauaggacuuaauuaaacuaaagagcuccuggacagcagaaguggguuugacuuugucaauaaagauuuucuacuuaaaucgucaaacguagcuuaaaaaauuauuaacugcauaguuaaauauaaaacaguuccuauacgaccuuguuuauugcuagauuagauacaucgcauagguggaauccacauaguaaguauacaaugaguacuaaauguguaauagcauuuggucaacaaguggaacgcugcaaaucuaugaccuucuagguuuuggucccauuucaguugaaaagggaaaaugaacaauuaugaguucccucauaaauuaaacucugguacccaaacuacaacaaaugguuaaaagccugggcuuuggagucaccugcaugugauucagaauucuguccucauuaguuaacuaccugugaauauuuggacaaguuacuuaacaucucugaguuuccucaucuauaaaauggaaugcuaauuguacgucagccacggaguugcugauagaacugaauaagauaccuaaauaaaauuuuucaaguaauaugcuuagauagcuaagcagcacauucuguaaauguuagcaagugauuuuaucaguaucauuauuacugcuuccuuuuauaggggaaaaaauuccaaguccauauguguuuuucucauuaacuuaagugacuuugccuacccaaagucugguacagguuauuucugcaauaguauguucaaaaucagaaauaucauguacuguuuuuaagucauagagcuauuuuaauugauacucguaucaucaaagguugaaaaugugauaauaacaaacaacaauaaaaggugcauguucaacauuacuuucaaaauauauauagauuuucuuucuuuaaaacaaacauaauuuuuaaaaauaucagauuguuuaugauaugaagucaugguuacagucacauugcaguuuaccaucuguucuuguccaaaauacagguccaaguuagagccagaauugcaaaacgacaguaaaugucuguuggucucguacaaagcucuucucaguuagaccauacuuaaacauguaauauauucauauaaaaaugaauguagaguuaaacaugaaaaucaaucaaugcaauauaucauaugaauagaacaauagacgaaaaccacaugggcaucucaacagacauagaaaaaggauuucacaaaauccaacaucuuuuuaugaaaaaaaacacucaacaaaauaggaauagaaaggaacuuccccaaccugauaaaguguaucuaugcaaaacccacagcugacaucacacaugcugaugaaagacuaaaaacuuuccgccuaagaucaagaaccaaaaaagauguacugucaguucuagccagggcaguuaggcaacaaaaauaaauaaaaggcauccagauaggaaaagaagaaguaagacuauuucuauuaucagaugaucuacucaaagauagacaauccuaaggaauccacuaaaacacuauuagaauuaauaaaugaguucagcaagguugcaguguacaagaucuguuguauuucuacaaaccagccauuaacaauccaaaaaugaaaucaagaaaaaaauccauuuauaguaguaugaaaacgaagcaaauacuuaggaauaaauuuaacaaaaaaagugcaagacuuauauauugaaaacugcaagauacuguugaaagaaauuguuaaagaccuaaacgaauggaaagacauccuguauucaugaaauggaagauuuagcauuguucaaauggcaauaucuuugcaaagcaaucuguagauuaaguacaaucucuauagaauucaaccugucuuuuuugcagaaaugaauagggaacccagaauagccaaaauaauuuuuuuaaagauuucuuauuucaaaacuuacuacagagcuauaguaaccaaaauguugugauacaggcauaaagacagacauaaagaccaauggaauagaacacagagcccaaaaauaaacccuaacauauauggucaaauaauuuucaacaaagaugccaaaaccauucaauggggaaggaacaagccuuccaguaaauggugcuggggaaacuggauauccauaugccaaacaaugaaguuggacccuuaccuuccacccuguauaaaaguuaacucaaaaugaaucaaagaccugcacagaagaccuagaacuauaaaacucauagaaaauauagaggaaaagcuucacgacauugggucuggcaaugauuucuuggauauauaccaaagguacagguaacaaacaaaaaaauagauaaauuggaauuaaaaacuuuccugcaucaaaggacacuaucaacagagugaaaaggcaaccuacagaaugggagaaaauauuugcaaaucacauauauaauaagagauuaauagccagaauauauagagaacuaaaauucaacaacagagaacccaacaacacaauucaaaaaugggcaaaggacuugaaucgauguuucucuaaagaaaaugugcaaauggccaauaagcaugugaaaagaugcacaacaucauuagucguuaggaauauuaacaucaaaaccauaaaguacaggacgggcauggugacucacgccuguaaucucaacacuuuaggaggccaagguggaaagauugcuugaggccaggaguucaagcccagccuagucaacguggcaagaccccugucucuauuuuaaauauauauauauacauauauauauauauauuuauuuaaaacuauaagguaccacuucacccacuaggauagauaauugggggaaaaaaaaguaagaaagaaaacuaguguugacaaggauguggggaaauugaagcccuaagcauugcuguugggaacuuaaauugguacaaccccuguaggaaacaauuggaauguccuccagaugcuaaacauaggaguuaccauaugauccaacaauccacugcuaguuauauacccaagagaagugaaaacauacauucacacaaaaauuuuauccaaaugcucguaacaacauuagucauaacagccaaaaaauguaaacaaaccaaauguccaucaacugaugaauaaacaaaaugugguauauacauacaauggaauauuauucaguuauuaaaaagaaaugaaauauuuauacauauuacaacauugauaaaccuugaaaucauuaugcuaagugaaagaagccagacacaaaaggucacauauucuaugaucccauuauaugaaauguccagcaugggcaaauccuuagggacagaagguagacuagugguugucagggccugggugagagggacugggggaguggagugauggccaacauauacaggguuacauguuuuaggaggugauguacauguucugaaauugauuauggugauaguuacacaacucugugaauauacuaaaaaccaugaauuguacacuuuuuuuuuuguucuuguuuuuuaaaaaauacagaaugcuucacaaauguauaugucauccuugcgcaggggccaugcuaaucuucuuuguaucauuccaauuuuaguauauaugcugcugaagugagcacaaauuguauauuuuaaacuguacacuuuagaaaguuaaaaaaaaaagagagagagagagagacagggucucacucuguugcccaggcuggagugcaguggcgcaaucauagcucacugcagucucaaacuccugggcucaggugccccucccaccucagccucucaaagugcuggaauuauagaugugagcuacugugcccagccuagaaaauaaauguuacgguaugugaauuauaucucaguuuaaaaaaagaauggacauaaauagcuuagcaauguuuuagcaugaaagaauuuaacucugagaauguucugacaucuugauggggugugauaauaaugccacaguggaagggaugugaauauuaacagaaaaaaaaacuguuuuccucuacacucacaacacuucugacaccaaaugugugggguuuuccauaccaagaauguauucuccgucucuccugacaccaacugggcgucuuauaacacaauucugacauuuuccaccuggagcuagcaucagacaccacggguuaaguaggggcucagugccacaggauugcucccacuucagacaccaaucacaaguccugggccuuugguauuucugaccaaauuggcuacaaacugggggucuucaugacugucuucugagguucgaucauuugcacuaaugggcucacagaacucagggaaacacuuuacuuacuuuaccaguuuaugauaaaggaugcaaaugaacagccagaugaagaggugcauagagcaacguguggggaaggaaguguggagguuccauacccucucugggugaccaccuucccagcaccuccuuguguucauucacccagaagcucuguguacgccauaguugaggaauuuuuauugaggcuucaucaccucagcaugauuaauuuagucagucuucaguuccuuuccccucccuagaggaugguggguggggcuuaaacuuccaagcuuguaaucaugccuugguuuuucuggugcccagcccucgucuugaagcuauccaggaacccaccaaaaguuaccucauuagaacaaaagacacuccuaucacuaggaaacuccaagagauuuaggaccauauauuagaaaaaaacaugcuccuagaguuuuaggagcccuaugucaggaacugggagcagagaccaaauauauauauuuuuuauuaugucacacauauucuuuucauagagagaagagcugacgaguuaagaacagccuuuuuuugguguuuuuuggggggcgaggucuuuuuuaaauugggggauucauuaguacaguguguggcaggaugauacagacauuuuauaugaguaagugagguaucacuugggaucuuaaaaaauauuuucuuuuuauuauggugggcaccacaccaaagggugcaaguugcagguuauaaaaacaaagcaaaaguuuccauagccugaaaugguuggaaauaugacugagucuccucgucgagcuucuaagaugaaaggccccagaauucccucuuccucuugcaaauguugaauuaaugaugauaauaagauggcugacuauugagggcugaauguguaguaaacauuacaugcuuuuucuuguuuuaauuuccccaucaucacugugacauacccauaguuguuuagaacauacccaaggucaugaagcaagucaacaacugagcugggcugcgaucacacauacaugugagucccaagaucccacucuacuucuacucugggggagcugcccccaggagcuuacagcaccugagauccuaaccacaccaguaagggaggcaguagaguauggaggcagugcccuggacugggagucaaggucccugaguucugguccaccuuugccacuaaucagcucugugaccuugggcaagaggcuuggacaagaaguucagaggcaugguuuucugauguguaaaguguggaaaauucaucccagcuaucccuguaguuccuuccaacucaggcauucagcccaaguccugccucauucacccucugauuuguacauugagacuaaaaggaagaaaaccuucgagucaguguaggcuggugauuucaagaugcuggacuuugguguugggcugauguggcacugguuccauuauuuaucucagugugauguucagcaaguucuuuaauuguguccccaucugcuaaugggaauaauaacagcguggggugcugugcugucuacauagagugguugugaggauugagugagaucucggaagagagcuuuaaugcaauuccuggcacauuguaaguacugagauguuauauuauuauauguuaaauaauauuauaauuuauuuaugaugaugauuguugauuguuauaaaacagagacacagaauccuuucagaauaauuaguguagguuagcucacccaggucagacuuuggagcucagauugccugcuuaugcugaguuuugaaaccauuccauaucuagaagguuagccauaccucaggacuaugcugcuggguaagagggcaucagauugucaccaaaaacacuccagaguuccccucuuguaaacuuugagucaguaaugccaucuuccccuauaugagacaacacacuauuauaacuuacugugugaauuuugacucaaguauuccuuuuuacccaauguaaucagaaauagaugagugaucagugacagauacugauaaaacaguuaauuaauuugccauaaaaagaacagaugagaaaaugcugcucccuggaaauuucccaauguggguagggaauuuuucucuuucaauguuauuuaacauaauaagcacagauaaaguuauauuuacaagauuguuuaucacgguguuauuauaaugguaaaaaguuguaaauauaagagccaucgaaaaucuaauauucaaagaauagcuucagagucgggggaaaagugcacuauagaguuuuuuuaaguuagaaaaaaauguguucucugauccuaauuuugugaauauuguguguguuuauagaaaaauaugaaauguaacaacaaaaacauuagcagagauuaccucuggguaugagauuauuauuuuaaauuuucuucuucuuuuucuuuuuuuuuuuuuuuuuuugagacggaguuucgcucuuguugcccaggcuggagugcaauggcgcaaucucagcucaccucaaccuccgccuccuggguucgagcgauucucccgccucagccucccacaaauuuucuucuuuauacuucuuuauauuuuccacguuuucacagugagcauguuucuuuggaacuggagcaaaaguuguuuuuuuuauuaauggagauucugucaacuuuuuucuuuuugcucuaaggcucuucugucugguagauuguuucaucugaauaugucuuaacacucagucugaauauauuggguuuuuuuucucuuuuaaguacugacuuagaaguaauaugcuucauugauuuugugagcucaucuuuuucauguaauguucaggacaagccagacacauuuguugcaagacggauuuuguuacuuugaaaaccaauaacagauaauaagauaaaaucaccaauuaaccaaacuuuuucuaaacccaucacuucccuguugaaagcaauuuucagcucuuccugagauucauguauuuaagucagcucugaaucuucuauaagaagaaaucaauauucuucucucucucucucuuauuuuauauaauuagaauuguaccacuaaaggacuauuaaaugugcaauugagaaucuaauacuuaaaacaagucuacaaaguuaauucaaagcaaaggaaaauggauagaguagauagaauaaguuuuuccuacuuucuucucuaauuguaacuuuuuuuaaauaugcuuuaaguuuuaggguacaugugcacaacaugcagguuuguuacauauguauauaugugccauguuggugugcugcacccauuaucucgucauuuaacauuagguauaucuccuaaugcuaucccucccuccuucccccuccccacaacaggccccgaugugugauguucccuuuccuguguccauguguuuucauuguucaauucccaccuaugagugagaacgugcgguguuugguuuucuguccuugggauaguuugcugagaaugaugguuuccagcuucauccaugucccuaaaaagaacaugaacucaucauuuuuuauggcugcauaguauuccaugguguauauaugccacauuuucuuaaucuggucuaucauuguuggacauuuggcuugguuccaagucuuuccuauugugaauagugccacaauaaacauacguguacaugugucuuuauagcagcaugauuuauaauccucuggguauauacccaggaaugggauggcugggucaaaugguauuucuaguucuagaucccugaggaaucgccacacuaacuuccacaaugguugaacuaguuuacagucccaccaacaguguaaaaguguuccuauuucuccacauccucuccagcaccuguuguuuccugacuuuuuaaugauugccauucuaacugguaugagaugguaucucauugugguuuugauuugcauuucucugauggccagugaugaugagcauuuuuucaugugucuguuggcugcauaaaugucuucuuuugagaagugucuguucauauacuuugcccacuuuuugaugggguuguuucuuuuuuucuuguaaauuuguuugaguucauuguagauucuggauauuagcccuuugucagaugaguagauugcaaaaauuuucucccauucugcagguugccuguucacucugaugguaguuucuuuugcugugcagaagcucuuuaguuuaguuagaucccauuugucaauuuugucuuuuauugccauugcuuuugguguuuuagacaugaaguccuugcccaugccuauguccugaaugguauugccuagguuuucuucuaggguuuuuaugguuuuaggucuuuaauccaucuugaauuaauuuucguauaagguguaaggaaggcauccaguuucaguuuucuccauauggguagccaguuuucccagcaccauuuauuaaauagggaauccuuuccccauuucuuguuuuugucagguuugucaaagaucagauaguuguagcuaagcagcauuauuucugagggcucuguucuguuccacuggucuauaucucuguuuugguaccaguaccaugcuguuuugguuacuguagccuuguaguauaguuugaagucagguagugugaugccuccagcuuuguucuuuuggcuuaggauugacuuggcaaugugggcucuuuuuugguuccauaugaacuuuaaaaguaguuuuuuccaauucugugaagaaaguuugguuccauaugaacuuaaaaguaguuuuuuccaauucugugaagaaaguuauugguagcuugauggggauggccuugaaucuaugaauuaccuugggcaguauggccauuuucacgauauugauucuuccuauccaugaguauggaauguucuuccauuuguuaguguccucuuuuauuucacugagcagugguuuguagugcuccuugaaaagguccuucacaucccuuguaaguuggauugcuagguauuuaauucucuuuguagcaauugugaaugggaguucacucaugauuuggcucucugucuguuauugguguauaagaauacuuguaauuuuugcacguugauuuuguauccugagauuuugcugaaguugcuuaucagcuuaaggagauuuugggcucagacaaugggguuuucuagauacacaaucaugucaucugcaaacagggacaauuugacuucuucuuuuccuaacugaauacccuuuauuuccuucuccugucugauuacccuggccagaacuuccaacacuauuuugaauaugaguggugagagagggcaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaagggcuguugaauuuugucaaaggccuuuucugcaucuauugagauaaucaugugguuuuugucauugguucuguuuauaugcuggauuacguuuauugauuugcauauguugaaccagccuugcaucccagggaugaagcccacuuggucaugguggauaagcuuuuugauguacugcuggauucgguuugccaguauuuuauugaggauuuuugcaucaauguucaucagggauauuggucuaaaauucuguuuuuuuguugugucucugccaggcuuugguaucaggaugaugcuggucucauaaaaugaguuagggaggauucccucuuuuccuauugauuggaauaguuucagaagaaaugguaccagcuccuccuuguaccucugguagaauuuggcugugaauccaucugguccuggacuuuuuuugguugguaaccuauuaauuauugccucaauuucagagccuguuauuggucuauucagagauuuaacuucuuccugguuuagucuugggaggguguauguguggaggaauuuauccauuucuucuagauuuucuaguuuauuugcauagagguguuuauaguauucucugaugguaguuuguauuucugugggaucggugugauauccccuuuaucauuuuuuauugcgucuauuugauucuucucucuuuucuuuuuuauuagucuugcuagcagucuaucaauuuuguugaucuuuucaaaaaaccagcuccuggauucauugauuuuuugaaggguuuuuugugucucuauuuccuucaguucugcucugaucuuagcuauuucuugccuucugcuagcuuuugaauguguucgcucuuguuucucuaguucuuuuaauugugauguuagugugucaauuuuagaucuuuccugcuuucucuugugggcauuuagugcuauauauuucccucuacacacugcuuuaaaugugucccagagauucugguauguugugucuuuguucucauugguuucaaggaacaucuuuauuucugccuucauuucauuauguacccaguagucauucaggagcagguuguucaguuuccauguaguugagugguuuugagugaguuucuuaauccugaguucuaguuugauugcaccguggucugagagacaguuuguuauaauuucuguucuuuuacauuugcugaggagagcuuuacuuccaacuauguggucaauuuuggaauaggugugguguggugcugaaaagaauguauauucuguugauuugggguggagaguuuuguagaugucuauuagguccgcuucgugcagagcugaguucaguuccuggauauccuuguuaaccuucugucucaucgaucugucuaauguugacagugggguguuaaagucucccauuauuauugugugggagucuaagucucuuuguuggucucuaaggacuugcuuuaugaaucugggugcuccuguauugggugcacauguauuuaggauaguuagcucuucuugcugaauugaucccuuuaccauuauguaauggccuucuuugucuccuuugaucuuuguuggucuaaagucuguuuuaucagagacuaggauugcaaccccugccuuuuuuuguuuuccauuugcuugguagaucuuccuccaucccuuuauuuugagccuaugugugucucugcacaugagauggguuuccugaauacagcacacugaugggucuugacucuuuauccaauuugccagucugugucuuuuaauuggagcauuuagcccauuuacauuuaagguuaauauuguuaugugugaauuugauccugucauuaugauguuagcugguuauuuugcucguuacuugaugcgguuucuuccuagccgugauggucuuuacaauuuggcauguuuuugcgguggcugguaccgguuguuccuuuacauguuuagugcuuccuucaggagcucuuuuaggguaggccugguggugacaaaaucucuuagcauuugcuuaucuguauuuuauuucuccuucacuuaugaagcuuaguuuggcuggauaugaaauucuggguugaaaauucuuuucuuuaaaaauguugaauauuggcccccacucccuucuggcuuguagaguuucugccgagagaucagcuguuugucugauggguuucccuuuguggguaacccgaccuuucucucuggcugcccuuaacauuuuuuccuucauuucaacuuuggugaaucugaccauuaugugucuuggaguugcucuucucgaggaguaucuuuguggcauucucuguauuuccugaaucugaauguuggccugccuugcuagauuggggaaguucugcuggauaauauccugcagaguguuuuccagcuugguuccauucuccccaucacuuucagguacaccagucagauguagauuuggucuuuucacauagucccauauuucuuggaggcuuuguucauuucuuuuuauucuuuuuucucugaaauucucuucucgcuugauuucauucauuugaucuuccaucacugauucccuuucuuccaguugaucaaaucagcuacugaggcuugugcauucaucacguaguucucgugccauaguuuucagcuggacuucugugcauugguuauucuaguuagcuauucgucuaaucuuuuuucaagguuuuuaacuucuuugcccuggguuugaacuuccuccuuuagcucagaguaguuugauugucugaagccuucuucucucaacucgucaaagucauucuccauccagcuuuguuccguugcuggugaggagcugcauuccuuuggaggaggagaggcacucugaauuuuagaauuuucaguuuuguuguucuguuuuuuucccaucuuuguguuuuuaucuaccuuuggucuuugaugaugugacguacagaugggguuuugauguggauguccuuucuguuuguuaguuuuccuucuaagagucaggacccucagcugcaggucuguuggaguuugcuggagguccacucuggacccuguuugccuggguaucagcaccagaggcugcagaacaguggauauuggugaacagcaaauguugcugccugaucuuuccucuggaaguuuugucucagaggaguacccggccgugugaggugucagucugccccuacuauggggaugccucccaguuaggcuacucgggggucagggacccacuugaggaggcagucugucuguucucagaucuccagcugcgugcugggagaaccacuacucucuucaaagcuguuagacagggacauuuaaguccgcagagguuucuucugccuuuuguuugcccugcccccagagguggaguguacacaggcaggcaggccuccuugagcugcaguggacuccacccaguucgagcuucccggcugcuuuguuuaccuacucaagccucagcaauggcgggcgccccucccccagccucgcugccgccuugcaguuugaucucagacugcugugcuagcaaugagcgaggcucugugggcguaggacccuccgagccaggcgugggauacaaucuccuggugugccauuugcucaguuggaaaugcagaaaucauucaucuucugugucacucacacugggagcuguagacuggagcuguuccuauucggcugucuuggcuccaccccccucuaauuuuagcuuuaaguaacuuacaaaaaaacaguauuaccauauauauuggaaaaaaaucugaacaggccaaaaaaagcugaaccagguuuuugagcaugagaagauugagauuuuguugccuugaauuuuuuggauaucguuuugaucuuuuuuuuuuugagacggugucuugcucuguugcccagguuggaaugcaguggugccaucucagcucauugcaaccuccgccuccuggguucaagugauucuugugccucagucucccgaguagcugggauuacaggugcccaccacccaccuggcuacuuuuuguauuuuuaguagagacgggauuucaccacguuggcaaggcuggucuccaacuccugacaucaguugauccacccuccucgccucccaaagugcugggauugcaggugugagccaccaugccuggcucauuuugaucuauuuucaaaaguacuguuauaugugcauuacaaaaaaguugagcaaaacagaacuguguaaguuauacacuauuauuuguuugguguucacuggacagauaugcaacauauaccuauauuuacaaaauuauuuuuuaccucaauaggauaauauuccauuguucucaacuugcuuuuuuguccuaaauuuuuugugaaauaaauucaguuucaguacauauacauuuaccucacuuggucuauauuuuugcaagaguuucuguuggauaauauccuagaaguaagauuucuaguacaaagaauacacguuuaaaauuuuguuuugccucucaagaaagcuugugcccauuucaccaccccucacauggaaugagaaugaaagauaaaguuucugaaacauagguacauggagauucugccggguuuugauaagauauaauuuaaaaucaugaucagaagguugcucagcuggcuuggggaggagaugccuucuaaagucagaauccuguaagguauuccugccuaacucuucaacuccauucucuacccagaagagaaaaaagguguguguguguguguguguguguguguguguguagaaauaugucuccucugcaaaggaucccucaaaaugcugaguguaacagagggcagauuuuuggagucagagcugcaauuaaauuucagcccugucucucaauagcagcuugucuuuaagcaaaauguuuaacauuucugaccuguuuuuuaucgucuauagcaaggggauaaucacaccaccuuacaggguucacugugagaauuaaauguguuacuuaacacaaaaggcuaauaaauggugaggacuaagagcucaauuaauggcuuccauugagacaugagaaagggugauuaugaccaagcuacgggcaccuuggaggguaaaguuuugcccacuuuugcagaaaaauaugagacaaucacuaacagucuaguuaagauaugcuaugugggccaggcaugguggcucacaccuguaauccuagcacuuugggaggccaaggcagguggaucaccugagggcaggaguucaagaccagccuggccaacauggcgaaacccugugucuacuaaaaaauacaaauauuagcugggcauggugacacacgccuguaaucccagcuacuugggaggcugaggccggagaaucgcuugaacccgggaggcggcgguucgugccacugcacuccagccuggaugacauagcaagacuucaucucaaaaaaaaaagguaugcuauguaacacuacaccuuucccaccuacauccaggaacccucuuugauuuuaaccauaacaauuuuaucaccuucucauaugcaucauuacucauuuacuaugcuuauuguuuauguccuuuccuaggguguuccauaugaacaaaacuuuauucuuguucacuaaauuucaacaucaggguagcugaaaacaaagccuggcacauaguaggcacucuuuuuuuuuaauuuuauuauuauuauacuuuaaguuuuagggguacaugugcacaacgugcagguuuguuacauauguauacaugugccauguuggugugcugcacccauuaacuugucauuuagcauuagguguaucuccuaaugcuaucccuccccccuccccccaccccacaacaguccccgguguguucucauuguucaguucccaccuaugagugagaacaugugguguuugguuuuuuguccuugcgauaguuugcugagaaugaugguuuccagcuucauccaugucccuaauccuguagcugggauuacaggcacccacugccgugccuggcuaauuuuuuguauuuuuaguagagacaggguuucaucauguuugccaggcuggcuuugaacuccuggccucaagugauccgccagccucggccucccaaagugcuggaauuacaagagugagccacugcgcccgaccuagaaugacuauuaacugaagaauaugggacugagagcaaacaaugagguggauaauuuuauucaccagaaacuuucuaaaaagagaagagccacaguguccaguggguuuuaugaacuuugcuucauggaucaugaggaaggaccagggguccuagagcuacucgguuuuaaauccaucuuccaguggcccauguuguuagagagcaaggcccagaggugaguuacagcugagcacuagggcaauguguccuaugaagaggaaagaggacauaauagggagagcucagcaaggaugagggaaagugggaaguguuuuuaacagcugcuaaaaguauggaacuuagaagacaaagaauuaugccccaagaagacuucugggauguuuuuugugguacacaauaugaaaucccuggguauuccagcuuuaaggaaaccuacaugaaagguugacauuguuucaaagcuucuagcauucaauuuguguuccuuugagugugaugucaugcuuauacugagauacaugcuuauacugggaccgccagauuuauuaggguuacacugaccagguuucuuuuuauucuuuaauuuauuugggccucucuuauugcuguuucccaccagucacuagacuuguuauucauuguaacagcaugugauucauaucucaaauguauugcaguuucccauaugacaucuuaucuuacauuauuugcauauuguauuacauuaucucuucucuuauauauuagagaagugacuggaguuauuuuuauuuccucugcagagugcuauaguucgagaucaugucuuagaguugguuacuucugagaagaguucuuauauuuggcuaauuccacuguacauauauuaucaguaucuagaaauuucgguuggccucuuucaucaagccacauucugauucaauuuucaggaaacuuaggcaguuucuaaacuauucagaaagcuggagggggaggccaucuaggguagauuuaagcaucaaccugauuuuaauuuuuuuuuaauaugagcuuagauagaaccaaauauaauuuaauagucuccauuuuuuguuacagaagauuuuugguaauuugguccaaaagauguauuaaaaugcuuagagucaaccaggaccaaccugguuuccauuuuucugucccauguccucauugguuuaguaauuuggccagagagcauggccugauuuuuugaucagaagauauagucaccauacucauggaggaaggaaucagggacuguggguuaccugguauagaaggacauagugaaggaaaagauagagagguuuggaguuuaaaggauaagggaugucguuuuuguuaguuuuuaaggaaaaaggaaacugaacauuuggguaugcaaagaagucaguagaaagugagggauuaaagguggagauaaccacugaagcaaguucuggaggagacaaagguagauuuaaucacaaaccugggugggccuuggagaggaggaaacacaugccauucucagggaagcagaagauggaagaaauauaagguaucugaauugaaggaguuucugacaugaccuacacugucucagcauaguuaagaaacagucgaaugacugugaggaaagcaaacgcagguuugggaaugugagaagaauagaaaagaggauagugaguuguuuaggaaaaaauaaauaaguuugugucaacuuugagucacccugagggccuagcugaaguuagauaauaggaauuagcacccgccccaucacuaaguagcauaauugucagugucaucauacagcagcccagaagccaaggaauggaugguuugagucugcccagcacuggggauugggacaugccugugauggaaagucaagcugucuucuuagggaaucucuggcuggugagugccaucuaaaaugcuuaucguagcaccagacgaaggccaaggaacuagaaguuugcugaggacagagaaauuuuguuagacagaauaaaagggaagaaagaagucaaauucagggaugaugacuucagaguuuaauaauacagacaugaagcaguuuggagugauaauuccaaaguuuucugcaauggagauuuagaaaagagucagagaauacugaggucugaaugugaaggaagucauccuuacgaacuuugcuguuacccaguguccaggcuggaugacagguauuuccaggaagagaaugagugacaugaauaugugacauuuccccaacucaggugaccacaaaacuguuuuucuuguaaaugccaguauuccagagaucauucuuuggaaaacucuguucuagggcucaucagagacuuuccguuuguugaaugaaugaauuacagguaagaaguuaagaggcagccugggacagugucaaaauaaagagaaggcaaguauguggcucuaauuacagaaaucauuuugagccuaggcauccccuacucugguacuuccaucucaugaacugccaccuucucuccugcaucccucugucaccuucuugcuaccaguugugggccaggcaguuaagauuuauuuauuuagauacaucuccuuauuaccuauuccuuucuuauguuuguagaugguucuguucuugcaaacucccaaauagauaucagugaaaucaaagccacucuuugagggugacagguuggcagagaauaccaugacauuuugaaaccuuuuguccagagaguccuuggguccccagguguccugccuauuuacacauaauaugcauauacauauucuucaccacacagccuucuuuccucuuccauuuaaguuggcuaugcuuauaccuacccucauuucaugucauucugaugguaguuagcaaaggaggauaaggaagcaaaugguauuuuacaaaguaucauaguaaacugguuggggaauuaugugcuagauuaaugcugcugcugaaaauggaaaaccaacccuaccaccaccaccaccgccacuccacccccaccucauuaggugacuagaagacaaauaggacagauaucagaaaggucuuuguaaaaagaaaaauaguacagaacucuucacuaagcagaggauuugguuaaagaacauacaagauuuggaauggcucucaaguaaauaucuguugcaggggacaccagauuugauguaaccacgacuucuguugcuuuguuuuagaacgccagccaggccccucuguggccaauuccaaugcccucccuucaaguucagcugggaucagcaaggagcugaucgaucugcagccucucauccaguucccagaggaagucgccagcauccugauggagcaagagcagacuauuuaccgcagggucuugccagucgacuaccuuugcuucuuaacacgggacuugggcacuccugaaugccagagcuccuugcccugccucaaagcauccaucucagcgucgauucuuaccacucagaauggagagcacaaugcccuugaagaucuggugaugagguuuaaugagguaagaagccacuuuuugaugucuugguauuugacucacccguaagugauuuucaagcauaccuccccuucuagguuugucuguuccugauguguucauuucauucugucuugccacuuccaugauggcuguuuuucuuuccaggcaaagagacagacaucacauugcaauccuuccucucacuguaccccaacuugcccuuaagccuaauugaucucaacuccauucuauugcauuacccaguccaccaauccuagucccuuugggcacccagaaugccaaucuccaaccccuuccucuccccuaccaaccccucauucccaaaggugcuuuuaaaaccacaugucucaauuuugaguuuugacagcaugaucccugaccacauucguauaaccaacccccugacccccuuccauuauuaggacucccucagcagaaacaccuaggucaccagagaaggcaggaaacguggggcaauucauugaggggcagugaaucaccucgguucucucucugcauccccugaagauccucagccccagaauaucaauccaaagccucugagaccacauuagaagccaguucugaagaagacaggugugacuggagucugggaauacuuaggacaaagccauugcgugggggucuagggacucacugggagaucaagagccacuggcugacaucccuguggcccugggauagggaggagcgucaggaaagagcagggagucuccaugcaguacugggguugggcggacugcacucuugggcuuaaaaggcacuuucucuuaguaauguaacccacacccagaguuuucuauucuacauuuuauguuuuagauuuaauuucuuuuguuuuguguauucaaucacaaaauuuuaauugguauguuuguugguuguuaguuggcugaacacagaguaguugccuauuuuggucauuuaguaaacucuaccuaaaugcuaacaggauauuccuauucugagucauauauaucucugauugucugaggaucugucauccuguguuacauaaacacuuucuggcaaggugcgguggcucaugccuguaaucccagugcuuuaggagggugagacaggaggaucgcuugaggccaggaguucaagaccagacugggcaaaauagcaagaccuugucaguacaaauuuaaaaauuagcugggcaugguggugcacaccugcagucccagcuacuguggaggcugagacccucuaaggaucccuuagcccagaaguuuagaggcuucagugagcuaggaucacgucauuauacuccagccugggugacagagugagacaccaucuuuagaaaaaaacacaaaacacuuucuaacuguagcucacuuugcagccuccauagcuugccaaucaaaauccugaugaugguuguaaaugucagugaccaugauaaggcccaugaauacaacgaguguuagaggcugagcucaagcgguucuguauccagacauguccugaacaccagucuaucuggcacuguugugcuaaccauuuuauauguaccacuuacuugcuccuuacaacaaccuugggagacagauauugucauuagcccuaucuuaucaaugagaaacugaaguauguggagaugaaguuauuuucccaagauuacacaagugguagguggcaauuuugguuuaagcccacaaagucaggcccugggcuuugaauaacuauaggaugcugcuucccaccugcagcaggauugcacugggggguggugccugcuaaaacugcagauuccuggucccacccccaaacugaguaagacagaaucucugggaguccacaugagagcuugcaaaugucacugccccaaaguuguuuuuaaaaauaaaacuccugauguucuugauuuuccuuacugauaaaaaugggauggaaaaaugaaaguuccaguaaacugagugauuuuauuaguggauuucacuguauuucaugaauuauuuuaaacuuccagaucuacccacucucacauccuuaggacccuaucuugucuuuauuuuuaaauuucgaccugaacuuaaaagugaauugccaaaacuuuuaaaaucuaauuuuaaacuaaacuuggauuucuuccauucacuuccauaaccuugggaaucaaagacgaaucagugauuucacuaauucagaguuagagaugauaugaccuacagcuggguagaggcaggcuuuggacuaucucugaaaauaguuuagcuaagcaacuucagaacguaaacaagauuucugggaaaacacuuaaacuacuuaagagaacagucuguuucaaguauucucaagcaucuauuuucauacaaauuauggguaugcugauuaaaaaucagucuuacauagucagaucccaaaugaucucuacuggacacgacuggaauagcuaaauucuaguucuuuuguauaccuuaaaguagaaaaguuccauuacaucaaaagagaauuuucaaauucagauuuuucaccuauuuugagugaccuugccuugaaauuagcauggcuuuacauacuguaaagaaaaggaagaaauggaguuugcauuuauuuaauagaugcucuggacuggacauuuucacauuucuuaaaaucucauucaguucuuaugacaguugucaucaacccugucuugcagaugaggaaagugaagcuuaggcaacaaaauaaauaaugacaguguuggauuauggcccauagaguaaaauaaauauuuuuuaauccauaccgauauaaauacaucaguguggugggguuggggaguagggacagcacuuacuuauagaaaaauuucaauuaauaaauguagaaagaaugagaaaaauagaaaaucaucauuagaauacuacaguaauaacuguugcaggcaagaacuacugaugaauucuaaaauuauugggcaaaaguaaguuugaugagaaauaggacauuugcaaauagucucaaagcaucucuccacaagguauuuauuaauacaaaggggaaaauagaacaguggagaaacccgguagacacuggcuugaccaagugaucaaggcuaacaugauuaguaaugagacauaucaacauaugccuccugauaugaugcccugagaaaggcaggacuucaucucuauaguguucuugccaaaaacacaccacauaaaucuagcaaugaaaaaaaauaucaggcaacucuaaauugaaggacauucuacucuucaaaagcaucaaggucauaaaagguaagaaaaaauugaggaacuguuaaaggcuagaggagaccaggagacaugacgacuaaaugcagugugggauccuaguggaccauggacuagaaaaagacauuaauggaaaaacuggagaaacucugaggcucauaguuuaguuaguaugauuguaucaauguuaauuuccugguuuugacaauugugcuaugauuaugaaagaugcuaacauuagaggaagcugagugaaggguguacaagaacucucuguacugucuuuugcaacuuuucuguaaaucuaaaauuacuucaaaauaaaaaaaaauuguaagcagugagcucagagagauugagucacuugucuaaguagcugaguggauaucagaauccagaucuuucuucaaagucuaucucuucucacccagcugcuucucucuuguuaaauuaucagguucaagucuguaguaaaaccugacuugcuaauugagaauuucauuagccuugggucuccuuucccucuucccucccucucuuucuauuucuuuucaaaaucuccugugugucuaucuuuuuucuacuucucuuucugauuuuuauccaguuucccauuaucuagguuccugccauuacucccucauucauucauucauucauucacucaagagauuuauuuauuucaauuuuuuaguuuuaauuuuuguggguacauaguagguguauauauuuaugggauagagaggauauuuugguacaggcauacaauguguuauuacaucagaguaaauaggguauccaucaucucaaguacugauccguuguauuaaaaacaauccaauuacacuccuuuuguuacuuuuaaauguacaauuaaauuauuauugacuauaucacucuuuugugcuaucaaauacuagaucuuacauuuuuuucugacuauuguauguacccauuaacuguccccacuuccucccucacuccccucuacuaccuuucucacccuguaguaaccauccuucuacuuucugucuccaugaguucaauuguuuuaauuuuuagcucccacaaauaagugagaacacacagagguuaucuuucugugccuugcuuauuucacuuaacauaaugaccuucaauucaauucauguuguugcaaauuacaagaucuuauucuuuuuuauggcugaauuauauauaugugcuacauuuucuuaucuauucaucuuguugauggacacuuagguugcuuccaaaucuuggcuauugugaauagugcugaaauaaacaugggagugcagauaucucuucaauagauugguuuucuuucuuugggguauauaccuagaagugggguugcgagaucacugaagacauacuuauuggcugggcauagcagcucauaccuauaauccuagcaauuugggagccugaggcaggcagauggccugagcccaggaguuugagaccagccuggggaacauagcaaaaccucaucuccacaaaaaguacaaaaaauuagccaggcaugguggugcaugccuguggucucagcuacuugggaggcugaggugggaggauugccugauccugggaggucgaggcugcagugagccaagaucguacuacugcacuucagccugagcaacagaguaagucccugucucaaaaaacagacacauugagcaccuacuguucucucgucuucucuuuuuuuccauuggcaugucaaacauauuuuuuaaaaauaagaaauuagcaguauauggugaaaauugauguuauaagcccauacuuugauucugccaaaauuggauacacaaaauaaaugcacuuuccucaguggaaagauguauauuccuuggaauguuauaguaucuuaaagacaagaaagagaauauuagcuccauugccggugcuagucacuugggguggggggaagugaaugcauuuacucgugcauccauucaguuaauccaggacuucuuagaagcaguguacugugguagauaugcacuaaggaaaguaaauagcagucugccagaagcuaugagacauggacacaaauaucuaccaaaaaaggcagaaaguaagugcagugagaguggcaccaacagagaaggcugggguguccaggugggugacaagagcucauucugcugagcccucgagucuggggcugggucuugagagaugggaggaauagagggggaaguucauggaaauggaaggcaguccagacaagaagacaaucagacaguuuuugucaugagcaagacucaugguuuagggaggcagcuuguuccagauugcccccagaaccacgcuuaugagcuagaaguuucuauauucuaacaacucucuacacaaugacuuaacuguaaugugagaaaaaggaagaaaauuccuaauacuuuuugggcaguuuugcauaauguuuauucuuaggaaagcaugguuaaaaugcaacucaaaguacgaccaugaaauuacugaaaagguucagcuuacauuaaugaaggccuggagauaaaucauuuaaaaucaguuuggauuguggcuuggaagcaguguuuccuccccauucccccuucucaugcccuauuagacugugaugcacacacuagagaaacuucuuaaaggcagucucucuuuauccuugaaaagaaacagaagcacaaggaggggucaguccucaggcagagcuagucaagauuuguguugaacguaggcuucauccugcuuugcuuaguuugagagacaggucuucccgaacuuucuuaaucuggacaccucucuguagucauauuccugaucugaagcucuuagaagccaguguucuuucucucuccuuucagguggagcagccucacuucuugaccacccacgaaaucucucacuuugacagucucaaaucauauuguucuuuuuuccuauccuucaucuuccugcaucuagcuuauaccucuagcccacauuccuuaugaccuuacuuuuaaaaaauuccuccuaaaauaaauucccaagcccuuuaucuuuucuagaggaaaugcagaggcauuuuuauagacaauuuuaccaaaaagauuacauacuuuagugcaugcaggugaaaagagaggagaggcaaaucgagauugcagggcauccuuccucccuucacuaccucuccccucuuuccugagaagcacuuugguggaacguggagugagggggaggaucuuggcaucacaguucugaguugcuaguucucaaacuucaugucuccuuaauauguccuuugcucuuguuguguuguucaccaaugaugauuuuggggguuggaacccuucauugcaucuacagcugguccuugggaucgaucacacaagcaaauuuuugacuucauaaccugucaccacccacaccacuuccaggcacucuuuuguguaacagacaguugauaucucuggcuggaaagugauuuucaaggggccauaagcagguucacuuuuuucuauguccuaagagggcaguuuuugcuuguugggugguucuuggcaacaccauucagcagggcuucucuuucagaccagcuggucugaggguaggucaugaguccuagauugagacccccaguucuauugagaccccagcagcuucuacaaggccuccauguggcucugcccugggugucuuuuccccuccccaauucuguguggucaaccugagcauucaucagcuagcuucccugagccaugcaaucuugggcagcccaaagugacaaucaguuguugcuuguuccuucuguccaguagguuucaccagaugucaguucaacaguuuaaaggccauccucucuguaaagaaugccaagaugcagcuuaacuuccugguaaagaguaguaagaauaaauaaaccaucuggucaaagaagagccguuugagcuuucagccagaauuccuuauauacuucauagcaaugaugaucgcuuuggcagauuccagcaucuaaaagccugucuggucauagcuauggaaagaccauuucagcacaguaagcagaaagcauagcauauuauaacgaugugaggcagugucauguccaaauagguucuuucacuugaaauguuuuagaaaaaauauugguuuuugaauuuguauauugaaccauguuuagaaacgucucaaucaaaguuuucccccucuuuuauaaaagcagacagcagagcaaaucaucuguucagggcugcuuuacaaacuuccuuccucaaaucugaacacucacaggauaaacugcugauaaaaacccccucaggguaagggaaauuucagcucacuuuggaaaaucaaauuuuuccuugacaaagcacaucuccccucucagagcagauauuguauucuuucccuggaacauuucacagcacauuccaggaguaacagauauuuuacuccagaaauuucuugacuaaaaaaaauacaguaggcaaauaaacuacagaaacucagcugugcagggcggcauccuaagugcaagguuagcuguagauggcacuuccauccugaagcugauugacagcaaaucaugucucaugguuccuggcagucagcacccacacagggcuuuccucacccagaguaacacguagggcugagaaauaagaggggcauggaggcuugacaucauucaggugcagcucuggagucaggcugccuggguucugauccaccauucccagcugugcaaccucaagccagauaccuaacccuucaucuuuaucuuauuuuuauuuuaguuuaguuuuuuuuuuuuuuuuuugacagggucucuguugcccaggcuggaguacaguggcugaucuuugcucagugcagccucagccucucaggcucaagcgauccucccaccucagccucccaaauaguugggacuacaggugcacaccaccucgccuggcuaauuuuuguauuuuuaguagagaugggauuucacuguguuguccaggcuggccucaaacuccugagcuccagagauccaccugccuuggccucccaaugugcugggauuucagacguacgucaccacacccggccuaaucucucaucuuuaaauggggcuaauaauauaucuaccccaaaugcuuuauaugaguauucagagaaaugacauguuuaaagcacuuaucagggaccaaagacacaguagugguuugauguuaguucccaaaaaaaaaaaaaaccacuaacauaacagcauuauuagaauaacuaaugauaauaaauuccguuuuuuauuauuaugaucacccccacuuaacaggugagaaaacugagacacagagagacuaaaugaaugaccugugguuucagaggugacaguugaacccaguuguucuggcuuccagagccagcauucuuggcucaucugcuugauacuuuugaaucaaaagcugagggaccuucuuuccaccacucgguucucuuacucuaaaugaaaccauuuuccucgcaauaggauucagaauuuuuuuaugauuucaauauguguaaaaauguugaccuguuuguugauuuuaaccuaugugcugacuuccugauauuguaaaugcagcaucuccuuugaacuaggagauuguggcccuugaaauagggaggacaacagcaucucaaugucugagaauauuagagcaugggggauaauuuaucauuuccacagcaccaggcagaaggcagauuucagauuuuuggcuuuucaaguucccuucuuggcucugagguuuccuuuggugugaaaugccugagaaagauugcccccaaaaucuaaaggaguuuauuuauauuccucucuugaccacaucauuucuacuacauuuuuccaccucucugucuguucauuccuauuuuacaugaaacccacacccuuagcggugauggugcuaugauuugaauguguuuacuccaaaacucagguguugccacuguggugggauuaagaguugggaccucuaagaggugauuaggcugugagggcuccuccaucgucaaugggauuaaggcccuuguaaaagagacuucaugcagcauucagcuuacuugcccuuucaccuucugccaugugaggacacaguguccccuucagaggaugcagcugucaccagacaacugaaauuguuagcaccuuguggagcucccaggcucagaacuaugagaaaauaaauuuccacucuuuauacauuacacagugguauucucuuauagcagcacaaaauggacuaagacagauagcuuugaaauucaaaaucuuaaguccuaccugugcucccaguuggggcagcaggaggaggcagugggaaggggcugccuugcaccuugucagacaggacuggcacgcaugcacucauucuucaaccaucuaaugugacuuccuugaacaguaguucucacugaucagcggaaugaagacaaugggaaucagaauauuuuuaaaaugugcacguauccguagcccacccccaagagauucugccuccguggaugcaagguggggcccaggcauuuauaauuuugaaaagcuccaugggccgggugcgguggcucacgccuguaaucccagcacuuugggaggccaacauggguggaucacaaggucaggagaucgagaccauccuggccaaaauggugaaaccccgucucuacuaaaaaauacaaaaaaaaauuagccgggcgugguggcaggcgccuguagucccagcuacucgggaggcugaggcaggagaauggcgugaacccaggaggcggagcuugcagugagccgagaucacaccacugcacuccagccugggugacagagcaagacucugucucaaaaaaauaaaauaaaauaaaauaaaauaaaaagauaaaaagcuccaugaaggccaggcauaguggcucacuccuacaauccuaguaguuuaggcaucugaggcaggaggguugcuugaguccaggaguucaagacaaaccagaaguucaagaccaacauagcaagauccuguaucuacaaaaaauuaaaaaauugacagggcaugguggugcauaccuguaguuccagcuacuggggaggcugaggugggaggaacauuugggcccaggaauugaggcugcagugagguaggaucaugccacuauacuccagucugaaugauagagugagacccuuucucuaaaauuuaaaauaacaaaaaggaaaaaacauaacuucacgagauaacgcugaugcuaccaacacaccaauaguugagaaucacugcucuagaacaucagucacagcaguacucaaagagaacaaagcuguaucccaaagcaaauaggaggaaaaugucuuccuuccuuuucuuucuguuuuuuuuuuuuuucauuuuuugcucauaguacugccauggaggacuucauuuugaaacaggaggaaaaugguuucuaucuuuggggucauccauuagugcagauacuugagaauuguuccacguacauuuaaauaaauguaauggguuguuuucccugccuucauuucuuuuuuauuuuauuuuauuuuuugagacagagucugacugucacccaggcuggagugcaaugguaugaucucggcucacuacaaccuccgccucccagguucaagcaauucucgugccucagccucccgaguagcuggaucacagaugugcaccaccacccuuggauaauuuuuuuuuuuuuuuuuaguagagaugggguuucaccauguuggccaggcuggccucaaacuccuggccuuaagcaauccaccugccuuggccucccaaagugcugggauuauaagccugagcuaccaugccuggccccaucuucauuucuuuucuuucuucuuuccuucauuccuuccuuuucuucuuuccuuucuuucuguauuuuuuucauuguuugcucauaguacuacaaaauggaggaugugauuuugaaaccuuuaauauuuagacuauuuuauuacuauaauaggcuaucuuaauucuuaguucuccuucuuaaagcucacauugugucucuagaauuuaacuggcccagaaaguuaacugucaaagccauugacuuauuggagacauguuuaauucuguuuuaaagcagguaucaguuaacaccucuguccugagacugguagaaacaauaauggauccgguggaaaucagcaaauagaugaauaggaauuuugaccuaugugagcaguguuauuacuauuaaaaauaauaaacaugacccagagaagcacugcagcaguuccucaaggccuuugccaucagaucacuuaaaugacucugaacacugugggaaagaucaggucagcuuuggucagagauuaggauuuugagccucuuuucaggacggcauuagcugacccuauuaggauguuuaauucugcucuuugaaaaaccacuuuuagagauuuuuacugcacaugugagagccaaggaggaauguauuuaugcuuuacugaggaucugcauuugcccaaaagauuuaaacauucauaaauccaacugccuucucaaugccucaccuuggcuuuuuuuguucaacaagauuucaguaccaacuuuuguacuaaaugcuguuuugugcauggggaauauggcacagaacaacacagacaaagcuccugccccacugagcuuacauucuagucaugucuaaaagacaucucaaauauggccaaaauagaauuaacuucucccuccacaccauucacauaccauccaggaccuuccccccucacccagugcugcugcccuccccaucucacuuagcagcuucagugucaacugaaguguucaggccaucaaccagaguuugauugauuuacucuuuccucaaacccugacaucuaaacuguacuaggcuauucuugcauugcuauagagagauaccugaggcuggguaauguaugaagaaaagagguuuaauuggcucaugcuucuacaggcuuuacaggaaauguggugcuggcauccacuucuggugaggccucggagcuuuuacucauggcgggaggugaaacaggaggaggcacgucauggggcaagaaugagagcaagagagagaaaagggggaugucccagacucuuaaaacaaccagaucuugagugaacuaaaugagugagaacuuacucaucaccaaggggauggcacuaagcuauucauaagggauccaccccaugauccagcaccucccacgaggccccaacauuggggaucacauuucaacaugagauuugaacagggcaaacauccaaaccauagcauaaacuaucagcaaguuucauuugcauuacuugcaaaauacccccugaauuggccuauuccuuaguauuucaucugcuaagcuagguugaaaccagccaucauugcacuuaucuccagcacugcuuucaugcugacaaaugcuauaauccauucuccacccaacaaucggggugaucauuuauaagcauaaagguaacuccccugcuaagugucccuucaacggccccccuuugcguuugaaauaaaauccaagauaacaagacccugcaugguuuugcuccugccuacuucuccaacuuaacuuuauuuauuuauuuauuuagaaauggaguuuugcccuuguugcccaggcuggagugcaauggcacgacggucagcucacugcaaccuccaccuccuggguugaagugauuguccugccucagccucucuagucgcugggauuacaggcaccugccaccaugcccagcuaauuuuuguauuuuucguagagacaggcuuucacuauguuggccaggcugguuuugaacuccuguccuuaggugaucugccugccucagccucccaaagugcugggauuauaggcacgagccaccacgcccggcccuccaaccuaacuuuauacacucaccccucucucuggcucuguuuuagccacacaaccuuucauucuguucccuggacaugccaaguuaguuuucuguacauagccucugcaguuguuguugccucugcaaaagaccuucuuucucagaccauaucacagcuacugccuucccuuggucaugucuuagcucaagagccagggaacuugacuugcuuauuuuuuuuuuucuaucuccuuaggcuagaaacuuuucuaacuuguucauugcuauaucucugguuuuuaugcaugguaccaucuauauaguagauguguaauaguauuuuaugaauaaugcuaauuaguguaaauaauuauccuauuagguacuguuagaaauacaaagaaaagcaagacaugggucauuuuguucgaggaauuuacaaucuaguucaaggcauacaagacauaaaauaaugaauaaauauacacaaaaggggauaaagcaaugccaggcaugaacuauuguguaagagaucaugguuagagaagugccaugaguuaguagaaagaggaaagaguauaauuccaucauuaaguuugggcauacggccacaguggcucacgccuguaauaaccagcauuuuaagaggcugagguggaucaccugagaucaggaguuugagaccacccuggcuaauagggugaaacccugucucuacuaaaaguacaaaaaauuagccaggcaugguagugugugccuguaaucccagcuacuugggagucugaggcaggagaaucacuugaacccaggaggcagagguugcagugagcugaguuugugccacugcacucuagccugggccacaagagugaaacuccaccuaaaaagaaaaaaaaaugucugggcaugaacaugggguucugccacuuacugugggacccugggcaagugagugauuuaaaaaacagaauuuagcuucauauuucucaucuaugaagugggauaauuuaauuaauuucacaugguuauggggacacuuaaacaagauaacauauauaaaaucaaguacaggauagguucucaauaaaugguaacuagugugauuugugcagaaugagagauaaagacugugcaugccaugagauuugaagagggagaucacacaggcacaucuccauugaggaugaccaaaggcuucagagcuuuggagauugggaaggcuuuugucaggcacagcucugaacuuucacacugaugaaguuuuggagguaauguggacucaugucauucaccaaauguaagaaucccuuccuugcagcuucuugcccagcuuuugcuaaaaacuuuugaagacggacuucgcuccauuucaacaaacucauugugaggaugcggcucgauuuguuuuaacagucuuccuuaaaacaggcggaauucuuucuccuuacaaauuccacuugucaguccccaggaggaauaguaaaaauuauaucuuccuuugguuugguucucuugaggcuggacauuccccauaucuucagaacuuacgucaucuggcaaaagguaaaaauggggcuuccucaucuguucugaacagugagucucuuccuucucucaauuggguaauucuccgcucuuaauuccugcuaaauuaauugcuuuucucuauuagcucuaauuauuagccugguugaugaucaacuaaaacugcuagacuuuuaucauauaaacagccaucaagcucaucauuucucugcauagguuguuucauuuauuauuuucucacaugggcauaguauuuuauauuuaagucuacuacauuuuaauuuuggggcauucaggccuaucaaaauaauuuugaaucuuaauucagcucuguauugaauuaacuaacacucuagauuuuuucauauucagauuugauaaauaugugccauguauauuuguucaaauuguugguaaaaaugucaaaucuaauaggaauuaauagaaagccuuauggcaugucacuagagacuauucaucggguuggccuaacagaacauuuuuucaacuggaugugaaucuccuuaacucuacaaucauccaacaaauguuucuccauuuugugucuccucugugaaaccucuuccuaaaaccaagauacauaauugauaugcaagucaaauuaucuuaucaaaagggaaaaaaacuuaauuugacaauuagcuacuugaggacaucuaauuucucucgcauucguugauaugaugauaaugauggagagagugaugaugaagcugcugugaauccugugccuugcacugggcacugagccaaacacuuuacaacccuaaucucauuuagcuuuuacacaacccugaaaggugggagccauggcuuuauuuuacaaauaacaaaacugagagagaggcuacagauaaauuaagacauggggcuaaaaaaaugauaauaauuaauaaguaaugaaaggcuacagaauuugcccaauaucacauagguugaaaguggcuaagccaagaugaaacauauaugugugugugugugugugugugugugugugugugugcgugcacacacauuacugcaucuaguugcaauauaaauacuuguaauaggaaauaucaugaauaaagaaacaugggcauuaaauucugguuuguuggaagggaguuuagggguaaccaagugagggcagggcaguaucucccaacaugauaugggaugucaguauucauuccguguaaaaacagugccccaucaucuaacacauaagccacaugcuaggaaagcaaugauaaguaaguuguuuguuucacugcaggacuucucauggacuuaugcugagguacauggugacucccucagaaugaguauuucauaaaaauacuuggguacuggauacccgauggcucgguacccauuacagagugugcuuuuggaaacuguaguagaggaggugggucugggccuuaaugccucagccuccccaagcagcuuggccacagauuccucaagggccagggaaggagcagggaaagaaugaggacucagccgcaggucaaagcaguacagaugcugugggugaugagucuggaucccuccugcccuggcacauggacuuacaaggugaaaucuuaaucccacgauucagauuccauaagccucacgcgaacacaaguuucauuccuuuucaucacaccucauacuuugaaaguuagacagacacuaaaguuguauguaaaucauuaggguggaaaacaugccggacuggcccuagacaaaaauccagccaagaaguuuguugacauuuccagccccuacaacccccucuucuuuucuccaucucacugcccuggucccuagguacgcacagcuaccauggaacccacuugcccccuucccuagguacucacagcuaccaugaggucccaguucccuuaaaucacauccucccaccccccagcaccauaauucauguuauaguggucuuguuauaagucauuuuguaauuuguaaaauauucuccucaaugaaaaguaaaauuugucuuguauuugugauaguucucuauuugggucaaucaaguguacaaaugcaacaaauauucccuauaaguagagagaauaaaaaaccuguauauuuauaguccuuuaauaauuccuaagaaguucucuguugcuguauaaaauauguuuucuuaauuuuuagcuauggaaaccaacaaccaaucuuagggaaaaaauuugaaguauacuuaaauuuaaaccauuugucaacuaaugugcacauuuacaccacagcuuuacacuuaagcagagccuuucacauacauuaugacauuaacccuuacacggccucucuguguggcucuuggacuccggccuauccuucugacuccacguccugggcuccuacuguccaucacugcugacuuucacuccugcagccugcauagcuugguuugguuuguucguuuguuuguuuuguuuuguuuuguuuugcuuuuuagauggagcuucgcucuuguuguccaggcuggagcgcaauggcacaaucuuggcucacugcgaccuccaccuccuggguucaaacaguucuccugccccagccucccaaguagcugggucuacaggcaugugccaccacucccggcuaauuuuuugaauuuaauagagauggcguuucaccauguuggucaggcuggucucaaacuccugaccucaggugauccaccugccuuggccucccaaagugccaggauuacaggcaugagccaccaugcccagcccuguauagcauuuugauagacauuccuagaguaguuuuucuuaagaauuguucuacagaacccugguuucucaauaugcucaguaggagaaaguaaaaaaaaaaaaaaaaaaaaaaaaauuugugguccagugaauuucaaauacccuuuugcagcucuuuccacuuguguauugauagucgccaugcauguuaguauacugaaggcugaagaaguccagucauaaagacacuuuuaacucaccagcauuucucaaauauacuuaaccuggaacuuuauuuuccuaaucuuucuccaauuuuccaaaacacaccacucuugaaacuacuaaagacuauauauagacauagauauauaauauuaauauaguccauauuuaauauauauuauauaauauauaguacacauacauauaauauagauauuaaauauauauaaaggaaaaaagauucaccugugaaauauuuaaauuaccuggcaguugacauacauucuaguaucccuucccuccucuccccacaagaugaggaccccaggcaagugagggcuggacaguucuaagguggaucaaauaaaugaauaaaaagauauagaugccaggaagaugucucaagugagagacccagcuugcucaaacauauucugggcaggaucaugcaugauggacugaagaccugggugcaggaagauccaucaggagagaguugcaguaaacaacagaagaugacaaggggccugauuuaggaugacagugagaauauaagggaaaaauggcucccagaugccuagaagaaagagucccaguaauucagugacuguucacauagggaggcugaaggagagggaggggucaagacugaauucaggcuuuccaagcguggcuuucggaauaaguggagcacccaugacaucauuuuggguuacaaagaccagccaaagaggucaagagcaugugcuuuaauucauacacucaaagguucaaauccuaacccuguuacuuauuagcaguguauuuggccaaauuacuucccugagccuauuucugcaauuauaaaaggggacuaagaguaguuucuucauagauucuuguaaagguuuagaaagaauguauccaagccgagugcaguggcucaugccuauaaucccaauggguggacugcuugagcucacaaguucgagaccagccugggcaacauggugaaaccccaucuauaaaaaaauacagaaguuacaggcgugguagugccccccugugaucccagcuacucaggaggcugaggugggaggauggcuugugcccaggaggcagagguugcagugagccaagauggcgcuacuguacuccagucuggcugauagagcccaacguugucucaaaauuaaauuaauuaauuacguuuuuuuaaaaagauaaugaauccuggcugggcacuguggcucaugccuguaauuucagugcuuugggagacugaggcaaaaggauugcuucaggcuagcaguuuaagaccagccugggaaaaacagcaagaccuugucucuacaaauuuaaaaacuaacugggcauuguggcacacgccuguaguaccagcuacuggggaggcugagacaggaagaucacuugagcccaguaauaagaggcugcaaugagcuaggauuguuccacuguacuccagccuggcugccagagugacacccuaacucaaaaaacaacaacaacaacgaaagauaaugaauccuuagcucaggauagugccuggcacauaguagguguucaacaagugcuaauugcuaucuccauugugacuauuaucaucaucaucgucaucaucuugugaagaaauaucuaguuugguacauguugguucuaggaugagaguaaaguaugaucuuuaaauggaugccuacuaggcagugcaaggcgggagcauggagcucgugugcuagauuggugaugcagauacaguuuuggaauaauuguuauagaagggaugagcgagccaugagaaucugucuucuaagacauaaagugggagagagaucacaggcuucaaggaucaagcuuugguaacacccccugacauggcagaucauaaaaggauccagugagaaggaucaugugggcaucacaagagaaucaggcaagugugggugaugagaaauuaaggggccccagccucauagggugacuaaaagaaaaaagaaaaaccaauggggaaaaauuuuaaagaugauuaucauauuacccugagccagggaagcugagaaguacauuaacagagcauucagaauggcacaauggcaaacauuguggaauggcauaacauuacucuccucucccuaaagugggcacacuugaauugacauuugcaggagaauuucacuagagcagagaggacccccccugccccaaacagaaaaaccauguuguacaacaguaguuaaagaaacuugggcuggacgggcacaggcgcucaugucugugaucccagcacuuugggaggccaaggcaggaggaucacuuguguccaggaguuugagacgagccugggcgacauagcgagacccggucucuacaaauaauaaaaaauuacccaggugugggguacgugccuguagucccagcuauucagggagccugaggugggaggaucacuugagugcgggagguugagucugcagugagcugaguucgugccacugcauuccagccuggggaacagagugagacccuuucucagaaaaaaaaagugggggauaaggaaaaaaagaaacuuggacuuccuacacaggagacuuccaagauggucaagacagguacauuucaauauuuuaaggguugccauaaagaugaaguugaguuauuuguugugucuuuaguaggcagagcuagguccaguuauuucaucucagccuuagaaaaggcugccuguugaaguagugaguuucuuauaacuggagaaauuucacacagagccuggcugcccagcugcaaagcugggaagaaaccccugguuuuagcugagaggaugaccuacaucaaaccaaauccuucccaucuccuguuuuugcacauccugugagcuaauaauguuuuuuacauuuuuaacaauuuuuaaaaauuuaauuguaaauugacauaauuauauauauauggagugcaaagugauguuaugauagaugugaacgaugaggaaugauuaaaucaagcuaauuaacauauccgucaccucaaaugcuuaucacuuuuauggugagaacuuuuuaaaguguauuuuguuuuuauaauuucaacuuuuauuuuaaauucaguggauguaugugcagguuuguuucaugggugugcuguaugacacuugagguuugggguacaaaugauccugucacccagguagugagcauaguacccaauagguaguuuuucagccuuugcccaccucccucucuucccccucuaguaguuuccaaugucuacuguugccaucuuuauguccauguguacccaguguuuagcucccacuuuuaagugagaacaugcaguauuugguuuucuguuccugcauuaauucacuuaggacaauagccuuuagcugcaucuauguugcugcagaggacaugauuucauucuuuuuuauggcuguguaguauuccaugguauauacguauauccaauccaccauugaugggcaccuagcuugauuccauguuuuccuauuguaaauagugcugcaauuaacaugcaagugcaugugucuuuuugguagaacgauuucuuuuucuuuggguauauacccagcaaugagauugcugggucgaauaguaguucuauuuuaaguucuuugagaagucucuaaacuacuuuucacaguggcugaacuaauuuacauucucaccaacaaugcaguguucccuuuucuccauagccucacaagcaucucauuuuuaacaauuuuaaaaaucagucuacggccaucccaucuggaacgcacccgcucucaucugaucuuggaaaaacuaaaaggauacuauuuugcgauaggugaaaauuauaugaagcucaaauuucaguguccauaaauacaauuuuauuauagcacagcuaugcucauuuauguguuggcuacagcugcuuuugugcuacagugucagggcugaguaguugcaacaaagaucaaauggcucacaaaggcuaaaauacuuaucaucuggcccuuuacagaaaaaguuugccaacuccugauuaagaucuuccaauggccuuuuuugaacuggaagguucugugaggaagaaaaguuuuagccugagauuuggauaggaggucauggaucacuuggagaccgccaacacaauagccugcagggaugggaaacuagggugcaguggugagaaaauguagguaauggauuagguaaugccuauuggagaagacucacagcaaacaaaggugaaagccuggauggugaaagccaccauccucagaccagcacaguauggggagauauuuugggggauaggaugacauguagaaguuuguggcagaagggauauauaaaagcuuuucuuguguuugaugaacacagugguguacuuaguaucugcuuuauuuuacagcaugguuuaauauaucucuugucauaucucucagcaagaggggauuuucugaauguucuuguuuauacaaugugcagaaaauuuuugcacagagagucaugcuuuuguuggcaaaagaaagugagcacuugcugauuuucuggcaauccuaacaaaaauacugagguguauuuauacucugggggccaaaacgaauuucaaaaugacagugcuuagcucuguaaccaucccagcuuuccucuucugccuccacgggguuuaacaacuuugucaaaucccuuccucugaaauccacuucugcaaguaaguugaaacaaauucgcucuacugucauauaaacaccaggcgggcuucccugcugggugcucaauagcuuggucaccaaccaauggaugagauaagcaggcuaaagucacagaaaguguagaaugaaauugucuuuuuuuaaagcauuuuuuuauuacauuuuacagugugauuucuuuauuaacaucucuuaacaguuaaaagauguuuacuucacacuguuuuaaaguauaaugauauucaagugggauuucaaacuagaugcagaaacuuaguuacuguucuuauuccaaacaaggcaagaugccuauuagggagucagauacaagugacuuuuuguuaucugugccaaugagagaaccagauauccugcuaauaaaaauccacccagaaccaaauuucuuaauuugccuaguuucugccauccuuuucguggggaauuacacaacaacuauuaacaaaugguuacauucauucauuugcuuuucacauucauuuuuugucccuaugguaauacuaagagacagcccucuguucuuaauuuuuuaguugcucuucacugcugaccaagagguguccaggcauuuuaaccacauucaaggcuugucucugcaauguagcuguccuguuuucuccccauuaaucacuucaugccccuuuuacaucugucuacccggaugacucacuguuggauuguacaggaagaggcaaagacucugcacaauuccagagggcacuguucacuuagugcacaagacaguagcccuggguaagagcccuggcucagauuugaauucagauccaaggcucaccacuuacuuucagugugacuccaggcaaguuuccuaacuauuguauucuucagucucuucaucuguaaaguggugcuuauaacauugaucuaauauguagggauguugcaagaauuaaaagagaauuugaggaaauguguuuaccaaggugauugacccugaaucaagcacucaauaacuaaugaugaugauaauaauucuagacagcuaauagcuuguaaugauuuacuuuuagaacagauaagaaaauuuuccuugcuuccaauacuaucauauuuuaaacuccauuuagaggcuaccaagaaguuugggggaaacaggggccaccauuuugaacuccuugaugauuacaaaggugguagauaguggugcugauauuaggguugguucuacugucuuuaucuggauucauagaauauaggaacuuuaucuaaaguaaaguuuucucaacacucuuuggcccagaauguuaaagaaaaaaacguuguauccacauuuaauaugauuugaaacuucaaaauagauuugcuagcaugaauaaaaccauuuauaacgcugaauauauacuucagaaacauagcauguucuccccuccucuagcuacccugcucuaacccuguccaagacugucaucaucuccucccaagcugagagucacugccuuagagagaaagggcaaugggcugguccggauuucuaauagggcucuuccaguucuaggaguuugugauuuggggacuaagugccuaaacccuggagagccaagccuucuccaaacaagaaagaagucccuguguaaagagacaugagaaaugaaauagaagcagaaguuuggaucuaggaaugucacccuaagaauuaggggcuccuuuuuuuuuuaagaggaaugauaugacacaacucauguuguaggaggauaacacuucacuuggugauuuccuuucucugggauguugaaacuaauagaaaaagaucaugacauucauguaacucccugaagauuuugaagacuucuuucuuagaaauccuuaagaaagcaauacauacccaccugcuugcaauaguuuuaggacuauuagaugaugcuaaucauuaucucuaauaguuaaauaacucuggauaugaaauccugacuuuugggaauuucuuugauaucuguacuauacaucuaaaaaaggucagggaaacuuugaacaggauuaugagucuaggccuuuuguucugucucuagccagcugugucauauugaucaaaucuuuuagccccucugaacaucaguuucugccccauaagauaaagaauuaggccagaugauaucuaaugcuucuuagaauuuagacucuagaguuugaacucucagaguuugaaucccagccacauuguuuauaugaucuacaaguuacuaagucuuucuaagccuuccuuugccagccugucaaaugaggauaauaauuccuucuaguuaggguuguugugaucaauaaaagucaccuauugcuauuauaaucuucugauacuuaauguauaaggugcauuguaaguaauacugaauccaaacuaaccuauauacacuaccuccuugcuauacaccuucacucugggcucaggggcuugccuucuauagggugaggguuacagugagaguuuugcuguugcucuauccuauguauuauagcauaaaguguucucuucuucguuccuuugagauaaugauuucuugucugauccacccucagccugguugucacagcuggguagugcccccagagaagaagcagcuguagccccaggagaagcuccgaggggaagagccuuuuaaaguggaaaaggaggaucuauaagcuaccuuucaggugcaagacuuagagagagggccaggcaugguggcuuaugccuauaauuccagcacuuugggaagccaagucaggaggaucacuugcagccaggaguucaaaaccagccugggcuuugcugacccaucucuaaaauaaauaaauaaauaaaauuuaaaaauaaaaaaagacuuugagagagaggaccccacucagguauaaugaggugggacucaccagcccagaacacccaauccccaccccuucuagaaguguugcuagaaguagagaaagcacucuacuuucuauacaacauaucuuuuugguuugccuguugcuuucuguuugauauuuguaacagcuuuauugagauacaauuuauauacuguauaauacauacauuuaaaguauacaggucaguggcuuuuuucauauauuuacggacuuguauaaucaucaccauaaaucaauuuuaggauaugaugaucaccccaaaaagaaaccacauacccacuagcagucacuccccauuccucccuaacugcagcuccuggaaaauagugaucucauuucugucccaauggauuugccuauucuggauauuuuguauaaauugaaucacacaauaaguggccuuuuuugucuggcaucuuucacuuaagauaguguuuucaagguucaucagcauuguagcaugaaucaguacuucauuucuuuuauggcugaauaauauuucauuaugugcguauaccacauauuguuuauugguaaaaauaaugauggccauuugaauuauguauacuuuuuggccauuacaaauagugcugcuaugaaauucaagaaaaauguuugagcauauguuuuuauuuaucuugaguauguaccuaggaguggaauugcugggucauacaacucaauguuuagcauuuugaggaauugccaaacugcuccaaagugucugcaccauuugacauucccaccaacaauguaugaggguucugauuuauccacauuccuaucaacacuugcuaguccuacaacacauaccuacagccauccuaguagguaugaagugauaccucaugguuuugauuucauuuuccuaaauagcuaaugauguugaguaucuuuucaccugcuuauauuuguauaucuucuuuggauaaaucucuguucaaauauuuucuggcaauauuucugacaaugaagcgugacauuaagauauaaucucauucuuggcugggugcaguggcucacgccuguaaucccagcacuuugggaggccaaggcaaguggaucaccugaggucaggaguucaagaccagccuggccaaccuggugaaaccccaucucuacuaaaaauacaaaaauuagcugggcaugguggcgggagccugucauuccagcuacgugggaggcuaaggcaggagaaucaccugaaccugggaggcggagguugcagugagccaagauugcaccauugcacuccagccugggugacagagcaagacucugucucaaaaaaaaaaaaaaaaaaaaaaaaaaaauuuaagaacaugaaagagcugaugaugaaaccuguuggaugaacugaugaaccaccccccaccaaaaaaaaaaaagauauaaucucauucuuuauagauuggcuguugucauucuaagucuuugacuaugaauguauaugcuaggugggggaaguaagagcccacuuccaaguaugaacaagaagagagggaucagcacuuaggguucccacucuggucugggauuauauguauaaacaggauagagagaaaaucaguuuuuuccugaauauguguucauucucaacagaagucuggacuggaagguagaagaucuaggcucaauuccugcuucuacuuggcaaauaugaauaaguugcuuaguagguaauuagcuucuuugaaccuuucuuuucauccuccccuuuucaguuaucuucuuuccuuuuuuaaauugaacuauaauuuacauacaauagaauuugccuuuuggcaugcaguuugaauuuugacaaugcauacaguugcguaaugaccaccacgaucaggauagagaauaucauuacaaagggaugauacugaucccaaaaguuuucaucccaaaaguuccuuuugccuccuuuguagucauuccuccccuaucucaaaccucugggaucugauuucucuuuuuauccuuuugccuuugacagaauguagcagaaauagaaucuuacaguagguagucuuuugagccuggcuuucuucauuuagaaugauggauuagaaaucccucagccaggcauggugaugcacaccuguuaaucccagcauuuugggaggccaaggugggaguaucacuugagcucaagagugugagaccaaccugggcaaauccucauguaaaaccuccugucuacaaaaaacacaaaaauuaucugggcaugguggcacgcaccuguagucccagcuacuugggaggcugagguaggaggaucgcuugagcccaggagguugaggcugcagugagcugaagucacaccacuacacuccagccugggugacagugagacccugucucaaaaaaacaagaaaaaagaaaucccucaguguuacuguaugugucaauaauuuguucugaguagcaugucauuauaugaaucuaccauaguuuauuuauccauuuaccaguugaaggacauuuauuuucagcuuuuaugccauuauuaauuggccacuaaaagcauucucaaauaggugaauguagguuuuuucuuggguagauacuaaauuauuuuacgaagcguuaugcgaaguggcuguaucauuuggcauucacagcaacaaugugugaacauuccaguugcuccauauccacaccagcccuugucaaaaaucucaguuucuucauuuguaaaugggacagaagucccuacccuaccacucacucaggauuguuguaaagauagaaacagaagugaggugguauagcagaagugcuuugugaaccauaaagugcuauacccaaguaagaaaugcugccacuuaguuugauagagaucaugcucacuucaaugcaaaacuuguuucccacaugagcuagauguuucauuuuuuccccuacaucuuggcaaaauaaguuauaacaagucuuagacggcaaaaagguuugucuuagaugcauuguggaguuuguuuuggcuccaguuuuugaacuuuucacagaaaugaauaaaugaccgagauguaaaucauuaagcgugagucaguuuugucaagaaaaaugacccugugggauggaagucagcaggaauggagucagcaugacagacaaugugacgugcuguggaagaaauaaaggcagcccuaaccaggcaguguccccaggguaaggcgcugaggaugacugcacagcagcaaagagggcuaauaugcuccacuauggugagucugggagaguuggugagaaaacugacaaagcacuaauuucaacuuuuuucaaauuugaaaaucacuuuuuuccauguuagaaacaaaaagcuguaagaaacaagccaaacguuaccuccuuaacaucagaauggacuaauucuuaguguguuacaaagaugguuacauauagaaauaucuauagauacacauauauaaacaaguuaguauaacauacauauauucccuugcucugucaucugagagggcauagaaacaacugacaucccaguagcaacaaggacaccuugugcucagaucuugguuucuaaaaccauucuccaauuaaaaggaaccagggcugcuuggagaaauggcugauuguaggacuaaggcagaaaauauacaggcugagccuggagcaucugguagugccaagcaguaaggaggugcuucaacggaaacacaagugauggggugugucaaagagauaagauaacugaaagagcucccaacagccaaagcuggagcaacuugcaagacaaaguaaaggaaaaauauauuauaaccaaaaguauaaaauaaauauucuugacucuaugcugacaugauugaauaaauaaaugggggagaauaaaugaaagagaauagacaaaucugugcaaaagaacuccaaauaacucaugaauacuccacccucuagaagguggagccuaacucccuacuuguuaaaguaugagcuaugcauauugacuuccuuccaggaaguacaguagggaaagggaguaaaaaugaguaacuuuacaguaaggaaagcugagaaauaugaccucagccaggugaucaaggucaacaucaacagggacacauucuguugauagugugugcccuggauauaaugugaugggaauugcauuugaccuccguggucuuccucccacaaaaccuuaaaccagucuaaccaugagaaaaauagucaccaaaucccaaguuaaggggauucugcaaaauacaugaccaguaauucucaaaaaugucaaggucauuaaaaauaaggcaaguguaagaaacuguuauagccaagaggagccuaaagaggcaugaugacugaaggugaugugggauccuggaacagaaaaaggacauuagguaaaaacugagacauaaccaauaaaguuaauuuaguucauagucaugcaucaauaauauuuuauuaauugugacaaauguaucaugcuaaccuaagacauuaauaaacggggacuugggugccaggauuaugggaauucucuguacuauucuugcuauuuuucuauaaaucuaaaaauauuccaguugcuccacauccacaccagcccuugucaaaaagcucaguuucuucauuuguaaaugggacagcagucccuacccuaccacucacucaggauuguuguaaagauagaaauagaagugaggugguauagcagaagugcuuugugaacuauaaagugcuauacccaaguaagaaaugcugccacuuagguugcagcauuugccccacuaaaaaauauucucugaggaauuucaguuuaaucuugaugaaguuuuuaauuuuuuugagcggagucuugcucugucacccaggcuggagugcaguggcaugaucucggcucacugcaagcuccgccuccuggguucacgccauucucccgccucagccuccugaguagcugggaccacaggcgccugccaccaagcccggcuaauuuuuuuugguauuuuuuaguagagacgggguuucacuguguuagccaggauggucucgaucuccugaccucgugauccaccugccucagccucccaaagugcugggauuacaggcgugagccaccacgcccaggcuaacauguuauuguaaagguuguaugacaaugaauuaugugagucccaagggaaacauuuaguacaguuuuuuuaauugcuguucauugagauacccagugaaaaagaugaccauauuuugggggcauuuccuuucuaagacuuaaauaaauauggaaaaugaauugguaaaaaaauaaaaaucuagcagauaaucauucaaaauaugaggcacaaaucagaggccacucuuucugccaaguuaaagacaaaauccagcuugguuuuagggguuuuuguguguguaugguuguuauuuuguuuugccuuucaaauaaacaaauaagagcaaggguacaaauagcaucaauuuacagguguuacagaacaacauuuguuuaaugugacugccacguguagaauauguccacaugauaaaugucuggacuaucuagcuccaucagucaagacguuuuacacaaaagaaaauucccguauuccuuuuaucaacuuuauuuauuccuggcugcaauuacccuucccucuaccccacccccaccaagauaauagugaugccuuuaaaggauauguagcaguuuguucuuucauugcuuucuagugagcuuccuguaacagaaaguuucuggcaagauguuuuuacauucagacccagaucauugucuaugacaaaacggagacaaaacugagccaagaacuuuaccaccaccccccauagaagcugacgcuaccccgacuccuaauucacaaggcucagggcugccaaccacauuugucaggguuucuucuccuugagcucugccuaggauauuucccccauuauuacucucuagaggcgcguuaucacguuguuugcucaguuggccauuuuugucuugaugacaguguaaggaaaccuuggccccuuggcuacaagguguguccgugcggcagagguagacaaugaccaaauacagaguuuguucauugauuugauucauccugaccuaaguguggcucaucacaguuucauucugaaaacugacaucucugcagcuacuugaaccucaggggauuaagucuguccucugcuaaaaguaccaguaccuguucagugccuucugcaacuaguguguccucucggguuuuucuuugugauucuuuccugguugguuauuuuaauugguuacauaaaauaguuauugucuggcuucaauagucgcucuaaccugacuuaggugauaauagcuacaauuaguugaacacuucugcaagccagcauggugcuaugugcuucacgcauaugugaagccuuuuuaaauauccugcaugcuccuuaggucauucucaauuuacaggauuuggaaaacuuagaacuuagaaaacaugucugagcucugguaaguaggagaacuagaauucagggaagucucugugccuccaaagcaccuauacacaguggugcugcagauggaucauggcucugucacacucugcucccaacugugacccccuccuccaugacacuuaugaaccccuaucagaucacccugaauauuuauccaaguuagcauuccuggacccaucuuuacauuugcuacauauuuccaugcaaggaagcauaaagguccaaacaggaacuuuuacuucauauucauguuuuaagcagaaauuauucguuuaaaaucugguugaucagacuugcuuugagauuauaaacuaccauuuuguaaacuuugaaauguagaguucuucagcuugcauuaaacucaauguuuuucucuuuuugaugaccucacacuucucaacaaaaauguaauacucaggaacaccuucauucccaaagauauuucauccauguccccauaauuauaucugaauuccugaauggauuagauagguugcuggaguugagccuacauaagcagaaauaaaaagaggugagaacaucucucucuucuuccuggacucugcugccaaccuugugcauugaugaugaugaagagaagagcaaacaggccacagaccuggcuucccuucccaagaggaggacauaaaggaaagcaugcugagugaauauccacaaccugugaaggcagaagaaauauuagucucuaauuugaaacagcaucaaguaauggaaagggcaggaacccucagguuuuagucugaaaguuucuucuaacuaguuguuuguggcugauagcaaaggcaaccucuuggggccuuauuuuccuuaccuauaaauuguaaaauaucagcauuggacucuuuguuaacacauuuauuuaugucucuucguauuugcaaaaaauaaaaaaaaaauugggggaagauuuuuuuaaaugguagaauaaaaaaacuagaauagugccagagagaaugccuaggcaaaggaaacagaugcuuccauugaugaaaaaguugggcagagguuccuggcagccuaggcaaaaagggugauaugauagauuauaucauucucauuaucugaaaaagaaaaggaguuggaggagcagauaaaagaagaggaaggagagaaagaaggcaaaaaagcaucagcacaucaaaucaucagaaacuccaagcuaccuucuagaacucugggaggaauuagaaaaugauguguccuggcaaggcgugguggcucacgccuguaauccuagcacuuugggaggcugaggcgggugaaucacgaggucaggaguucaagaucauccuggccaagauggugaaacugcgucuuuacuaaaaauacaaaaaauuagccaggcgugguggcaggcgccuguaaucccagcuacucgggaaacugaggcagagaauugcuugaacccagguggcggagguuacagugagccaagaucacgccacugcacuucagccugggugacagagugaaacucugucccgaaagaaagaaagaaagauacacaggaagaaagaaaggaaggaagaaaagaaggaaggaaggaaggaaagaagaagggagggaggaaggaaggaaggaaggaaggaaggaaggaaggaaggaaggaaggaaggaagcaaaauaaugugugcuguagaaaaugauggugucuucaagagcaguuuugagggcagaaacauuggcaaaagcaaucuccuuuugaccauauuuuauauugauuguuaauaaaaagacauaauucaaaacaugacucucuauaaagauaugauauggggagcuaaaguaauccaguucagguauguugcucacugacagucuuacuuggcguaaggauaaagcuuagaaaaucuaaggaaugaauaccugguaugacuuuuaagauguuuuucuugaauaucaauugccuuagccaagcuuuugacaaguaugacaugcuacagacaguugaaaauugagauuccuuacacguccuuuaauaugcaaaaguaaucuugguuuaugaaaguucucccuuccaccaccuuuccauuccccaggggacucucaccugucuaccugcagagagggccaagaaauuuuauuauuaugguaauaauagugggggaagaagagagagggaggggauuucauuuccuacuguagagaauguuaugauauuggaucuuugcuuuacaagcacguauuacuuucaauauuaaagauuaaaccaaagacugguggagguggggaggaagagagaauggaaauaaaguacaguugcaugugaauaaaagaaaguuaugcacaugaagccauggggcagcccugucacuuagacauugcucuacaaauauucauugaaugacuaaauaaauagaacauggaaaagaggaccagcuggcaagagucggaagccagaaguugccaacuggccaccucaacuaggaaacaaauggacugugccuucuuuaaaacacuuugcuuuguucauggcaauauccuaaugcccuuuccaggaugagcagccccaaaaugcaucugcagaucucuaaacgguucaucuguucaucugucaacuagaauuaugugucagaggcaggcugccaaaaaccacuguuuugauccaggauaauuggaagugaacucuuccuccugucgucaguuggccagcacuuuuggucgcuucuugaggccucuccuggaauauccuucauuugcucuuucagucauucuuuuagaaauauugacugagugcccacugugugccaugcacuguucuaggcucuacggauccagcaacgaaaaaacaaauaaaacucccuacccacauggagcuuccauugcaguuagauggagacagauuagagaaauaagauaaauauacccuaugauaagcgccagggagaaaaauaaagcaaggcagagggaugggaaguguuggggagggguaguucuugcaaccucaagucgagugaugagggaaagccuuacugagaagcugguauuugaguaaagaagggaggguugagggaaugagcuaccuggacaugcaaagcaagaacauuccagguagagggaaccauaagugccagugcccuguguaaagcgugccuggcauauucaagcaacaggaagagggucaguguggcugagguggggguaagcugugcaggacaugaaaggaaguggcaagagaggaggucagaggacccaaucuguagagcuuuguaggucauuguaagugcuuucaauuuuacccagaaugguacaggaagucauugaaaguugugaucaaauugcauguguccuuuucugacuuguuucugucauucagcccaguugauaugcguagccaugguugauucuuuuccauugcucuaucuuauucuacuggguacagcuuggcccugugggugguuugggccauacaucaaccguggacaguggacaaaucuauguggccaaacauuugaaacugcuguuagcaaauagcaaaguaguugguaaagccugucuucucuuguuuagagcuugagggguuggaacaggccagugguguugacaugcugcucugaggagcccuagggaauauuccuugaaccucacuuuuuccccagccucucuuuauuccagaccaacucuuaaucaguguuguauugaaaguguccccauaaagccuccaggcccccagauuugaaaccauuuaaauaagagaccucuaaaguucuuuacaacuuuaaaguacagcugucacauacaugcacacacguacauacaauauguuuaaaauguuuugauguuuauuuuuucauugguaaaugcuuuaauaaaaggucaaauuuacuuucacuuucauaauuauaaauguauuaaccauuguauguagcucaaauguaagauacuagugaaccauuuacaaagaacaagcagcuuucccaucuuccauucccucuucccuuuguuucucagcauggagggcagcccuggcucguguggggagggugugggagcuucacagaagcacaucagugacacgucaggagcgugcccccagcaugcaaggaugcagaauggagaaggggacacacagcugggagacagaagggaaagccgaaaugguugggacauugguuacugugagcagauacuaaauugaugaguaaauaagcaaauauauuuaggauaacuauacaaaagccagguuucucacgguuggaaaugauacuuacaaacacaaaaaggaaaaaggcuggaaagaacuuugagguguuaaauuugaaauguagguuucauuaugaauguaggcuuuuauaaucuauauacacaaauaaaugagggaauaguuauacguguguguguguguguguguguguguguguguguguguguauagacuuuuuuuuucaagcucugucugucuaggaaaccucaaagcaauggcacuccagaggcaaugagcacaugaagcacacagauauuggauucuaaauaccauucuuuacuaaaaagaaaccagggcuucuuggagaaaauggcugaugccauggcuggggaagggaaaauuaaagauaaaucugaaacaucuuguuaugccagaaacaaaggaaauguuccagugaugauggaaacauauuaaaaggaccaggugccacuuugggaucauuugagcuucaaaauaaauaaagcgaguaauggauuccaauauagugaaaaaaaauuauaauccauuugacuacgccaauuuaaaugaauaugugaacaaauaaauggaagacaagggauuguuauuucuuacugaagaaugaaacuaauaaauauaaaaauaaugaaggaaauauaaaucaccauuugguagcugucauagaggugacugauuccggugguauuuaucaaugaaggcagguaauagaggguauaugaagaguaggauauuggugcauuccuagaauagugccucacaaauacuaauaaauuaccagagagaaaaugguaacuguguggcggagacaccuggcagacaccaaccugaccaggugaucaagauugacaucaccagugaugcaaaaguuccacauccuguacccucugcggugaugcaccaagcagagcccagcuucauucugaguauuucuuccaggacagcaucaccuaagucuggcaaugaaaccucagagagacccaggcugagggccauccuacagaauguaaggccuguaaucuuugaaauuacauaaagacaugaaagacagggaacaguagaggaacuauuccagauuggaagagacagaagaaaacaaaaugcaaaguguggucccccgaccagcacaucagugucaucugggaauuugcugaaacugcagaaucuucugcuccuacccccacccacugaaucauaaucugcauuuuaauaagauccccaugaacauuuaagguuguaaauagccagggcccuagaucagugauucccaaacacaaggcuuuauuagaaucacuuaggaaaacuuuauguaaggacagauuccuacuccccuccccagaucuacugaauuagacacuaaacuguggagucuacaauaggauauucugaagaaacucucccagcugguucugaaaccaagguacaucuaagaaucacugggcuguaaauaguguugacauaugcauaagugaccaaagugggucucauugcacgugggccucaaaacacagguuggagaaccaaacuaaucgucgccacaauuccugcuccaggcaccaagacaugaccccaaacuucaguccagggguggaauguaaauaaauauugcugauucacauuucagaaguuuucuagaacauuuaaguggauuugaaaaauacucuuuaaaggauuguuuguacaaacaucauacucuuuccauuccuuguuuggcauagaguuuaaucagauuuaaaauggugagaguucuguguaagguuguauguuucuuuucuuccagggcauguaaaacaggacaucuggguuuuaucauuaaaauacuaaaacauguccaguauuuuuaggaaauuuaggccugaguuuaugugcuacagguguugaguauauuugacagaaggcuggagucuaguaacuuagaguuaaaaggaaaaauauaugugugccugccaauuuuguuucagauaauacuugaugaaaacauuuaaguuuugauuuuuccagcacuuugaaaaauaggagaaaauagaaauaaaucuuuuaguccauuuuaaaggcaaauaguuuucagauauucuuuguuuuauauuauauacugagcuuucaucaacucauagcaaaacuugcuuugcagaucucaauuugccuauaguaccucaugggcauaaaaauauccuuuacaaauuucugaccucuuccagaaaagauauaaaagcauagaauuccaagcaugaggcugguuauaauguagguauguucuaugaaugaauauaagaaauaaugcuauccaacacagagacuggggagggacuaagugguggaacagcaagggauauguaauaagacacuucaaaaauuguaauuuccaaauucaaagaaacaccacaauucaaugcaggugccucacaaaaucaaaugccauaucuagaaaucauugacuauaugccuauuaauauuaguaaaauuggcuaaccuuucaacugugggcuuaaguauguaaaggcacuuucauauuauguccuuuagucccacaguucuguaagggagguguugcucguaggccugcuuucaacugaagggcauagaagagagauuaaauaauugacucaguaucacacaauuggugauacuagagcugagacuuaaagccagcaccucugacuucacaccuggccuacccuacgcaucuaguacagaauauuuguccagucaacagaccaaaaaaaugaucuuuuuuuuggcuuugguuucguuugguguuuuuuuguuuguuguuuguuuguuauugguauaagaugucacguuuuaauauuugaaugguguuuuuuuuuuuuuacuuuucaguuucuaucaucuaugccguaagcacuucccaaguaaauauuucuugaaagagauuucuugagccagauguacaacaugucuuuacuccucugagguuaaaacucacccuuucucuacaaaaaaagcaaggcugguauuuggcccccauuccuucugaggaucuuugugaccccuaaauuaucagaccccuaggcucccaaacaggucugucacuuuuacaggaacugucaacacacccccgaaauuuuuuaacugaccacccugaagaaaacaagcaggcuuuaacuugagcuugcucaccaaaaucacucaaguccuuccagcugcauggccccagucuccaaaauaaauccccuuccucugcuggucugaggcucacuucagccuccccacguccuaggcuuugaacuccugugacuuuuaaccuuggcuuugugccuguugagcuguuaaucagggucuccagcccauaaucagcagcuggugagcagcugcucccuccuuuccuaaaacagauccuagccagaauuuucccugaagggcucuuccugccagcuuccucucuucuaggaagcagaggaaguuuucuuccuuuggcuucucccucucuggccauuccuaaugaagacaaauagcaauggcaccauuauuucuccuguuuuccuuguuggggccucccuucuagaauucuuccccaaaucucuauucuccucugcccuuucccuucuguagcccagucugcagggcacagcuggugguaccuucuggcugaagcuagaggggaaaaguucaaggccagcauaucugaaauucuccagacaagucugccgccacugccaccucuuggacuccguucagccugcugagagcugugucgugggaggcccuaggcuggacacccuuguuuucauggccuggacucuucucccuuuuguuccuuggcuuuugccuaacuaggacccacugcccccaucuuuuaggccaucugagguuagugcucuagcaauugcugcugcucccagcucuccucguccuccuuauccaccacuucuucacccaguaagccugccuaugaaggccuacagagggagggcagguggcaguguaucagacugucuucacagagaugacaaaugcagcaaguuaugacuguagguguccugaggugacaucugggcucuagccucagcauuaccacucacuaacugggugaccuuugcaagucaccuaacaucucugauucucuguuucuucaucuaucaaauaagagaaauggacuaaauaaugucuaaagucuuuuccaauucaaacauucuacaguccauugauuuauucguuguuacauuauguaguagaaccgcauagcuaaaaguuggucugcuuucuggauuauuccuucaugacagccuuggcuaugaaauaacaguuggccuucaucuccucacuuuggagucuaaagaaaaaucuuccuucaugucuugguuuuagaguuccuccaaugacauauugauucuggauuuaugacaccaauuauaaaauccuaugcugcuguuucuguuucuaccuccuauaacccacccaccccaagcgguuucuagagaaggagggguguauuuuugguuuggccaggugcagguagaggaccuacugaacuacugguggagacaagccccugcuauguccucuucaagcuaaaagagcucagagagaccccugucaauauugcagcauuauucuaaauguuaauuaauguuccuuugaaaaaaaaauuacauggucaaaagaacuugagaaauacugaauauuagcugcuucuuaaagguuuaucgugcauauuagcauauuaaagccuccaaaaauccugccccuaaaaaccuuuuguuuauuuauuuaggagacugagucucccucugucacccaggcuggagugcaagugcaguggcgugaucucggcucacugcaaccucugccucccagguucaaacgauucuccugccucagccucccaaguagcuggaauuacaugugcaugccaccacaccuggcuaauuuuuguguuuuucuuuuuuugagacagagucuggcucuguugcccaggccggagugcaguggugccaucucagcucacugcaagcuccgccucccggguucacgccauucuccugccucagccuccagaguagcugggacuacaggcauccaccacuacgcccagcugauuuuuuguauuuuuaguagagacaggguuucaccguguuagccaggauggucuugaucuccugaccuugugauccacccuccuuggccucccaaagugcugggauuacaggcaugagccaccacgcccagccaauuuuuguauuuuuaauagagaugggguuucacccuguuggucagucuggucucaaacuccugaacucaagugauccacccaccucagccucccaaaaugcuuauccuagaauuuccugaagucauauggcuccagacacuuucuucacaaaauauuuaauacuuaauaucuggguagaacaugugcccugaaacacaguuugggaaacauuaccacaaaacauugcugaucuguuucugucuggggucuuuggagcagaaagggauaacaacacuuuccagaauauuuauugagcaucuacuuugugcagaacaugugggaauaauucaaaauuggcagaucaaucugcucaucaagauuucaaaaucaaaugcugcagaggguugccgcauaugaauaagcaggccagucaacaaacaagacaaauuaaguacuaagugcagcuuggaagugcugcagccaggcugcugggcccuuguuugacuccccgaauugaauuccauacucucagcugucagucucaaguuccuuugcuuugcuccaccagugcgguuaccacuccccaguuacaggaucucauuucaggacauucacuguuuauaucuuagguaguuggugggacacauccagcauuuuuauccugugcugaacacccuagaauuuuugccuuucauguacagcucuguuaguuuuuacucagaauuaggaucuguucuuugccuggaaaagaugaugaacuuuucaaaaagcaagaaagaugaugaaacagccaaugucaugugaugugguuuaaucccagcccaucaaauguuguaaccacaguccaguguaccugauguuuccuggacaaaggcccuggguucucaggguggcugcccuuuuugaaccugucuaugacucacagcuauuuuuccaggacuuccccaccuaccaagccaugucccugugucccuaccuccucagagagcccugacccagaccucuuccucuucugcuucccacccuucacugccaacuuuccuuggauguuccauugauauguucuuucugaacauuuuucuugccccuuuuccucugccucuccuuucuggcuucuuugaaagaaaugaaggaucauucuuuuggagaaucuaauccuuggaaagucccucucugcuaaacagugaagggaagcuggcccuguaauaaaaaggccaacauuguuuccacaagugcuacaucuugaagaaggagcugcuuauuauuuuuuaauuaucaguauuaguugacauuuauugagcacauacuacuccucuccaagcaccggagcccuucauauuuaucgucccuuuuauuaguuuaugaauauaaagagacuuuauauuuaucaucgcuuuuauuagucaccacacuccuuaugauaccgggcauuuuauuauccccaucuuaugagcgaggaaauaagagucucaggguagguaggaaacuugcucaaggucacagaaauagugaaaggcagagccaagaaaugaaccuacauuccuuuggcuccacauccuguguuuuucuguuucccagcacaagugacaugagugagaggugcuugacaacaucuuguuuugaguuaugcauaaaacauugcagccaacuccauguuggugcugcccuucccagaagacuguccaagugccuuacuugcccagggcaucuggggacugcaguacgggcaguaaggcacgaucauuuacccuagagcucacagccccagagcugccuacuugaucuucacccugaggagagugauuacauacacucucuuccccacuggaacagagaagcugaggagauuagaauuccaguuuucaucagauuuauucccuuacgaguuucauucacagaugcucacccaacauauauguacuggacagacugcugauuuaauuaucuucuucuuaauggucuguucuaucuaccaguguccaguggggccaggaugaauugaucuuggugggaugccaauauccuuuguuuguucacacagauuuguuuucaguggaauguacgccaacacaggcacaccauuuuauucccuuccgcucuguccuuccugcuccaucauuauuguuggcugguugucggucuccuucuacuugcucaccauucacauucuaauuggugaaaauuugcauuucaccgcaagugaaaaagugacuugcgggcuuacuuuugcuuaccagugacaggugcacaccugcccgaggaccaagagugaaucacagcauggucuccaaacaucgugacccugcucaguggcccuggaugacaaccuucaccuguccccuuuuccuaaguaguguggccuguggccagaggcuuccccauccaggguacuugcguaagcuauguucuuguccuucacucagagaaccucagaauggguccagcccauuccagugcagaugagaaacccaccacacucucacccucugcugcccaaucaucucagggaaaauggagucuuccagucauggaccaaacugcccauaggucuucuaugucauggcuccccugguugccuuccccagcaacacuagccuucugagccucuugggugaagaucaagcaggcagcucuggggcugugagcucuaggguaaaugauccugccuuacuuccuguacuggaguccccagauacccugggcaaguaaggugcuuggacagucuucugggaagggcagcaccaacauggaguuggcugcaauguauuaugcauaacucaaaacaagauguugucaaacaccucucacuuaugucacuugugcugggaaacagaugaguaaaacaaugccugcauccaaggagcuccaucugcaguggcaaaguccagggggauaguggucaccgugcaguauaaaaagugcagcaggaagguuauauuagcacagaggacccauuaauuaucugagggcucagggacggccuccuggagaacaugacaucugggcuacuuggaagcuaauuggaugugggaauggaaagugaaggaguuaaggacuggaaacaggaugggcuuuggguccuccagguaagaauguccaguucauucuuggauauacaagauaagagcuagacauuuggagccagcagcagagagaggauggguaaaggaaaguuagugaaggaaaacauauauggagaggauguagcauaagaagagauucgagaagggccgagacagagcaaggcaugguagcacacaccuguagucccaacuacuggagaggcuguugugagagaaucagcugaacccaggaguucaaggcuucagugagcuaugaucaugccacugcacuccagccugggugacaaugagacccgaacucaaauaaaauaaaauaaaauaggccaagacagagccacaagaaacacagcauucaaaaaccaauacaugccagcagaguacaugggcucuggggccggccugccuggguuggaaucccaccuucaccacuuuaauuagcuuuaugaucuuaggcaagugauugcuucaauuucauuucuaaaaugcaaaugauaaggacauauaccucauaggcuuguuguaggauuaaaugaauuaauaccuguuaaguagacucuguaaaagcauuuggugucacuguuauuucacugaugucggaaaagggcaaacccagccaaugauagagucagcacugcccaguugagaucuccucggugaggagagguaaaggagcacuccuuauaggaagcagaucagagcugaggagggacacgucaggcuugggaugccaccaccuccuggcaggguagggacuguguuugucuugcucaucaugugcucuagugcccacuggagugcgagcucuagaggguagacacucaggaaugauuugcugaacaaguauauauuuguugaaguucccugacuuagcuggagugaaggggcugcagggagcaggcaguccagagguggcagcagcuuggggugagguuuacuaggggguauacccugacuuucuggccucugccugggauaccuagcugucugggugagugagcuucagggauggaaucucucacaggccuucucccacacauucuucucuaauucagaaggacccuguccuacucugcaugucauaggaaacuuaaaauuuuagauacaugacagaauaggaacauuuguaagcaacugguaagcaccaaugccacauucucugugacuucucagaaugcuaaaauucuguuucuaaagggaaugcgacucggcugcaucauucugauucuggagcuaagcuccgcacaguguuugcugaggcauuucuuugcccaguagaucaggguggcuguguggggagcaaagcuuuaaaaauuuaaaggccugugcuuuuacauuaccaugcucuacuaucuuccauuuucucuuuuaugaagauuagacucaacaguaaauuagcaaacagucuaauuuacuguugagucuaaucuucauaaaagagaaaauggaaggcaguagcaugguaauguaaaagcacaggcuuuugauuuggcucauuccuacuuugcagguguguaaccuugggcaagcuaguuuacucacucugaaucucaccuuucucaucuguaaaauggcagcaguauuaguaccagccuuguagagcugaaaggauaggauaagcagcgucccucucacaagccuaccauuuacauggagaguguuguuauuguaauuaugauuaugaaaauuaugcaaagaggaaaagaaauugauuuauaaauggucccacaauaggaucaggauaguucggagcuaacagcucaguuauaucaagacauuuuauguaaacuguuagugauggauuuuaaucucaucauauuaaagugggaugaaauaaguaggacccuauucuagggccaucaauuaauacaauuacaaaaggggagacucugcaugagaugaggcuuacuucugaacagcauuuaauaauuggcuucacaaggaaugauccauucaauucaauuaacuauggugagagagaagaggauaacacauucugcauagcuguuggcaauuccccaaauuccauuuaacuagacaugguauuugcaaaucucagugaaaauauucucccuaguugauuuuaaaacaguaaauaacucuagugaacuuagaacccaauuucugaguacaguauuuagggauuuauaguugaagaauuugagaauaaucaacugucucuugcaaacugugggcaagccauucugcaaacaauagaaagauacccagaauaacauguucucuacccucaaggaggugacaauuuagagaaaauggacauauacacaacugguuuaauugcaagacagaguaugcuucuuacuuuuuuuuuuuuuaguuuugcuuacauuuuauuuuuacuuauacacaaggguaagauauuauagaaauuggugucacuauaagucuaaaagagcacuuucaguaaauauaaaauaaaauuucauaaugaugcaucuuagcacaaaugaagcaaaugaugucuacaaauccauauccauugguguugcuggcuuuaacacacuuuucuuuuaauguuuugggauaacaugaauuauuacacuuucugugugauacaguuauacuuaacacauucuaaaauaauuaauggaguucuagaauaagaacacuagguuuuuauaguauguauauuacauuguuaguuuuaaaaauauuauaaccagaugacaucuuagugauuauucaauuuauguuacagguaaguuagguaaagcccagauagguuaagugaauuccguaugauuuccagcuagaguuaggcuuggaauucaagaaucuuggguucuuucucuuaggucugcauguuuucugcuauaccauccuuaggaaacucuguuaucuccuuacccacaauuucauguguagauaaaauaaaaugaagaucauaaauaguauuauaaugacauaaaccaauacuucugucagcuuagaauugggacuugucuacaauucuguucuagugaacagaaaauggauacggauuuguagcuucuuacuuuucuuauacuugcuuuaacugcucccacccucaugccuagcauaguuccaggcaaauucacaggcaugcaguaacuguuuguggaaaaaauaggcauuacuacagagauauaaauaaagugcuuugggagggcaacugggaccaagaagugguagaagaaccagauuucuaaagaugacagcauauaaaugguaaaguaauuauccaauuauuauaucaaucauacuuuuauauauaauuauaaaauaauaauuuuauauauaauuauaaaaaaucugacuauaaaaauuuuaauuauaauuauauuauuauauaauuaaauauaauuaaaauauaauuaauuauaguuauauauaaauaauuauuaauuguuaauuuuauguauaauuauaaaaauaauuauccaauuauuauaucaauaauaccacuauuuaauuacuugcuuauguuauuuucccccaugagaugccaagcuaucaaugggcagauaccaugucugucuuguuuacuagcgcccagcacagugcauacuauauaguggauacucacuaaguauuuauuagaagagggaggaucaccucaagucaagauauauuugucaagguucuuuuuucaguuaugaguuaacagcaacucaauucaaaucuguucaaacaaaauaagaaauugguguauguauauggagucaucagagggcuucagggauggcuggauuuaggaacccaccaauguuuuuaaaaaucuaucuucaucuuuucuugguguuggcuuccuucuuaggcaggcuuuccuuauauuauagcaaagacagcucucaacagcuccaggcucauaucuuuacaguuuaugauuccaacaaaaagguugucucuuuuccugauagcuucaguaaaagacucaagaagggcuuuaguuggcugguguaggucauaugacaaucuuugaacaaaucacugaggucaggcuugcaggaaggaguauggucagccuuauguaaucuguauagauuaagauguuagacagccaaaacaaaacccccuacacaaggaaucagauugaaaugagccuaagaauagacaaagaauagaaaaugauacacauaguacaauuggauuguuaucuggauaaguggcagguaacaguaaaaaauuaauacuggagacguaaauuuagagcaaauagugccauccuugaaagccaaaaagagauuuagaguuuguucugaagacaaaugugauguaguuuggggguaaggggagauaaucugagcuguguuugaggcucugaaaaagcuaccuuuggguacuugccuuuuccccucugugucucuccuaagcaaagagucaucaguggaaccaugccaagcacagcaaggaguucaagagacucuucugcacccacuucaugucaaggaggaugccugggugugggaaacaugcuggcugcuguauccucagaacugagauccuggcaugaaugaaccauggcccgugcuuuaaggagcuuaugauuagaagaacuuggucuaggacaacauuuuauacauacauacauacauacacacacacauacacacacacacacauacacacacacacauacauauauguagccaagcacaguggcaugcaccuguaguaccagcuacuugggaggcugaggcaggaguuuguggccauccugggcaacauagagagacuccauuucuaaaaagaaauaaaagcuuaaaaacuaaacauuuuauauauauauauauauauauauauauauauauauauauauaugauugggcuauuguaauagaaacaugcucuuuuauuccuagcaaugagccagggaagccuugagagaagagguaacauuugaguuauccuucucuuaagagaagacuguacucggggcacaaacccuucucagggcagucacagauucuucuugguccagccuguuaguuaggaagugggauuuagagauuccagucuucaggauuucuguguucugucaccugaaauucagcaucucuacaacaguacuugcagcagcagagcagucacaguagugaacaucuaucccuuaacugcacacuaagcaucaugcugagaucuuuagauacacucuccaacuucacccucacaacaauuuuaggagguaaacaguaugcccauuuuacugaaaagggaauuagggcucagagcaguuagauggcuugccucaggggcacgcacaggaaacgguggggcugggagugcacacaggucuaccuaccuccagcgccgggcuccgccacuacaccgugcugccucccuccagcuuccccuuguuccaaauggguuacagucucaaucucagguacaguuaacuggugaggccagagaggugauuuacaauuuugcgcugguacuacagaaaugacgccugaucugacucaaggcccuggggugcagaaaaaggucacuaagccccugggugaguucucaaacuccagcgcauauaagaaucaccagggaguuuaucugaaaaugcaaauuauugaucucuggccuuaagagagccugauuucucagucugaggccuuggaaucuacauuugaacaaacaccuaaacaccacccccagugcuucugaugucagugcuccacauuugagaagcacugccucugcaaggguguguguguguguaugugccugugcaugcacacaugugcauguuguguguguguacaugcccacaugugcuagucaagauguuucaguaaagcuccauggaggauagguauggaugugcacuacacauaaacuacuugaaaguagcuuugucauagccggguucaguggcucacgccuggaaucccagcacuuugggaggccgagguggguggaucaccugaggucaggaguuugagaccagccugaccaacauggagaaaccccaucuuucuaaaaauacaaaauuagccaggugugguggcgcaugccuguaauuccagcuacuugggaggcugaggcaggagaaucacuugaacccaggaggcggagauugcagugagccaaaaucgugccauugcacuccagcugggcaacaagagggaaguucugucuaaaaaaaaagaagaagaagaagaagaagaaggaaaguagcucugucuagacuuucauuauauuuuguagacuuuaccauuugaauucaaccuuugcaguuagaaugaccagauacccauuacaaaugaucaucucuuugaaaacuucugcuuggcauuuucaagaaacuuuucggcagaaagucauuugucuccuuuuucuggaccugggaacagcacugggaaguguucaggccuuuucccaaauauaaucccugagcguuuggaagcugagaauccucccugcccacggccuccugggacucuggauggccugccugucugccagagacacugagcaacuccaugcuggaaaugugggaaagauggucucuguccuggaggucuaagggucugcugggggagacagaacaggcccaugugaaagagucaggcacacaaauauaacaaaaauaaaccagaggcagauccaugcaguggugagaauacaagugaaacuuugaacucaagguccuacauuaagucaaagagaaguaggaagaaauggaaugaaaggugcuaggugaaccaugagaaaagccucccuagaggagguaagcuucauucauucauucauucauucauucauucauauguucacuccuucgcugacucuuguuuaaacuuaccgagggcagauccugacaggucaccgacacugcugcuuacccgugagcauagcagauccagcaucugccuuaaugaggaucacagcacuaaaugugcgcuagggucagggugaugugggggcaccacagagcaugcaguguguggacacacuccaggugggaagucaaggaaguucugcucaagaaaaugauguuuuuaucagacuccugaaggcagccucacccuuuccuuuagggggccagggcgugaguacaagggaggccccagcauguuggccuucccaccuucucuucccauccuggcuugugugccagaguauguauaccucaggccucaaguucaaacccuguccacacaucacccccacccccacugcccucuggccuggcuuuaggccuagggguuacaaucuacccucugaaggacugauccagauaaacagcccuugcagaccagcagugggcuuggugcuguuuggacagggaauuugggaagcguggguuuacaagggauaaauuaucuagaagugagugugcagccuauggacaggcacguccccuccaccccauagacuucuuacucuauggagagggcacagcuggacgacagccaguguggagccuucugaaaccugggguccagggcaggauccugauggcauggucucagggcagugcugccuaaaggaugaguaggguucaaugaauaaaaugccaggccgugugugguggaucaacuguaaugccaaugcuauggaagcggaagcgggaggaucacuugaggccagaaguucaagaucagccugggcaacauagugauacuccaucucuacaaaaaaaaaaaaaaaaaaauugaaucuggggugauggggaagccuuccugcagaaggaacaaccaguucaagauuccugagauguuaaaaagccuacuuuaccucccuaaaaggagggauauaggggagaggugaggugauuggagaauggacaggggccuggugggccaaaguaaagauuuggcuuugcagaggacacaagcaagacaugguggaccagggaaaggucauuuugaaugaugcaagaaaauuccuuccaaaaugagcaugugugacaccaauaagguauuugaugugaggagagggaguaaacuguucuauuuggcuaagcccaagaguacugagaaaagcaaaaggaaggaaaaaaagauauuuugggaggggcaguuguggaggaguugugggcaugguccaggggguuaugaugucaggguaagcccagaaccuucugggagaggugcuuaaagaauugggcugggggccagauucucuccucauucugugcuuacuauugaaauaagcaaaauaaucugcuaccauuaacaccuuucugcucuaguagcacucccuaugccuaaaccauaguacuuuauauuuauaugauuuuuuuguuuuucugugugauugcacagaaauucuuucuggauuggcaacacaucccauuuuccacuuaguaaaugugaccaccuuuuaugcuuuggucaacauuuugacauuugucacugaaucuucauuuccuuuuugugucauuuauuauuuuauaacuagcgguggcccucucaccauuuaaugcuuauaaaauuaugaauacaucagaccauaauaagaauuguccgugaggcuuguaaacagauguuggggugugugugcguguguguguguguguguggugugucuguguguguguuuaugauaacagugcuuacauaaucucaacaaccagggcccuggggacucacacucggcaauggaacaguugguuuaaauuagguuuccaugugaaauaugguaucgcuguuuuuuuccuagcauugugggaaaguauauggaaaaugauuugacugauaggaaauaaaucuggaugagugaucaggauugugacacaaaccaagugguggucuccaccugcccugugaagcagaccucuccagggggaggugaguuaacccuuuccagccacuggacuaguaagucaaugcaugguaucagaacagccugaaagaaugacaacuuuccagagacccugauuugccaucaauuucaacuagaaaggagcuaaagccauagagacaauauagccagaggccucaacaacuaaugaguuggguggcuuugagaaacuguuuuuuuacuuuucaggaucucauuuuuauuugugagaaguguuugaauuuccaacucaaagagucaguaggguuaugaugcuaaguguuugcugaugguuucccauuuuaggauagggcucaucaaaagccagucagacuaaaggaagaauuagauggaugcaccaaugacucagucucuguuagcaaaauaauuucuugcucuagugagccaggguuucacaaaggugacuuuuaaccaaggaaucaagugagaggacaggcauggagacugugagcaagggguuacucauagcugcaggagacgggucagcacuaggaaucccagacaguuccugggaugauguggaccaggguuugucccaagggucugauuccagaccuguucuccugaugccaccugagggcccagugaaguccaguacagauggagggcagaggcacaugcugggagcccacuaggcucaggacugagcuugaggguggcagguagcccagcacguuuugcuucagucuguuucagaagggaagaggaagauuauuaauuacuccagugccucuggcucauaccagagaauagaccuguuuuaucacuaaaacucccuguugcucugauuuuccuguuuguuucuauguagggauaggaaagaggugugagcaaccauucauuuuguuuuuuucaucucuuuagucauauuuuggacucuucucaguauuuucuccuuuuauuccugcucugccuucacauaugcagcucaaaacugagugcuuaggaggaccuacccagagccaagucugaaaaaacucaccuuucggcugggugcgguggcucacgcccguaaucccagcacuuugggaggccgagguggguggaucacuugaggucaggaguucaagaccagccuggccaacauggugaaacccaucucuacuaaaaauacaaaaauuagccgggcgagguggcaggccuuguaaucccaguuacucgagguugcagugagccaagaucauaccauugcacuccagccugggcaacgaagcaagauucugucuaaaaaaggaagaaagaaagaaagaaacugucaacuuucaccagaugaaagagcacugggcugggaguccuacuuuugacaucaacaagaauugugaccuugaaaagucacuucucccaugagccauagauucucgaucuggaaaaaugggguugcacugcccucugugguugcugccagcacucaaugccauuaauucuuaucauuuuauccacuuacaggcaguaugccauugaccuugagcucuuauuuccugcaguugucaugggucaccauaaacucuguguuccggccucucuaacuuaguccagagaaaaguguugcuguccaggcuucagcacugaugcugaaccaagcggagcuuguagggccaugugaggucaagaccaagacuuuggucuguugacaaccaagcuuaucaacccagaugcuagucaggauagagaagguaacuuagguggacaccagcaucuaagcaccaaaguaaagguggcagcaaaauaaucauagagcagaagcagaugauuuagaggcugcauaucauaaggggaggguguagacauggauuauuuuuaaauauuguccuccagucuguguagcaggaaaaacgaaucacauuagaauaacuuuaagcccagaacugaagaacauuagaguuuguguaaacacaucaggcauuuugugagugguugauaaugcaaccucuggagaagacacccuaaguucaaaccuaggcuuugcuaccuucaacgugguugaagaccuuacacacaucccugaggacaguaacagucccugacucuuagaauuguugugagagauaaaugagguaauauagguaaagugcuuagaauggcuccuggcacauaauaagugcucuauaaauauuuguucauaauauuuugucauuugaggggcauaauagauaaagcauuuguaaaagauuguuuaaaaauguuuuuauuuuuccuuugauauuauguauuuuaauacuuaguaaaugucuuuaacugauggguuaaguacauuucauuuuaauguccaucagucaaauaucuuucaaucaaaauuauccuuaggccuuauuuucuuauagucaaaagaaauuuuuucaaucaaaggauuuuaugaauugccuuuuucagccuucuuguuuuaaagaaaauaaagagagaguuauaagagauuaaggaccuauaggucuuuuuuuuuuuuuuuuuuuuuuuuuugagacagagccuugcucugucacccaggcugcagugcagugguacaaucucggcucgcugcaaccucugccucucgcugcucgcugcaaccuucaaccuugaagcugaggcaggguucaagcgauucuccugccucagcuucccaaguaguuggaauuauaggcgccugccaccaugcccagcuaauuuuuguauuuuuaguagaaacgggcuuucaccacgcuggccaggcuggucucaaacuccugaccucaggugauucgcccaccucagccucccaaagugcugggauuacaggcgugaaccaccacgcccagccaggaccuacaggucuuucauuuccuaauaccaaauugauauuuuuagaaaaacaaagaaugcuuuuggaaaaaaaaauugccaagcuucuaggacauaauucccgugaaugucucuguguguuuuccaggugagcuccugggugacauggcugauccucacggcaggcuccauggaggagaagcgagaagucuuuucauauuuggugcauguggccaaaugcugcuggaacaugggcaacuacaacgcugucauggaguucuuggcuggccucagguauagucaguggggaauaugguuaucuuggcacaaucgcuucucaucaccugaauggcacugaauuaauuguccagggacucaccuuuacccaagccagguaacuggaaaugauuaacuugggaaauguauuaucuucuuucagcaccaaaggcccugucccucaaagaugcugcagaauucagccccugugggccagucacaauccuacuucacugggucugcugugauccuguguucuuugccaagccaagugaaauuacuugguugcauaacccgaucaaccccaccacugacuauuccccuuccuguccuguaaaccccacuguuaucugucucuuuucaggccugccuuauguaguguuccagggcuauaugcuauagaccaccaacugcccuuaguaauaacaguggcuagcauugacaauaggccuccaauaauguaagcucucauuauuaacaaacacuauaugucaaguaugagcuaugcacauucccuauauuguauguuuuaauucucaaaacagguuuaucagguagauacuauucuuauucccacauuauacaaaagaggaagcuaaggcuaagagaaauuaagucauucacccaaggucaccuggcauugcugggaauacaggcaaccuugguuucggagcccaugagcuugaccacuaugauauccuguucuuaugcuuuuuccaucaagcuaauaacaaaaucaccauucuguucaucagguugccugcuuuauccccuuuuagccucagcuaccuggcauaaaguaacuguucuuacuccugugggaggcagcaugguaugugaggaagaagagcaugaguucuuaaguuagaaucaaauuaggaaucaaauccuuauccaggaaucaaauccugauucccccaaggaauaccugugugauccaggcaagcuacuugacuucauugagccucaguuacuuugucugcaaaauggggauaauacuaaaaagcaccuacaucuuuagguagaauucagugaaauaauauaguauuugacacaugugcguggcguauaguaaggccucauaaagagaagcuauugauauuguuauugcuuccugagauucaccauccucaugaggguucucacuauaaaggaauguuaguucauaacauuacugagauuuuucuuugauucuccaggucccuagguagggauucuggguuaggggaggagaugaaaacucccagaguucuaauuuuuuuuuugucguuuucaacuuucuuaacuuagaauaaacccaaaugaucauguccuugacauuuaaaauagucauacaaaugcaucaggcauggcucaaaagaaggaaaaaguggggagaaaaaaaaacaaagccuuggagaacaggagguuauauccagaugauuuagauucucuuugugaucaauuuucuauaaagaaaacguguaggccgggcacgguggcucaugccuguaaucccagcacuuugggaggccaagguggguagaucaccugaggucaggaguuugagaccagccuggccaacaugguaaaaccccaucucuacuaaaaauacaaaaauuagcugggcaugguggcaggcgccuguaaucccagcuacucaggaggcugaggcaggagaaucgcuugaaccaggagguggagguugcagugagccgagaucaugccauugcgcuccagccugggcaauaagagggaaacucuguaucaaaaaacaaaacaaacaaacaaaaaaaaacagaaaaaagaaaauauguauuacauuucuuuuaagaaaagaauuaucauauuuugauaaagucauuuuauuuuaaugaugcuuaucauucugugucuggcaaguuggugcuggcuguuggccagggaccuugcuuccugaccccacaacaugacugccaucacagcacggugacuggcuccuucugaagugggugauccaagagagggaggcagaggcugcaaugccuuuuauaugauagccuugggaaucauacauagucacucuugccauauuguacugaucacauaggacagcauggauuccuuguggguggggacugcacaaagccacaaaaucaggagauguggaccaugggaggccgucuuggaggcuggcugccacauaccauguucuagauucucuuauuacaggaacggccucagagugaccuauggaggccuagagugaaugggacuuuaagauucaacugaguuuaaauccaaaauccaagaagaccauagaaccuggugauuucccuaaaugaggaauaaucucaaaccaggacagaccucaacauugaucccagugcauuuugucucacaccccagacccacugcugccuaguuucaugcuccuauauuuggcuuaaaacuaaacugaucuuuacagauagauaggcgaaaguaccacguauaauaggucuuuuguugacagcuauucuguacacaggagauaaguggccagauacucuuaugaugcaaugauuauggaggcagagcuuauaugugcacuuuuagguuugaaaguguuuagguuccaagcaauuaacuauuaccaacauaauagagauuuuuuuuauuuuuuaagcaauuaaaugggaagagaaagcauacuuauuaagugacuuugguuuuuuuauggacauuguacauuuugcuuccucuaacuaaauucuuagcucucuuaagccacuaguaagaaguacaaauauuuacaaucaagaguauuuacucagucauggugucaguuuaaaauaacccaaaugaacaacaauaggaaaauaguuaaaggaaauaauaugcuauauccagguaauggaauauuauauagccaucaaaaaugauguuuauaaaaaacaaaauuuuuuuuuuaaacggagccucaccgugucgcccaggcuggagugcaguggugcaaucuucgcucacugcaaccuccaccucccagauuugagcaauucuccggccucacccucccaaguagcugggauuacaggcacgccaccaugcccugcuaauuuuuuuguauuuuuaguagagauggacuuucaacauguuggccaggcugaucuuuaacuccugaccucaagugauccacacgccucagccucccaaagugcuaggauuacaggcaugagguaaaaaacaauuuuuuaagagauaagaucucacucugucacccaggcuggagugcaggagcaagaucauagcucacuguaaccucuuacccugggcucaaguaauccucccacuuuggcuuccaaguagcuaggucuacaaggaguguaccagcacaauggcuauuuaaaaaaauuuuuuuagagauggagucuuucuauguuucccaggcuggucuggaacuccuggccucaagugaucuccccugccucagccucccaaagugcugggauuacaggcaugagccacugcaccuggccugaaaaguuuuuauaucauuggaaagcaggagacacauaauacaugaaucuaucugggaacaaaacugucuaucccuaauaaccucagcaauauuuauaugcccauauagacaagaauagaagaaauacugaaagaaaauauaccuaaugucugugugugguagaauuguaaguggguuuucuauauuuuugauauuuucuagauuuucuacaaugaguaguaucuuuauaaucauaaagaugaauaaaaguuuuaaaaauaguuucaauucucaauucaacaauaaagaauugaucuuugcugaaguuugcccuuugcccccaagugaaccauaacuacuucauuacucacacaauaagaaaccagugagaaccaugucucauucauucauucacuucauuuguuuguaaccuccacuucauuccccaaaaaagaauucucacugucuuauaagaauccaguuauaggacaagcuggauuuagugggaugaaaucauaaaaugcuuuuacuuuucugauuugauugccuuucaaagcuuccaacuagcucucccucccucaacccuggauuaugcuacauugagagauccuguaguuuuccagucacuuuccuaguuaacacacaaucucauucuccuaugcucuugaauaugaaugagucuugcaaauuuaaggcuguauaaaaaaaaaaaaagcaaguuguuuaaaacagggauccccagccuuuuuagcaucagagaccaguuucauggaagacaauuuuuccacagacucggggugugggggugggggcagaugguuuucagaugaaacuguuccacaucagaucaucaggcauuagauucucauaaggagcgugcaaccuagaucccuuacaugcacaguucacaguaggguuugcgcugcuaugagaaucuaaugccacugcugaucugacagcaggcagagcucaagcuguaaugcuugcuugcccgcugcucaucuccugcugugcagcccaguuccuaacaggccaugagccaguacuggucugcggcccagggguggggaccccuggucuaagacuaucuaccaugugauacuauuuacauaaaguuuaaaaauacacaauucuguaacuugcuuagugauauaugcauauguuggaaaaguauuaagaauuuuaaggaaaggagaaccccaaaguaccaguggugguccugucuggugagggaagaauagaguaugugcucuuggaggaauacacuagggccucaaccacauuguugauguuugauuuuuuaaacugagagauuggcacauggguguuugucauguuguacuucuuuaugucuuuggaugucuuauauauuacacagugauuuuguaacccaguuaaucuaaaucaaaauuuuaauaucucauucaauauauaucuucuucccuuccuuacguuucacaacccaaccagucucagagacuuguaguagugaggaagauagaguuuaucuuuuuucuuccuuuucccugcaacugggugucugcagaaaagaaguggacaggagaggagaugggaaaggauggggauagagggagcacagagucuuacuugauggggcaguuguaaucuggccuuggugcccucacagagaccaauggagggugcuuuuagguuuucuuacuaguuacucucucuaauuuuuuccaucuccccacugcacaauuaccuagcaaaaugcaguguacccucuggucaaccucuuauuccucacccccugggguccuguccucacaggcccuuucugcuagggucgccucauuuggcaggcagacccuucaagacagcucaagccccaccucuuugcacaguauccccuccugacucacaggaaauagucagcauguugcccucccaacucugcaagcacaggacauaucuacuggaauccucucucccuuugccaccagggagcuccagcuagccucaaaucuuuaggcaagagucaugcaccaguucacgugaucuacagacugcccgggacacaggucaauguccccagggaauucacuuacugcccccugcacuuggggugacuucauccucucacagaaaggugagcucucccacaauuccccccagagaaauauucccaagcuaucugcucagauccacuuucucugcaugggcugaaagagagugggagaccacugugggcaaagcaguucagguaacaccuugugagggccucucuuuagaagguguggugcauugucaucugugggucucagcaggaguuucagaauagggaaagucccacuuaacauccuguaaugcaaauaauacuuuacaacaaggucccccaaaaugggcugguggcuucaugucaaagcuugauucaguaaaaaucaauucuacagaagaggugaaaacaaugggcuucauguugaucacuaagggacuggauugauccaagaguaauauuuaaaagaucaagagggccagaugggccaaguuuccccaggcaguccuccuccaccaauaucuguacaaaccacauuacccucuacuuuccccuuuuggccauagcugccagaaaaacucaaaccuacauucagugcccagcuuccauaacuaacgcgucccauaugccuauuuguguuuguaucuguccuauuuauuuuucaguuucaauuuacaaaaguauuauucauauuaucuggggaaguagguggggauaggaacccuacauaaauauuaacaaguaaagaauauuggggcugggcgcgguggcucaugccuguaaucccagcacuuugagaggccgaggcagguggaucgccugaggucaggaguucgagaccagcuuggccaacauggcgaaaccccgucucuacuaaaaauauaaaaauuagccaggcauaguggcgcgcgccuauaaucccagcuacuagggaggcugaggcaggagaaucgcuugaacccaggaggcagagguugcagugagccaagaucgcaccacugcacuccagccugggcaacagagugagacuccaccuaaaaaaaaaaaaugguaaaaagaaugaauuuguauggaauuuaggcuccuugcuguaaacuauauuauuucuccuucagucugaaaaaugucauuuacuugcaauaggucaagaaaaguuuuaaaaauguggcaguucauggaccagucugauauugagaccaugaggagccugaaggaugcuauggcccagcaugaguccucuugugaguacagaaagguggugacacgugcccugcacaucccuggcuguaaggugguuccauucugugggguguuucugaaggagcucugugaagugcuugacggcgccuccggucucaugaagcuuugcccgcgguacaauucccaagaagaaacuuuagagguaaggccuuucagaaucaucguggccugaagagccacuguugcuggcugucucaucaggcccugucugugcucaccaaagaaaugaucacugauugaacacaggguuaauaguuguuauauuauuucuggguagcacauagauccuuggaaguucuguagaaaagaaugccaacuagcgcugugugggacauaguauugugaaguuaguuuuaauguauuagguuuaauauguaaguacaagucaaaaaggguguuguuuucugaugguuuuuaaagauugacagguuuuucuuauugggugggaaugucuggaugcaggggaugaagacagucaauugagaguauuaaguuuuccacaucaguggaagaaaaaagaggggaagucaacacugcuuucuguucauccuuugugggaaaaugcuggggagccuggagacgcauguagagacaagcuccaggcuccugauccucagagccuuguuucucccagauccauugccuccuguuccugauucccagagcagaagggacagugugagcuuugacccaaggcauugggcauuggagagaaggggaguugagaaacuggagggaaaagauaaggaggcucccuccaagguguuuaaaaaugaaagaagugacuaaaauggaaagaacuuuauggagauuuugagaagucccuuaccggggaccaaacccaaaucuaggaucauuccugccaugaugacagaaccuacuacugaccuuucacacacacacacacacacacacacacacacacacacagagucauguacaugccuucuccauggagugggaagacucuccucaaccuucagccucuucuuugucaccugggagcaaaggcaucaccugauaucagaaagacuuaagagcuccugacagguacaggcaacaccaccggcaucucucuggguuaugagcuaggauaaaagggcaagaaauggaggagaaagcuuaaaggaagacucccgggccacacccccuagcuuccucaugucuuaagaagagggaacuccacaucucuuaucccagacacagcucucaccucugaugagagaagcuuccuaaucaacuguaugaacaauaaggcuuaaagagcuuaaaaaccaggaagaagccacuguguuauuauagaacacaugagcaauaaagcaaaacaucaccucuucucaguguuuugcuugggcccagucauuuuuucugguuccauagaauagcauacuuuacucaugguuuuucucaguucucacuauaaggauaaaauaaccaugcucuuccucugcaaauuggcuaaucuucuccuuagggagcccugaaauaauauuuuuuuuguuuuaaauuugaaguggagugucgauucccagagggauuaaaguugucucaguggaaacaagggugaguuuugauauuucauguggugaaaugaaaaaauguuuuuccuggaggcucuuguuuucuuucccauaaaauaggcacaaaugccauuauuuauuacuuuaugauuucauuucccuagccaaguauguuauccaggcauauuaaguugcaauagcaaauucucgauuuuuuuuuguaguuuguagcagauuacaguggacaagauaauuucuuacaacgagugggacaaaauggcuuaaagaauucggagaaggaguccacugucaacagcaucuuucaggucauccggagcugcaaucgaagucuggagacagacgaggaggacagccccagugaaggaaacagcuccaggaaaagcuccuugaaggauaaaagccgauggcaguaaguuuuacacguuaaaagugaggaaugcucaucucuucuuuuuuccuguugaugaguuguuuccuacuucagcuuaguuucagauggacaccucaucaaaaccugccacuuuuaucauuaagccacacuucuuuaucuucaaaccuuaccaauuccaaauucacauuuaccuuucucauuuugcugcuuuguucuaaaauuacugcucauaauuuaacuucuuaccaucuguuaccccuuuaaaaaaaaaacaaaaaccuagagcuauccugccauuucuaagaauucaacacauuaaauuucagaaggagagcugugaucuuuuauuuccuaguuuuuguaacagugguuuuuuuaauucuugggugggguacuaggguggguauuaagauauuuuuaaaucaaaucuacugacuuaguuaggucugggugauaccuagaaaucaguauuuuuaucucugccaaccucugggugauucuaagucgaggguuagugaucucacuucgagaaacacugcucuguaagguguguuaaaauuaacccuacacacacaaggcaucugcagguuuuuaaauugcucaguaauuccaguuucucagagauuauuucaaagauuuuucacuuaacagguugcuaacauuaguggcaaucuauauauagagagaagaccaucugcaaauaaucaccucugcacagaaagccucucagagccauuuaaguucuuaaucucccucucucucucucucggcaucuauguauauaucuauuucuuccaacaaaagauuuuguagaugcuuuuaagaauaacuaugaauaauugaggauauuaaagaaaagaaaaauaagaauaugagaaaauaaaacauacaaaaauguauacuauguagucuauacagugacuaaauuuuguucugagauuccuagcagucaaaggaaagaggaaaucacaauucauuauaaguuucacaguauuuguaagaaaaauuaaacagauguuugggagaagaaugccuucuccucauacuggaucuggcugaaauuccuuccuuaaauccuacuguuaaggcuaggauacaucagauaggaauagauaaaauaaugaauuucauauggcucuuuuuaaagagccuucaucuuuaaagaugaagcuuuacaauguggcuucaucuggggcuguguguguaugucguuugaccuuucuaaaacaccuucaggacugccacuuuuacugagugucagaccccuagacuauccuuuccuuucccucgaaguuccuucaagugguaacuuucuugcaucauuuucacccguuaugaaauuuuugucucuaauuuucuccacagucucuugucuuuuuccuaaucauuuuaucacguacauccuaagaacauuucucuuccacugcccauuuuccaagcccugcugcaagcacucuuagaagaggagaaaaacacaaaaaugcagauauuucuuuuauaaaaccugugaagucauauugaaauccucacuuugaaacuuguguaccuaagugccagugauagcuucuuuaccucaagugacugcuacucugaaaggaaccucaacacacaaguuagguugguggggcuguuuaauagaauucaccaaaaccagaucaguaagcacuauuucuguggccaucugcugggacuugggaauccauuccugauugagagccccauguuuuguccagugcaggguuaugugugccaaagaugugcagauugaaaagcccauaggaacuaugcuuuguugaucuggcugaaacagagacucuacaaacagcaaccucuagccccuguucacuuggcaacaaccagcccugugaaaacuacagcaaagaaagaagggacaaucucaugguccuuugguuuaccccaccuacagggugcucuuauaauucuucccaaaccucacagcuacuccugccagaaaaccacuagaaacacucauagaaaucucaaaaagugauuauaaaaaguucaagauuuauuuuugcugggcccgguggcuuaugccuguaaucccagcccuuugggaggccaaggcagguagaucacuugaguccaggaauucaagagcagccugggcaacauggugaaaccuugucucuacaacaacaacaaaaaacaaacuucaagaucucagcaggaagggaauuggguugaaaaaaucuugaaaugucaauggggucuucaaguaggcuugucuaacuucuguacagaugaaguugugccuagcgagcugaagucgcuugucugacuaauaaacaguagagccgggucaugagccugaccauguguucagucacaggggaggauccuuuguccuaaaaugcuuaaggcauuucuuuugauuguagagagacuaacccuuagccucuuuuuaugucuaacuccugaagauuaggaacaucugaauucugaaagcauuccaauuacauuucauaugaauuauaaugcucauuaauaauuacuuuuuuauuuaccagcauaaagaauaaauaaacuaugcguuuguauguuuaaaaacauauagaggcauggagaccuaagaguagcauguggcaccauuguugggaaauagaaaugaggaguaugaagguguguagagaagaguauagagucauauaggagcugcaaguucuuauugucaucauuuucaauauuguugacccucuuuggcaugcugcaccuuaagaaggauuuguacauuuggaaaaauaagauauaaguagaugaugccagaaaccuacaauggaagcugcuucagcugauuaagaacucaaaccuuccagucacauugccugggacugaauuuugacaccaccucuuacuauuucugucaccuagguagguagcugaaucuuacuaagccucaguuuugucaucuguaaacuggaaaugacaauacuacuugauaggguuuuugugaggauuauaaauuaagcaaauugcacggcauacuauaagugccaauauagaugguggcuaucgugauuaauguguguaucacacccuuaaaauaccaagcugaaguucugagggugauaugguuuggcugugccuccagccaaacucucaucuugauuuguaaucccuauaauccccacgugucaagggagagaccagguggagguaauugaaucacgggggcgguuucucccauguguucucacgauagugaguucucaugagaucugauggcuuuauaagugugugguuguuccuccugcguucauucuuuuuccugccaccuugugaagaggaugcagcaaggcuucaccuucugcuuccccuucaccguccaccaugauuguaaguuuccugaggccuccccagccaugcugaacugugaguuaauuaaaccucuuuccuuuauaauuacccaaacucgggcaguucuuuauaacagugugaaaauggacuaauacaggagguuccagcacuuaaguguggacacccuuggcaguaaucaccauuucagaggcaauccucagucauccuccucucccuuacugcaaagagguauuuucuguguccuucuaccucaauaaccucguuagagacgcgccuggacgauaauccaaccccauagggauaggaaaaaaagaaagcuaagcaugagaaaguagaauaucugagaaaagauaauaguuaccaggauuaaccacacacacacacguacgcauguggaugccccaaaucauaaaaugauaggaaaucaguuauucuccacagggaaggaugcagacaggccucaaccuuaucaaugcccaacacacaacauccuuuaucugcaacagcugccucagcccagcccagaccuucauacagucucacuuucuggcuuugcuggggauaccugggauccuguauuucucucuuucugcuucuuuggccaacaccugagacccaacaugauuuguaacagagaccauuuucccacuaucugcacaacauucaccuuaggcuuuuuucucacuuaaaucucaacuugaaacuuggacaccauuuuuacagagaagcucuauuuguauggaugucuuuuguuuuaugauacuaacuuaaacucaagccagacaacaauaacauuagcaauauuuaagaugcuaauguuuauugagagccuaucuuuaagcaaacacugcucuaaauucuuuccauauauuaaacuauuuaaucuucacaacaguuccauuuuacucucauagcuagcagggccaggauuuaaauucaggcagacugguuccaaaacccacagacuacucacauauaauaagagaaugcuuauagucaaggaaggugcuagguuaauuaaaagcaagaauuuuccagaagagagcauuaaaaacgcuagauuuuauuagagagaacagcuguggcaaguccuuuggaaaggacauagauuuacuucuaucuuaaaaaauuaaauuuacgcuuguuugucacgugguaauucauguucaagggauuauguuaaauuggcaggaagcaaacgaacacuuacaaagaaaauauuuaaccagguuaacaaauaccuguugaucacccaauguaaaauuuucaucagggaacauuagacaaguauuuaucugucuacgguuucuaacugaaugauaccauggaagcucuuuaggaacaggauaaaaaccuuucuucuauuuuuacuccuugguccucuccuuaaggcauacaaccugaguuugacaagauaguuucuuugcugguaaaccacaucuuugaucuucgguuaacauuauuuaguuccuaaauaagucuuaacauuccaccuuaucccuucuuguaaacccacaggaaauuaucuucuaagagaaucaggcacaaaauugcauaacauucacuauaucauguaagagacaaaagcuacuaguuuccugcuugaaaugaacuuauuucauuacaaacaauugucaauuuuauuuugagcauuagucccuggaagauugcuuuuuaauggaauuauuaccaucuggcauuaguucuuuuuugcauucuaaaauaaaaacugacgccaagaaagacagcguccccucucucccagcuuacaucaucucugagcagcagaaacaggcuccagaaaagccuuauaauuuuucuuuccagacacuauuuuuuuauaaugcuugugguauuucacuggaacaugcuugacuuaacucagaacuuaaauggaauauggaaaacaccauuuaucuugcuaaauuaaaaucagaaguucuauguacaaauuuacauguuguauuuuaauggguacuaacacucaccaauugaauccuuuuugcucuuaaaacaacaagaaguaggacauggagaauguggaaauggucccaaaagaaagccccuuggccgggcaugguggcuccccccuguaaucccagcacuuugggaggccgaggcagguggaucacaaggucaggaguucaagaccagccuggccaagauggugaaacccugucucuacuaaaaauacaaaaauuagccgggugugguggcgggcaccuguaaucccaacuacucaggaggcugaggcagaauugccugaaccugggaggcggagguugcagugagcugagauugugccacugcacuccagccugggcaacagagcaagacuccaucuccagaaaaaaaaaaaaaaaaaagccccucuagaggaacagcugggcugggcugagguagccuagagaagaggaagugagaaaggaaaagugcaaagaauuggucuuccuauauuuaaugaguguacuuuaccaagacaggcgcugugcuaagugcuuuccaacuguuaucuuauuugaucuucaccauuauucuaugagaugagcauugucuuuuugccaucuaauagugaggcucagagagguugaguguuuugaugaggucacacaggaaacagguggugauguuuaacauuaaacccaggaugacugcagcaggcauguaugaagccauuguguaagaggacauaaguauugguuuuccaguguuaccgagagcaauuucagagggauggagcuaaauaagacacaaaugauuuuuuucuuauuucacuuuuuauuaugaaguaacauuaggaaaagagcauaaaauaucauguaaccccagaucuuguguuuuuuuuguuuuuguuguuuuauuuuuuauuuuuauuuuuuugagacagagucuuguucuguugcccaggcuggaaugcaguggcacaaugccagcucacugcucacuacaagcucagccucccaaguucaagcaauucuugugacucagcgucccagguagcugggacuacaggugccugccaccacgcccagcuaauuuuuguauuuuuaguagagacgggguuuuaccauguucgccaggcuggucuugaacuccuggccucaagagauucaccugucuuggucucccauagugcugggauuacagaugugagccacugcgcauggcccagaucuugguuucuaauaccauucuucaguaaagggaggcaagguuucuccuagagaggcugauucgaggacuggggcagaaaauacacaaggugagccuggagcauguuguaguaaggaaguucucaaaagaaacacacagugaugggagcugugaaaggaauacaagaaccaacuggaagagcucccaauagccacagcaacaaaauaaauaaaguaguaucacauuauaaaucacccaaaguauuaaauuaauauucaugagcucauacugauacaaguaaaugauauguguaaaugauaaauaaacaaaugggggagaagagauccaucuuuugugcaaaagaauucccaauaacuuaggcagauucuucacccucaaggaagugcaacauaacuccccacuccuuaagagugaguugggcauggugacuuuuucccaaagaguagaguauggaaaugaguuaaaaauaauaauaguaguaacuguacaguggcacaugacacacagguccucagccaggugaucaguaucaccagagagaagucauguugguaguaggugcccucaauaugaugugauaagaaugauacuuuaccucuauggucuucccuccccaaacccauaaccugcaucuaguuauggaaaaaauaucagccaaguccuaacugaggggccuucaagaaaacaccugagcaguacuccuccaaacugucaagagcaccuaaaacaaggagagacccucauagucaagaggagccuaaagagaccugacaaguaaauguaaugggagauccuggaagagaaaagggacauuaaaaacuaagaaaaucugaauaaaguguggaccuuaauuagugauaauguguuaggauuuguucaugaauuaugacacauauaccagacuaauguaagauguuaauagggaaauuuuugugugagguacacugucuuuggaauuuucuauaaaucuaaaacuauccuaaaauuaaaaguuuaucgaaacaguguauuugaauaauuaucaggugacugagcauaacuagcauccaggguuagaacauugccagcaccccuaaacuucuuauuucccuucugaauuauuaccagccucccccuagagaaaacuacuauuauaaguuuuacaauaacaucuuguuuuucuuuguaguuuuucuacuaauaugccuuccuaaauaguacaguauaguuuuugccugguuuugaaauugacauuuacagaaauguauguauuuauguaucacaaauacauaccauaugcauucuugugugucuugcuuaaaauuuguguuauuccauguaguuagcuauugcuuauucauuuucauugcuguacagaauuacauugcaugaauacaccaaaaucuaugcauacauuuuauuguugcuggacuuuugguuauuucugguauggggcucugaaauggauuuucucaccgucagauuugugagacacuaaaauucaauauuugugguagacuuuuuuuuuaaagaauauccacguguggggcaaggauguagaaccugcuguuugaaagcaagaaugguaaucuuguucagggaccauagucuaaacugaggaguaucaacaagccccaugauacugucguugccucaucaagaggcaguagguggcccaagugucuccugagcaugagagccuuccuucccagagacgcguggaccagccuauguaccagcuccuucacaauuuuacucaccacuuugcuggugaugucuguggaccaaauagcagaaaccuugaucuuacuaacaacuuccuaugcuuugaaaagaaugagacucuugggcagguuccugccaagguggccauguaagaaagaagcaaucgcuugccuucacuguucucugauccucuuggcucaaauaauccagguuccugacucagcggagggaacgugcuaaauuuucuaugcaaacuagccuuuucuguguauaccuacacacaugcacagagagaguagaaaucuaagguugaguccaggagaacuguuaugcuuuucuggccaccgugaccauauuucccaaggaguguccuuuuuaaaugucauuuauuuuuauuuuuugagacagggucuugcucuauugcccaggcuggaguucaacgaugccaucacagcucacugcagacucuaccucccaggcuccagcaauccucccaccucagccucuuaaguagcugggacuauaggcaugccaccauacucagcuaauguuuguauuuuuuguagagaugggaucucaccauguugcccagccuggucucaaacuucugggcucaagcagucugccuacuuucuuuccaaggaguaucuuugaacuaauuguauuuuauuuuuaacaguuuaacagagguacuucucaagccagccuauuaaguccuuuuuuaaccuaaaaagguuaaaaaaaccuaaaaaggacuaaagucccaguauauucagaucaugacuuguguuuaugauuuaauugaaggcaaacaagccuaacaaugaaaaucccagguauaaaguuagaccaaaaucucaccuuggcuuggccuccucugagagggguuaccuugaacaaauuacuuucccuuucugaaccucgguuuccucauagguagaaaaagaauaauaaaacuuaccuugcaaguagauuggauuuaguacaaaaaauguacauaaaguauuuaacacgguuccugacacaagaaggaaaacuaauacauaauaaagauuauuguuguugagaauaaaaauacaauaacucaucuaguaguuguuuucuuaugcuuauggucagauaccuugcuaaagauaagaauacaguuauaaagaauauuagaauacgguuauaaaaaguuacucaaaauuuuuuuuuugcucugucgccuaggcuggagugcaguggcacgaucgcagcucacugcaagcuccgccucccggguucaagcaauucuccugccucagccucucaaguagcugggacuacaggcauaugccaccaugccugacugauuuuuguauuuuuaguagagaggggguuucaccauguuggccaggcuggucuugaucuacuggacucaagugguccacccucagccucccaaagugcugggauuacaggcguaagccaccacaccuggccucgguuauuagaaguuacugugugcuauuuaguauuuuguauuuccuaugcuaauuugaauucauagugcgaugaaaaauaaagcccagugucagugaaaaugucuuuggguuguucucacuugauuauaagacaaaccaaauugguguuucuuuccuuaagguuuauaauuggagauuuguuggauucagacaaugacaucuuugagcaauccaaagaauacgacucucaugguucagaggacucacagaaggccuucgaccaugggacggagcucaucccuugguacgugcuguccauccaagccgaugugcaccaguuccugcugcagggggccacggucauccacuacgaccaggacacacaccucucugcccgcugcuuccuccagcuucagcccgacaauagcaccuugaccuggguaaagcccacaacugccuccccagccagcaguaaagcaaaacuugguguacuuaauaacacagcugagccuggaaaauucccacuacuggguaaugcuggauuaaguagccugacggaaggggucuuggaucuuuuugcagugaaggcuguauacaugggccacccuggcauugauauacacacuguguguguucagaacaaacuggguagcauguuccugucagagacuggugugacauugcucuaugggcuucagaccacagacaacagauuauugcacuucguggcaccaaagcacacagcuaaaaugcucuucagcggauuauuggaacucacuagagcugugagaaagaugaggaaauucccugaccaaagacagcaguggcugcggaaacaguacgucagccuuuaucagguaaggggugcagccaucccucuuuccucacuggcauaauacucaagagcacacacugggugaccagaccaccagguucaugcucccagcucugacaguuacuaccuguggugaccuugggcagcuuuuacuuaaccucuugguaccccaauccccuuuucuauaaaauggaaauaauaacaccugcucacaggguggcugugagaauuaauugaggcuguggcucacgccuguaaucccagcacucugggaggccaagauggguggaucacccaaggucaggaguuugagaccggccuggccaacauggugaaaccccgucucuacuaaaaauacaaaaauuugcugggcaugguggcacaugccuguaaucccagcuacucaguaggcugaggcaggagaaucgcuggaacccaggaggcagagguugcagugagccaagaucgugccacugcauuccagccugggcaacagagcaagacucugucucaggaaaaaaaaaaaaaaaaaaaguuaauauguguaaagccacaguauaauucauaaguaugaagaauaguaucugcacucauaggugguccuauuuguauuuuguaugaaauacauuuuacuuagauuuuauaguaacugaaaaugcuuauguuaacugguuucuuugcagaugggagaacuauaaugacccuggucgcgguuuuuauuuuguauuauauuuauauauuguauuauacuacauaaaaauagucccaggaucauuguaguucucccaucugcaaagaaaccaguuaauauaagcauuuucacuuacucagguuucaauggaaagcauuguuaucugaauacuuuuauuauuaguuagugacuagcugauucacugaaaacugucccuauugaaauuaaaauccugguucauuuccuaacaugcuaugugacuuuuggagaguucuuuaacuuacugcauauugcugccuaauuguagaggugagggguuaauuucuuuaagguugaaagaaauuuuuccaaaugugggauaauucuuauguggaguucuucuuuauuagguuuguagugguggcagcccuuagugggcaguuuuucacagucagcugcuuacauugagugaauuagucuuucauuaacccuacguuaucagguacucuaacacuauaguuuagcguggcaacagggcugggcugaaugagauagaagagacacaggcauaaccagaguagcaucccuuggggaaaagaggauacagauugcuuggaaaucuuaaacuccacaagcaggugacacuugaagugucauucucaaaugaguugugucaaaguauucaguuuuucuuugcuaugcuuuucuaucuucauggcaaaaagaaauaucuuuuguauugucacagaacaaauagaacuaccacuugaacuacucaaaugccugauuucauguacuugucacaguucuaauacauuucugacaauuaaaaacauuucucgccccaggaaguuagacaaggcacauguaaugccccuucuuucuucuuucccuacacccaugucacgauuaugagcagagaccauauccugagugacuaacuugauuaauugauuaauaagcagauaggccuauguacacaauuauccuaauguuacacagaacaaagccaguuuuaguuaacucgucuaaaauggaaaacaaauaccugacuguguguggcggcuuaugccuguaaucacagcacuuugggaggcugaggcgguagaucacuugaggucaggaguucgagaccagccuggccaacauggcaaaaucccgccucuacuaaaaauacaaaaaauuagucaugcaccuauaaucccagcuacucaugaggcugaggcaggagaaucgcuugagccugggagauggagguugcagugagccaagauaaugccacugcacuccagccugggugacagagcaagacugucucaaaaaaacaaacaaacaaacaaaaaauacccgccuccuguguacuccacagggcacagggagcuuucaguguacucagcuggaaaaaaaaaaaaaagucuucaggagcuauugugaaugucaguuuuuaauuacagcuauuccuuggccuucuagaaucaggaaaauucaucaaauauggacauagaccaguguuugagcucaauuacaauuccugucacaaagucuaugugguuuaguuguuccauuugucugcuucucaagcuuauagcauagguaacugaauuaauacauaagagguacuugguuucucauuuacccuggcacucuucagcuuuuacugaaggaggcaccagcugagaccacgaacggcaggugaagagguaagaguugcugcuagaacagagacagaagugacuuagagaagacucaguccuacccagcugcaaacacagcuccacccucccccaccaccccugcacagaaccaagauguuacaguguagaggcaaaacagcucauacucaaccacuucugaaauauaggugauguuauuccuugacacugcucucucuacaugagccauuuaugaagucaggcaacgugccuuagaaacagacacucaagauuucuuucgaaagaaaaaaguuggaaagaccaauggacugaucauuuucucaucauauaaaccaguucccaaacugacucagggaucaccaaaaagaugcuaacuuaguacucagagaacaaaagaucaaaucuuuuguuaauguuuaauagcuguauuggugauuuauaauaccucuuagaaaauuaaauucucucagaugcccuaaaguuaaaaaaaaaaacuauuuaaauuuaccuauaagcuaaagaaauuugugaaacaauguuuggguuuuuccaaacuucuguuaacagcucuauaagaggauuuuuuaaucccuaguuugggaagugcuuauauggaaaauaaucauucugacauuagaauuuccuuauguaguaaauguaagugaaguuacuuucaaauacuacaaguauuugaguacuacugauggaaguaguaacaagagauaacacagaagacaagaagaaguaauaacauuuguagagaagccuagaaaaauacaggaaaauccaagaaaguaaacugcagagauguugaugugggguguggaggaaagaccaaugucuugagcuuuggcccaagguuaucauggacagaacugauggcccauaauccuggguauuuggaaggugcucugggaggcuaagaaaguuaaauauggaauuaccagguaaauaucuuugguuauaagcaaaaaagauucuggcuaucuuuacgugggggaaaaaaaaaagauucauucaaaggauguagauuaguuuaauggucuucaaaaugucacaugcaaagauaugccaagagguaacagugcauggauauuuuuuaaggaaucuauuuucuaaucuucaacuuucacauaaacuguuuucuccacugcacuccagccugggcaagagugcgagacucugucucaaaaaaaaaaaaaaaaaaacuguuuucuaaaauugaacaugugccuucacuuacaguaguccaucucccacauuaaaaaaagaagguaggccaggugcgguggcucagagcuguaaucccagcacuuugggaggccgaaguggguggaucacuugaggccagggguucgagaccagccuggccaacauggugaaacuccaucucuacuaaaaaugcaaaaauuagcuggguguggugguacgcaccuguaaucccagacaccugggaauugaggcaggagaaucaguugaaaccgggaggcggagguugcagugagccaagaucacaccacugcacuccagccugggcgacagagggagacuccaucuccaagaaaaaaaaaagagaagaaaguauauccuucauccaucccaaacaaguuuauuauuuuguguaaaacaaaagaaagauuaaaacuacauuuuacuucccagaaagcuuccuuuaaagacuaaacaaagguauccuuccuuuuccugaccuaaacauauuucuguuagugguaaaguuugacccauguugggauguucugaaauuagaaaaaucaaagcaguauagguuaauggugccaauuauuuuacauguaaacuauaaugggccuauuaagcuuuuaaagauguauugguuaaaauccauaaauaaaaguuuuacucuucuuucagauucagaguauguuauucaaaaugguaguuaaaacguauccauuagguuucauucaugaaauguuuauuccaauuugaagucacuccuagugacuuguuagcagggauucucuucagcaggccuccagcagauggacugaucuccaaccauuuucauucucuguaucacugcauucaagaacccugcuccaggaaggggcuucugauuggcuuauugggaucaugugccaaucauuggucaaaggaggauauuucaucuugauugacacacccaucgagacuauauccaguggagaauagacaguuaaaguaaaaucgggguaugguuagagaagggagaaacagaucauggacagccauaagucacaaugucccacuauaagaggucacccaaagguuucuuugucaaguacccaaguuauucagcauccugggauccacagcaggaugcaggaagugggaaugcacaagucauaacaucagauaguuauuaaacauuaggcugaaggagcaagcacacacacacacaaagcuucuuuguuuuuugcauaugaucugcaacaaagcaaaaucuauccauaagcauuucuuuggaacugcaaaggagagccagccugaaauguuuuugaagaguaaacacaguacauggaaauuaauuuuuaaagagcccgcuuauacaguguaugaaauaucaauaucaucuuuagcucauaggcaacuuuuugugguuuuauuaacugacuuauggggagaaucauugacaauuguuuaauuaauagaucccugcuguuacuuacaggaugcuacacagaguugccuuagaagcaguagcuacugugaacaauugccugccccuugaguguguuguugcugcucagagcauccuaauauguaugguguucugagucccaugggcucccuaucuuuagauuucagccacucaaggggauggcagcccaacuauuuuaggagcucccuggggcccuucaaagggaauuucaugcaugucacacacacccuguauuucaaguccgacugucccaagcaucaaacuaguugaaaaccuaccuggcaauaauggacaaauacaacuugauuuuacuuagauugauacccugccccucucccuuccaggauguccaaggcccuaauuugcaaaguaagucuaaaugaauuuuccuacagugguaguucugcaauuuaaccucuguaaaugggaugggaaguuuuuguuccccaguugauguauuaaagcaugucacuggaacucagcagugaugugaccaggacaacgggggacaugaugaaauuccugacagagaaucuugugaguuagaaaacagucacuuggguggccagaucauuauucuucuguggccgucugugcucuuccaccucuuggaauuuucugggagacauuaauauauuuacuuccccauugcuugaugcuuccuauuguguucaccauguggcucuuucacaggaggauggacgguaugaaggcccaacuuuggcucacgcuguggaguuguuugguggcagacgguggagugcucgaaaccccagccccggaacaucagcaaagaaugcugagaagcccaauaugcagagaaacaauacccugggcauaagcacuaccaagaaaaagaagaaaauccucaugaggguagaguguuauuuguuuauuaagcauuaaacccaucuuccaggaccgcuguauggugaacaucaccauaaaacacuuaagguuguuuggguugaggacaaagucagguauaaaauagaagauacaagggcuuaccacauaccuccauggugccaugcuagugccaggaacaccagggaaaagacaagguccgcagaaggacauagacauguaaacaaacacagugcgagcuaaaaagagacaucguugagucacccacaaagugcugugggggcagagagaaggaaaauagagagcugaggggcaggcacagagggcuccacagagcaacugacacgcaggucuugaagaacguguaggauuuuaccaagcaaagaacauaggagaaaguauccccagcagaggagacagcauagaggcauaaaagacagcuuguucaaggaagcacaugcuguucuggauggcuagagcaugagcacucugugggcaaggaagggcuagaagagaacagagaucacagaggccccaaauacuguguguagaacacaauguaaaguauauuagcacuguguauuauaaacuauauaauaugaaauaucacuaugaagugauaauauauuugcuucauggcuauuuguuuguuuguguugcuauaaagaaauacuugaggcuggguaauuuauaaagaaagaagguuaauugacucacaguucugcagguguacaggaagcauggugccagcaucugcuucuggugacagccuccggaagcuuacagucauggcagaaggugaagcgggagccagcgcaugacauggcaagagcaggagugagagagaaggggagaggugccacacacuuuuuuuuucucuuagaaacagggucuugcucugucacccaggcuggagugcaguggugugaucauggcucacugcagcuucaaacuccugggcucaagcuguucuccugccucagccugccaaguaucugggaccacagguguacaccaccaugccuggcuaauuuuuuuuauuuuuuauagagacagggucucacuauguugcccaggcuggucucgaacuccaggccuuaaguaauccuauugucucagccucccaaaguguugggauuacaggcaugagccaccacacccagccuacacacuuuuaaauaacuagaucuugugugaagucagagcuagaacucacucaucaccaagggaaugauccucagccauucaugagggauccacccccaugauccaaacaccucccacuaggccccaccucuaacacugggaauuacauuucaacaugagauuugaaggggacaaacauccaaaccauaucaucuaucuagaaaaagugccacucucuuugcuuaugggaggcuuugaugcucaugucaaauuuuaucugcuucacaguuuuuuucuguacacagagguuccggagguucugugccgccucuugucugccucccuccccugaggaguacugcuguauaguaaagaacaacugaaauaauaugacaugagaauacucggucagccuuaauguaggucuuuaccgguuuuaccaggaagaggcaguauugaagguggguaggucagaaaauagagaccuaccugaacuaaagcagugaugggagagaaauacaggcuuggaaccaucgugagcuuuguguucccagggugagaguggagagguaacugacgaugagauggcaacccgaaaggccaagaugcacaaagagugucgaagccggagugguucugauccucaagacauuaaugaacaagaagaaucagguaaagcggcauguuuacaucugagauuuuuguuuuuuaauuuuugugggaaaaaaaguauacauuugguuuuaaauugugauuuaagcauugcaaacauuucuaacaaaacucuuuguccuaaccagacaaugaaaccuaaagguacuucugcaagcauagugugcuuggaauaaaauccccauuaauuaacuugccauuacugacagggaguauuagauauacaugguauaauuugauggauuaaaccagugauucucaaccuuggcugcauauuagagcuuuuaagaaaaucugauuccucuggccacaucuaagaauaacugauucagauauucucuggcugggaccuugggaccuggacaucuuauuuauuuuugaagcuucccagacaguucuaacauguagccaguugagaccccaccagauuagcccauucauaaagauauuuuggugcugcuuguauagaaaccagcugcauagguugauuugcucagacauccagaagccucucugguuuguauuugguucugagggaaaguauaaucugagucauucucucuuuucugucuuucauccucacagaggugaaugccaucgcuaacccuccaaacccccucccuuccagaagagcccacucuuugaccacagcugggucccccaacuuggcugccgggacgucaucucccaucaggccaguguccuccccugugcugucuucuucaaacaagagcccauccagguggggccuuaacaugauaaaacagaaggacccuucacauuauuccaguuguguggaagggcauaucuuuacaguugucuauggaaagacuauuucacauuuugauguauaguugaacugaaaacugaaaaaucccaaaauuuuaaaugauccuaauucucccaauuuuguacuccuaccuucucauauuacuucaaaggucaguagcaguaacaaaaccuaagccaugauucuccaaaucuguacuauccaguacacuagccacuaacuagauguggguauuuaaauucaaauguaaauuaauuaaaauuaaagaaaauuuaaaauucaguuccucagucacaguagugacauuucaagugcuccauagccacaagaagcugaugguuauuaucccaaagaguguagauagagaacauuucuuuuuaucauugcagaaaguucuauuggauagcacugcucuaaacgaagaagagagaauagauuguuuuaauguaaacuauuuggccccuuugcuaaucgaugaaauauauuuaauacuuuucucauauguaaguuaugcaugucuagaggaaugaauucaaguaucacagcaaguuggauauguuuaaguauaaaucuaaagcuggauaaauuacuuuauaaguuccaugcaaauuacauauuugaaacaauaucuucccucucagaagaaggaaugauauuaaaauggcagacuuccaaagggaaccagaaugcugcuccauccuccuguaucccacauuaaaguuuaagagauguggagguuccagacagaaccaagcuaaaacaggaacucuuuacuuuaucucacacacacacacacacacacacacacacacacacacucucucucucucucucucucucucucucucucucucucucuccccaccccucccucucuccccacgccccucucucucuuucucccuuucucucucuuucucuuggaagcuucuuauuaacaauccuggcugggcacgguggcucucacauguaauccuagcacuuuaggaggucagggaaggaggaucacuugagcccccaggaauucgagaccagccugagcaacagaaaccccaucucuacaaaaaguaaaacaauuagcggguguggugguucucaccucuggucccagcuacucaggaggcugaggugugagaguaucacuugagccugggagguuccggcugcagugagccauaaucaugccauugcgcuccagccuaggcaacagagugagagcuugucucaaaaaaaaaaaaaaaaaagaaagaaagaaagaaagaaaaagaaacagaaaauagaaagaaaaaagaauccuacaguaaauuaucuuuuaaauaaaaauucuuucacaaugugagcaaugaacuuauaauuuaugcuuuauacauucacauucuacaaugggugagcaugggucaagguuauaugggaauucuuuguaccacucuugcaacuuuuauguaaauuuagauucauaacaaaacuaaaaguuacaaaaaucagaauccuguuuauuauacuuucagccuguguaguauccuggguaaacagcaaggaaccuggauuaaauggcauuucccguuuauuucaaucauucaugagcaggaaaagaaaggacgaaguaagggaggaaaauauuuuaaaaagagaaauuaacaugccagaugcaagaucagaaggccaaccccaggaggacagggaucagcacccacucaaguguuuuaaaacagaaagaaaacacaagacaggaggaaaaaucagcuugaaugcuauuaagggagaaagcuagacugaauccuaagucugauagugggaagaguggacaaacagaguuuccuagaaucaaagggagauggguuccuacagacaguagcuggaucugcaaccagaaagaagcaagacaggaaauuuacuucuuuagcugcaaaugaugaagucaccuuuuuccucuuccugcaccucuacccuauguuuccugcacuacacuggggaucgacaaccuacaaccuaugacuacaaaaugcuaaaaagcuaucaauuuguagugcucuuucauugcugaaggugaccuucaaaugucagcacaaauuaauuuuccaugagugaacauuguuagcaggguugagagucacuucaacaaacuauauauuuuauauuuauagucuuaaauauauaguuuuuagauuauauauuuaauauacauaaaauagacuucaugauauucucuauacuuucuuauauauuugaaauauuucaaaaaaaacuuuuaaaauccaagacaaaaaaaaacagguccucuagaacuagaaauaccauuugacccagccaucccauuacugggcauauacccaaaggauuauaaaucaugcugcuauaaagacacauguacacguauguuuauugcggcacuauucacaauagcaaagacuuggaaccaacccaaauguccaucaaugauagacuggauuaagaaaaugugacacauagacaccauuggaauacuaugcagccauaaaaaggaugagcuucauguccuuuguggggacauagaugaagcuggaaaccaucauucucagcaaacuaucgcaaggacagaaaaccaaacaccgcguguucucacucauagguaggaauugaacaaugagaacacuuggacacagggcggggaauaucacacaccagggccuguugugggguggagggaggagggagggauagcauuaggagauauaccuaauguaaaggacgaguuaaugggugcagcauaccaacauggcacauguauacauauguaacaaaccuguacauugugcacauguacccuagaacuuaaaguauaauuuaaaaaauagauccuguucauuaauuugacuacaaaccauaaucaaaacaucucucauaccauugugucaggaaaucaguauagaaaauaaaaaauguugugaaacaguaagucuguucugaguugacugauauuucuacauugaauagaugcagccuuggaaggugcaaauauaauccuagucaaagcuggcuuuuuuccauucuuuuuuaaauuuucuaaaauuagagacagugccucacuauguuggccaggcugguuucgaacaccuggggucaagcaaucuucccaccucagccuuccaaagugcugagauuauaagcaugagccaccgcacccagcccuuuccauucuuaacauuuuuccgguucacauuuuucauuaauauuuaaaagcucuucucuguuuucaucuaaggacugguuaagaaaggaaucagacaauacacucaaagguuucuucuuaaauguaauucuauaacuuagaauauagaaaagaacgugcauuauuucccauagauuaagagugaguaauuuggggcucuuuuuaauagacaucuucagaaacacugaguuauuuugcccauugaucugcaauuucaaagaacugauuugauuaauagaggaauauuaaccucagcccugggcccuuauuaaauagacuagaaacauguuuucuuuuucacauagaacauguuuuauuuccucugauacaauauagguuaagagaugugaaaagagaguacuggaaaauagcuucaaucuuaaauaacuugcacucauccuuuugcucauauugcuaauuggagcaagucuggugggacagaaucacaacaguggccugcccuugugcccaugaaggccuugucuuuguugcagugcuuggagcaguaguagcuggcacgggcggaucaaaggcggcaugaagggauuucagagcuucaugguuucagauagcaacaugaguuuuguugaauuuguugagcuguucaaaucauucagguacagucuuauguuuccuucuuauucuuucucaggcccccccauuucuauaaagauacucaaugagagguguuuuccauuccucauucagugucaggagccgcaaggaccugaaggaucuguuugaugucuaugcagugcccugcaaccgaucuggcuccgagucagccccacucuacaccaaccugacaauugaugaaaacaccagcgaucuucagccugaccuagguuuguugaacauuuuaggauuucccuuugggaucaaucugucuaaaacuuaaggucagagguccagucacacaaacucugagccugucccacauagugugcuauuacugcuguguagggaaagacuuaagagaauuuuuuuuuuuuuuuugagaugcagucucacucuguagcccaggcuggagugcaguggugcaaucucagcucacugcuaccuccaccucccggguucaauugauucuccugccucagccuccugaguagcugggacuacuggcaugugccaccaugccuggcuaauuuuuuguauuuuuaauagagacaaggguuucaccauguuagccagaauggucucgaucuccugaccucgugaucugccaccucagccucccaaagugcugaguuuacaggcaugagccaccucaccuggccaacacuuagagaauuauuuuaaggugucaucugguguugagggagcaggugcuacuggcauuuugagcaaagaaauucaucauugugugguucugcccauguauuuauuuaaccaauaaagccuuccagucauucugacaaccaaaaacccuuucccgacuauauuaguccauuuucaugcugcugaugaagacauacccaagacuggguaauuuauaaggaaaaagagguuuaaggggcucacaguuccaccuggcuggggaggccuuacaaucauggaagaagaugaaaggcgugucucacauggcagcagacaagagaacuugugcaggaaaaacuccccuuuauaaaaccaucagaucucaugagacuuauucacuaucaugagaacauuuucacaugggaaagaccugcccccaugauucaacuaccucccaccaggucccuuccacaacauggaauugugggagcuacaauucaagaugaaauuuggguggggacacagccaaaccauaucacugaccauuuccaaaugucugcuagguauguggugugugucacaguggagaacccccagucucuucccuaccuacagacaguuguguguucaaucacagggcaguagucuccugcccuuugacaaggagagucuuuagcgccuuccacaggguacuucugucugaaugauuguccaggauauauuuccuacuguauaaacaagaaugucucauucuucuaucucacucaccaccaccaccauuacuaucaccacccaugcauuuucuaaccacuuaugcauuuccagccuaucauuuuccuccucuguucuuccuggaaacuauaaacacaaauagcaaaacaaaaaacuuuccucuuuuaugcaguugcuucauaauuauuuauaaguuuauguuguccuugagcuaagacuauuaaguauuguucaacuuuagucauaaaaucuccauaaccauggauuagucaaguaguuacauuuuucaaaaauuauuggacuuuauuuuuuguucuauuauauuuuauuauuuuauuauuuaucaugauuuucauguauuuuuuauuuuuguuuuauuuuaaaauauuauuauuuuaaaauaauguaauuuuuuguagagacagggucuugcucuguugaccaggcugcucucaaacuccuagccucaagcaauccuccugccucagcuucccaaagugcagggaucuuaggcaugagccuccaugcccagcuuagacuuuauuuuuagagcaauuuuagguuuauggaaaaaugaguggaaaguacagaguuccaauauacucucuucuacucucccacacagacuuucuucuguuaguaauaucuggcauuaguguaguacauuuguuacaauugaguuaauauugauauauuaugaugaacugaaguccauaguuaacguuaggauucacuguuuguguugugcauucuauggguuuugacaaauguguaaugacauguauccaccuuuacaguaucauacaggacaguuucacugcccugaaaguuccuuaugcuucauuuuuccaucccccccgcgaccucccuccaaaucccuggcagccacugcucuuuuuauuaucuccauaguuuugccuuuuccagaaugucauauaguuggaaucacacaguacauagcauuuucagacuggcgucuuucacuuagcaauaugcauuuaaguuuccuuccuccguggcuuuuugcagcuugguagcccauuucuuuuuacccuggguaacauuccauuuugcggagguacuacaguuuguuuauccauucaccuacugaaguauaucuugguugcuuccaaguuuuagcaauuaugaauaaagcugcuauaaacauuuguauucagguuuuugugugggcauaaguuuuuccaucauuuggguaaauaccuaagagugcaauugcuggaucauaugguaagccuauguuuagcuccauaagaaacugccagacugucuuccaaaguggcuaaaauuaaaauggccauaccaaaguuggugcgaaugugaagcaauuggaacauugcaggugggaauguaaacugguacaaccacuuuggaagacaguguggcaguuucuuacuaagcuaaacauauuccuuccaugugaccagcaauuacaguacuugguauuuacccaaaugaguugaaaaauuuauauucacauaaaaaucuguaaacaaaugcuuauauuaaacaguaaaacuguaauuuuaaggguauaucuucaaucucuacaaacaaaaaugugcaaguaguuacucccuaaaaccaaagccugaauuucaccuaaguccccagcugaaccuacauuuaguugccauguaauaccacaugggauaucaagaucaucaaccuagcucugucuucuuuuccuuuuuuuuuuuuuuuuugagacagacucucacucuguugcccaggcuagagugcaguggcguaaucuuggcucacugcaaccgccgccuccuggguucaagcaacucuuaugccucagccucccgaguggcugggacuacaggugcacaccaccaugccuggcuaauuuuuguauuucuaguagagacggggauucaccauguuggccaggcuggucuugagcuccagaccucaggugguccaccugccucagccucccaaagugcuaggauuacagucaugagccaccaugcucagccuuuauuuauucauugauuuguuuuuuauuccuaucacuaugugaagccagaaauaaacacuucuuugauggcuuguuuagguacauuaguaaagagcuucuccauuuuaauaacuccacaccauuaucuccaaaaugaacuuugcaaaagaugcuggcuaucuuguccauguacuguggugauucuguuucagaucuguugaccagaaaugucucggauuugggguuguucauuaagaguaaacagcagcuaucggacaaccagaggcagauaucugaugccauugcugcugcaagcauugugacaaauggcacugggauugagagcacaucucugggcauuuuuggggugggcauacuucagcucaacgauuuccucgugaauugccaaggagaacacugcacuuaugaugaaauccucagcaucauccagguuugugccuguuuugugugugcaugugugugugaugccucuggcuauucuaauaauuugcugcuaaauguuuauucuuucuauacuucuuuccaaagccuuuaaaucugggacagauauacaguuuuguuuuuuuuuuuguuuuuuuggguguuuuugagacagagucuuacucuguggccaggcuggagugcaguggugugaucucggcucacuacaaccuccgccucccagguucaaacgauucuccugccucagccuccugaguagcugggacuacaggugugcgccaccacgcccagcuaauuuuuguguuuuuaguagagaugggguuucaccauguuggccaggauggucucaaucucuugaccucgugaucugcccaccucggccucccaaagugcugggauuacaggcgugagccacugcgcccgaccuuguuuuguuuuguuuuuuuaacaaaauaccaaguauguuuuuuaacaaaauaccaaguaugggcuggguguggugguucaugccuguaaucccagcacucugggaggcugaggccgguggaucaccugagaucaggaguucaagaccagucuggccaacauggugaaacugcaucuccacuaaaaauacaaaaauuagccaggugugguggugcgugccuguaaucccagcuaccugggagaguggagcaggagaaucacuggaacacgggaggcagagacugcagugagcugagaucacaccacugcauuccagccucggcaacagagcaagaccccaucucaaaaaaaaaaaaaaaaagaaaaagaaaaaucagccaggcauggugguccacgcuuauaaucccagcuaccugggaggcugagacacgagaaucgcuugagcccaggagucacagagguugcagugagcuaagaucacaccaccgcacaccagucuggguaacagagcgaaacccugucucaaaaaaacaaacaaaaaacaaguauguaaguguucuucuuuaacauauuauuaguguauuauuacauaauauguuuuucuuuaacauauuauauguucuucuuuaacauuauuaguguaauaauauuaacauauuauuaguguauuauuacauauuaauguaggucccaggcuuucucuaacucaguaacuauuauaaggaguugguacauaauuuuuuguuguuauucuagaacaugcaacagauuuagucuagguuuucaaccucauuagucauuaaaugaacaugcacuaguuccuacuaugcuggcucaguuuuaggaggugggaauauagcagagaauaagauaaaaguucugguccucaaugcagcuuacauucuagaaggugaggcagacaacaaagauacgauguaauuucagguaauaaugggguaggggaaaaacugagucaaguaaaggaauggaaugauacaggaggugggcugaggagaguaagcaaaggccacuuggaagagguggcauuuggacugagcccuaagucaauaaccaguuugauggucucgggaaagagcauuccccacagggagccacaaggucaaagaccaagacagcagcaagcuggggguuuaugaggaaccacaaaaagcugguguacugugagcugcacaagccaggcagagaauggcaggcauggugucagacagaugugcaagggcccaaucauccgggccuuuuagagcuugauaaggagguuggcuuuaguccaugugaaaugggauaccacugaaauuuuugagcaggggaguaacaugauuugauuuuuuuuuuuuuuuuuuuuuuuuuuugagacagagucuugcucugucacccaggcuggagggcaguggcgcgaucuuuguucacugcaaccuccgccucccagguucaagcaauucuccugccucagccucccaaguagcugggauuacaggcacacagcaccaugcccagcuaauuuuuguauuuuuacuagagaugggguuucaccauguuggccaggcuggucucgaacuccugaccucgugauccacccaccucagccucccaaagugcuaggauuacaggcgugagccaccgcgccuggcugauuuauuuuuuaugagauuacucugagccacgcaugguggcacaaaccuguagucccagcuacucaggaagcugaggcagaaggauugccugagcccagaaguuugaggccaggcugggcaauauaguaagacccugucucuaaaacaaaauuuuaagugguuacucuggccccauuguaaacugugugggugaaggaacagaugcagagagacugcuuaggaagcuaucauaguaaccagcaauagcuggugaagguuuacacuacagggugucagcagagaggagcgguguggcuccaugcaacaaaugagucuagguuucaaccucccuuaucaccugacuggguaucaguguauuaguuguccagcaguuggauuugaucaccgaaaaugcuaaaauugugagauuacuaucacacuguugagugcucauuaugauuuuacuaaauacaggcauggcacuaagugcucuaugugaaucaucucaguucaccucucaccaacuuuaugguagcugcuauuauuauccccauuuucaccuggauaaacugauacacuuuguuuucauagaaaucagccuucuuuucucauucucuucuuuuuucuauuaaauaaauaugcuuaguauaauaaacucacauauaauaaauguuuucuuuuggacuaaaaacuacuucuuaccacuacguuacuaaauuaguucaaauauuugguuuagauguuuccugaugaaaacagaacagcuuuaaaaaaugauguggugguuucuuucccccucuuaguuuccuuaaccuaaauaacacuuuuuuuuuuaaucccuugcagaaguucgagccuagcaucaguaugugucaucagggacuaaugucauuugaaggguuugccagguaacuuuuaaaauaucuuuugcccaucuuuuaagaguagaugcauuuuucccaugcagucuuaagaaaauuuguuucaccuagguuucugauggauaaagaaaauuuugccucaaaaaaugaugagucacaggagaacauuaaagaacugcagcuaccccucucauacuauuacaucgaaucuucgcacaauaccuaccucacgggccaucagcucaaaggagaauccucgguagaacucuacagccagguacagggaaugccacuuggaaugugguuuuuauuaaaccuaauuauuuauguaacccccaaagucaaaaaaaccugaccccagacuccuuugaagagcuuauagaguaagcuauuacaugucaaaugugaggaaccaugaugugugggaaaacuggcuauacuacagcagucguuuucuuuacuucuuuuguuuuguuuucccccaucuauacuuaaccuuuauucugggccaaaaugaaaguguuuguuugagacucauagcuuuuagauccuaguuagucugaccuacucccacuaaaauuagauuuucccaugggaaaauuaucuaaucgucucucuaacugcuaaauaauauauuguagugggaaagcauaguagaaaaugcaacuuccuauguacuuauucccaaaauauuguuuguuuugcuuuucaguuuguuaaauaaucaaucuaucccuaugguaaccaaaaaaaaugcagaaaaaaaucuacacagacuuuaggcacugucccuacacauuaaauucaucagaauguucuuugaaacucaguagguucucuagacuagaaaaaguacauccuuuugaccuaaacauccaacuugcaaugaucugcguguccauugccucucugcuggauggucugcagcuuccucaucuauucugccuuuuuucuuaacucuuucaagaagggucaauucgguuggagccaggcagggaauauaagugugucauugugugcacacguggguccagguuugaaaacuacagguguauuguuuacauaaccccagcaccagugagguuucuuuguucuccagauuaguccagauauuccucaaagcauggggcaauuuuuugucccaaagcuugcuuagcgggaauauguauuuuaaacucuauuuucuaaggaaacuuuauuaugaaugaagauguguucuuagagcagugauuuucaaaauagaaguucugucauggggccucagccccccacacugagaugaggaagccagagaguaggaggggugccauacgcugccccauuucagguaauguacuacuccucuacacacuacauacuggcccucccuucgcacacagaaugccaaaguuaaaagaaguuugaaauccauuauucuauaggaaugaaauuaaauauacauauaaauacagauacuuauauauauuucauauacacauuuguagguacacacauauacaugcguguacauauauguguaagugcauauauacauaucuauguauauuuauguacuuguguguauccacauuuaucccagggaaauaaacaaggaccaguguccuggcuuuaauuucuauuucauuccucuguuugacuucaaacaguuuuuaaaccucuuaauaucacaccccaaggagagacucucacagcuuuugaauaaggcacaagaaccccucaaauagacucagagaugugacuaaaccuagugugcagguggaucccucuuacuucauuucuaaccccucuccacucuuccuuagcccuuccuaauuaccucuuaacauuacuccauggggcaaaugggaagugagaauaagcccuguucuucucaucuagaauuuccagcccagguuuuccucuucuagccauauguggauaucuaagguuacacagacuuuggugaagaccuuuaguccuucaaugcugaaaagccaucucaucuguugccaguugcugaacauuauuccuggucuggcaggggcaccacagagauaagcagcuugguguuccagccaccauuuuacauagcaauuuccagcccaaggcacugcaccucuagauacucuagcugcugaaagaagcagauagccuugagauucuaggccacugacuaugcuguaaaauaggaagaauauagcacuuaucccauauaaaaguguuaaaaugagaaucauuccacuaucugagcuuaguugcagaaacucuaguggccacuaagccccaguaauggauugcugucacacagaaauaguuaugugcauucuaaaaucaguggguaggcacauuuacagauguaucaauuucuuggcuugggucacuauuccaguauguaauaauuuuuuaagaugauguacagaucuauggaggaagagguugcuucaagcaaacuuuauagaguugcaacccaagcacauguauugagcucugcuucccacuucagauccaggauaacaaauagguaucagcucaucugauucuuugguaguguuuucuggagcacuuuaauaaagagguuaugagcuaacauauuaaagcuuaaaggacaagugugccuagcuugauuacugaugucugcuguggguaugggagaaaggaaccauuuauggauuauuugccaucccugcucuaguugcuauucuggaauuagauagccaggcaaauccuugauaacucugcuuccacucuucuuacauguuaugcauucacagcaaagauguuuaaucguggcuuaauuugggucuuaauggaagugauuuuauccugauuggcuugcuguaaauguuuagccaguucauuaaggacucaguggccuuauuuucucugggcuguggcaucagcauuuucaccuccauugaugucuacccagauagagagcacuugccuggcucucuaauuugaagacgugcccuuucaaggggccaaaguugcuaggaaaauggccauaugguuuugcuaucaaauuuuacuuuccuuuaauauccagcucugguaaacacucuuucuaccuuaaucuguucccuuccuuccccacucuggauuaauuguggccuuuggcaaaaaugccauguuuguuuuagaccauuugcccuucugcuuuaguccugaguguaaacacugccugauauguagaacuacaugcuggguuuaguucgaggcuuuaucuccaggugcucaccugggguggauucgcucauugaucacacagguccuuuugcaaggcugucgaaguguagaauuggacugcugggacggagacgaugggaugcccaucauuuaucauggacauacgcugacaaccaagauccccuucaagguaauccuucauaacuuucuuuaaaucaaaucacaaagagacauuaucuucauuugucuuuuuuuuuuuuuuuuuuuuuuuuugagacggguucucgcucuguuauccaggcuggaguagagugguaccaucuuggcucacugcaaccucugccuccgagguucaagagauucuccuacaucagccucccaaguagcuaggauuacaagcccauaccaucaagcccagccaauuuuuguauuuccaguagagaugggguuucaccacguuggccaggcuggucucaaacuccugaccucaagugcuccgcccgccccucagccucccaaaguaccgggauuacagacgugagccaccgugccuggccuucauucuuuauuuaaaucagugacuugaccaaauuacaccuuagaucaagggucuuuaugcugggucuaaaugaagacuucccaaaaguguuugcuguaucauguggaaugugcacauguucauuuuucuggaguuaaucuagaacucucauuagauuccccauucaacccaaguuaguaaccauuaccuuacauuaguuagcauguaauaauauuguugcaauuuuuacguaauaugauauauaaaggcaaggucuauuuuccugcuauaggaauuaauggucauuuguccuagugucaugcugacaaaggccaaugucaggaguuaggagaugguuaaauaguuagcauuauaauguaaugagcaucaguuccaccuaagaagauuggucacccaggaagacugaucucacuggauuuguguuucaaauucuggguagcuuauuaguugaguuaugcaauuacuaccuucauucagagggucuuaggcuauauaacauaauuuuucucugaacuguggccagguugugaaggaauauuauuuuuauuuuacauguagaaauaguggcuaaaaugcauuuucuccucaacuugguuuccuauuuagcauuccuaaaacuccuguaugcuauauuggcaugggcaugaguugauaacuguguuuacauauacacauaaauauaugugacauaugucuuauugccucaaauaaauuauaaacucuuuauaagcaagaaaguauuuuaugcuuaauuauguuugcugcuauaacuaggacagugucuuuuaccugcaauauacucuauauauguauacagagagaguauauguauauaaauagauuuguuaaauucaauaugauaguuguuccuuauaguaugugaacaauacucacuauaaaguuuaaugucuuucuacaaaauggccuuauccucaugcuucauuugaaaauacgaaaaccaucuuuggccagagucugcugcauguaacaauugagaugcuuucuguggcuauaacuacccugccuucugaccaccuugacagauaucuggacucuaaugagcuguuuuggcucucauaggaagugguugaagccauugaucgcagugccuucaucaacucugaccugccaaucaucauaucgauugagaaccacuguucauugccucagcaacgaaaaauggcagaaauuuucaaggugagcucucaacaaaaaggcaggaugguauguuggcccuuguuuugcaauugucauuggguuguuuuguuuuguuuuguuuuuugagacagagucucgcucucucacccaggcuggagugcaguggugcagucuuggcucacugcaaccucugccucugagguucaagcgauuguccugccucagccucccgaguagcugggauuaccagcaugcgcccccaugccuggcuaauuuuuguauuuuuaguagagaugagguuucgccaugauggccaggcugcucuggaacuccuggcuucaagugauccacccaucucggccucccaaaguacugggauuauaggcgugagacacugcacccagccgucauuagguuuaaaugaggccuuuguggacuaugcugcaauuagaccuuggcugugaagcauauacaguuagggucccacaaaccugagaaauugggcuguucuuagagccugggcccucucugggauggucccuauuuucagcuggagugauauaaguauugcucucuggucuccuuacccuuuccagaaagccuuaggagauuaggauagaccaacucuccaacacuucugguaccacaagucagggaugccaggaugucaucugucaguuguauguggaaaagcugaaaauaucucagggcaaguaagucaaaucuuauaggagaagaucaucuuuuuuuuuuuuuuuuuuuuuuuuuugcgauggagucucgcucugucacccaggcuggagugcaguggugcaaucucugcucacugcaagcucugccucccagguucacaccauucuccugccucagccuccugaguagcugggacuacaggcgcccaccaccacgucuggcuaauuuuuuguauuuuuaguagagaugggguuucaccauguuagccaggauggucucgaacuccugaccucaugauccacccaccucagccucccagagugcugggauuacauacgugaggcaccgcacccagccaagaagaucuucuuauaccacaguacaaagauccaaguuagcaaagagcuuagacuggccagaacaguugcuguguuaacagucaguccuuccuuauauaaggguaugauaauguaucaggggaaccugcccccaauguuucaacguagguucuuucuauuuucccuaagugucagccagucugagauauaaagagaaagaauacaaagagaggaauuuuacagcugggcugcugggggcgacaucacauauugauagguccaugaugcccaccugagccgcaaacccagcaaguuuuauuaaggauuucaaaagggguuuacaaacagggaguaggucacaugcuucaagggacaaaaggcagagcaaggaucacaugcuucugaggaaacaggaccagggcaaaaucagaaacuccugauaagggucuacguucagcgguguacguauugucuugauaaacauauuaacagaaaacaggguucaagagcagagaaccggucugaccucaaauuuaccagggcugggguuucccaauccuaguaagccugaagguacugcaggagaccagggcaugucucaguccuuaucucaacugcauaggacagacauucccagagcagcuguuuauagaccuccccccaggaaugcaauucuuuuccuagggucuuaauauuauauuccuugcuaggaaaagaauuuagcaauaucucuccuacuugcacgucuguuuauaggcucucugcaacaagaaaaauauggcucuuuuugccugacccugcaggcggucacaccuuaugguugucuucccuuguucccuaaaaucgcuguuauucuguucauuuucaaggugcacugauuucauauuguccaaacacacauguuuuacaaucaauuuguacaauagugguccugaggugacguacauuuucagcuuacaaagauaacaggauuaagagauugaaguaaagacaggcauaagaaauuaaaaaguaugaauuuugggaacgauaaacguccgugaaaucuucacaauuuauguuccucugccacggcuccagcuggucccuccguucgggaucccugacuucccacaacaauaaugcacccagauuuagaagcagauauuccauuauacuucccccuuccuuuaaugguagaggcauuuguggaaaugaggcucucagugggaaagaggggcacugacaaaauguccccaaauauuaaugccaacaaaacuaauuaacuuuucauauuguccuggccuaagcuuugauuuuuuuuuucaauuaaaaaauaacucaaggccaggcccaguggcucacaccuguaauccuagcacuuugggaggcugaggcggguggaucgcuugagcucaggaguucgagaccagccugggcaacaauggaguugauauaagcauugugucugcuuucccuccacccaccuccuugacagacacacauucugcuuuggagauccaugcucaaaaucuuugugagaauugugucugugguucuuuacacuauguggacgcaaauucuaccuaugucuuugucccugcucccuacccccuccaaaguuuuauccuuuugacuugacuucaucugaaacuaaccuuauucuacaaacaacagccucuaacugauucucuguuuucuuauuuaauacaucagaccacagaauauuuuccuaaauaguuagaacugacaccagcugcagaguggccucgaccucuccuccuguccuucuaaacaccucccuuccuuucaguaagaaacugugaagggggcaggagcaggggacagcuucuuuccuaguuccucuuccuaagacuuuuuaaauaauucaaccagucuaaaauaucuacuauguuuaugaaguguacauauauuuaucaauuauagauaaaaggcauugauuguauguuuuccuucauucuuuuuagacuguguuuggagaaaagcuggugacuaaauucuuauuugagacugauuucucagaugauccaaugcuuccuucaccugaccaacucagaaagaaaguucuucuuaaaaacaagaagcuaaaagcccaucagacgccaguggauaucuuaaagcaaaagguacuccccucuguuaaaccaguuaugaaaaggcagugugccuagaacaaagaaaaauaacaucauucuaaccuuucagaugaccugcugguuuacuaguuuuucaagacugacuuuccuuaaaugauaaguuugauuuugggcuuuucauuccauagaccaauaaauucucucaucucacucacccaagauuuaauuuguggaauaguucccacauagaauauaccuccguuauuuaauuuauucugagugggaugaagugugacuguugugucugaaacugagcuuaggggguuguucaucccauaauggcugcuauaguccccuuuagggagaguccccuuaggggagcccuuggcauggggccuguaguagaagcccaaaagccauagcccugugaucccagcguaucacuaguuuaugcugcuugggcccagauccggacaacagagaucugggcccaagcacgacaaacccaccuguguaggagacccucggcucaaaggucugugaaaaaguucagguacagaacacugaguccauuuuccagucugcaccuacuuaucccacaggaugacagcugacaaaacuauuuguccuacuuaggagggcacuguugguccuaaaacaucacuuuggaaacuagccagcuacagacuugcucucaggcuggcucaaagaguacaggcacacagaugcuaaacauacagaaaccaguuucuuuacaaacauccgaaccugcauauucccuugaaguguuuguguccucugaagguaauacauuacccaauuugaagaucacccaugauucugggccaaaaguugcaaaaucagccacuuucaggggcuaagcaggaaacaucagugugaggagccagcuggauacaggacagcuggaaguggugaggacaggaguggagugugcacgccgugucaaagaacagcucuaauucaauuauuuuuaaacacugcaccagccaaacaagucaggucuggaggugcagucagccccaagggccaccaguuggagaccuccaguaggucuaccuuuauccagaucugcacuuccaaaucugcuccaggugaccuugcuuuugcuuggguuucagaggccauggcaccuaugcugaugggccuuguuacaaaguuauuuaaauguuagcauguauacucuaccuugccuuccucaaaugccacaucagugacugaccacccaguguggugcuuuuucuucuagagcccuguucaucugugcuguuuucuuuauccaacaauuccugcccaguccucacugccaagcagauaaagcugcuaaccacacauaccacuguggucuucaagauaaaugauaaaugugaauguccuugccuuuuccauucugugcacagucauuugcaguuacuuauaaggccuucauuccacuaaugaacagaagucuuuuuuauguugagcccaaaucuuccuuccuuuuccuccuucucauuggcccucccucuucccucugcagcuguacagacuaauuuuauauuuagaaagcuaucauguguuuccccaccagcuuuucuucuccaagcuaaaaauucuuguugugccaacuguuccugacaggauaugguugcuaagacucuuuacuuaccauuaagaauaucguagauauucuuaaauuuguggauauucuugaauucgucaaucugaaaaugugauuuccagaacuaaaucaguauucuagguaguauauuacagcacaagaacagugaaaccaucaccuccccuaauuugaacuuuaaaccuuuguuaauacagccucagacugucugcuuuucaaaaauucuuggccagccgcuguggcucacgccuguaaucccagcacuuugggaggccgaggcaggucgauugcuugaaucuaggaguucaagacaagccugggcaacauaucaaauccccaucucuacacaaaauauaaaaauuagcugggcaugguggcaugugccuguauucccagcuacuggagaggcugaggcaggaggaucaccugagccugggaggccaaggcugcaaugagccauguugugccacugcauaccagucugggccauagaguaagacccugacucaaaaaaaaaaaaaauucuuuagcacacacugagcucauguugagcuuguagaaaacaaaaagcauucaguuauuuucauauagacuguucuuaugcccagcguucccauuuuuccagauuaacaaugaauuuuaaccuuuuguauaugggagccucacauuuaucucuauuucugcucuucuugguuuugguauauuauuacguccuacaaaguucuuugugaauuuuguuucugucaucugguacauuuauuagcaguuucucaaacugugucuucaucccaaguugcccuugagucagccagccacauggagaggccugugcccuucuuaaauaagcccccuggcauuugaugauuauugcccccgucuggugcucuccucucuuguagccugcauuucccagagugugcuucgacuucuuuauugauuucuuuauuuauaaaauagaaaacugaaaccuggccacuugugugacuuucucaaggccacccagcucauagcaauagagcuuagucucagacuugggucuuuagagaagcccuuuucaaaggugauacagaagucagaguacauuaauaagaauaaucgcuggagcacuuugaaaaacagauucuaaggucacaaaucugacugacuaagucagaauuuccagaagaaaggccuggucaucuguuuauauaaaaauaauuccuuaagucaccauggugucugcguaaaaaauaauaacaauaauaauucuuauuauccuggaaguuugagaaacacuauuuaucugcuguuuuucccauaaagugaauuaucuuauccaaaacagcuaaggaggucacugugugguaaacuuguucuuaguagauccacucuaacucuugcaaaucaccucuuuauuuucuaaguucucacaaaccaagugauuaauaccccaucaugaaauuuugucagcuaucaccuugacacugcccacaguauaauuuccacaacuuacuuguuccuuauuuuggaaaaaugggacaauauaaucccuauugccaguuuucuaagacugcuugcaaccuuucaugaugacuucccaagggguaccagcaaugauuccacagucacauccguaaggccuuucuguuuucugguagaucaugggucuagaccuagugaugaucugaccucaaauaaaccaggugauccagagcuccagugggcucagaccuacccgcuaacauagaaggccggagucauuucccauacaaagaacucacccucagcaaggauggauugacucagagcaggauuucugaagcccuccaccugccucuggcuuguacugagaugcauccugaggucuccuaacuauaccccaccaggauccuccaggauucugacauuccucuccugaauuugaacccaaaaaacucaguucaccuuaaaugacagacacugcggcuagguacuggggaaacagagaaguguaagacauugcuccugcuuagcccuaugagggccagucuccucaucugacccauaccuccaaccacaaccuauauccgaguuacuuuuauucaggggcugaggucccauuuuucuacccuagaauaaguaggauauugcauagaagggucccagcuguuggccguuuguugggcuaccucucccaugcuucuccuugagcaucuugggggccuuggcacuccacuuucagacacugcuauucgugguucuuugagcaguguccuucucccauacaguucucaugcuucccugccaguggggucuguccagcccuuggcgucaucauucccagcacuuggcauuaccuugagugcucgcugagucaaggcccuucucuuaucagcgauaaacagaccugcuuuuguggcucacuugugccuacaacagauuucccaaaguuuugaagaacacuaauccuaugagagacucugagaagagaaagacaggggaaaaaaauuuccugguuaaguaagcaugggaaaugcugcacuggagaucuuugaagacucgugaugcccuuuagcguauuaaaugaaggcugugugaaacccuguaguaggaauguguucagguuugguuaagcugcugcuuccaggcauucaguguaucuugugguuccuguaauugucaguuuuuccauaacaccuauuaacacccaccgagcuccauaaaacccacuuugagaaaucgcagccuagaccauguccaguuaucuggaauggacugcuuuguaauacauuucaucuggauauggacacagccuaaauuguaucuuccuuauguauacauauucauuauaaagguaauauaaccacauuucaaaaauuuagggaauagagaauuauuuuaaaacauacauaauuccagggucaaacacaacuguauuacacgaguucuuaaccuugguaauauccacaaauagaauuuagggagucuacgaauauaaauggaaaaaaauuacaucuuuauuuucacuaaccucuagcugaaauuuagcauuuccucugaucauaaauguagggaauaaacuacaguaauauaggcaauaccuauugucaucaauagaaauggcaacuuuuucauuauacuucacaguugucgcuaauaucuccaagaauuauuuaugcucaauuuauauuuucaaaaauguuaauuaacuuacuacuauguuuucuacuguguuaauaaacacauauauucuaauagcacaaauuuguuccuauaacaugugaucacuguauucaacaguauuuccuuuguaaccauuucauuuuaugcauuuaaaacaucauucugagaagggauccugucucaccagacaaccagagaagucugugaugcaaaaacaagugaagaaccccugccauauuaacauuuaauaucuaggacuucgugacugucauuuuauauaauugcacuuuaaauauauaaaacaaauacagaauuauauguauauuuauauaguguauauauuuacauguauagcuauuaucuguaugcacacacauacauuauauauaguauauauuagcacacauguaugcacacauacacaugcagaauuauauauguguguauauauaaucuauauaguauauucaaugcauaaauauugaauaaaagaauuuguucacuuccuuuguucaauaaauauauaucaauuauuuuuucauaucucauucucuccagcagacaaccauugcuuacugaccccguuccucuaccccguuuagauuguuuccugcauuuaguucaugcaaguaacguuuccuauauuucagaugauuuucuuaagcuagguagguucccagaccuguacugaugcuuaucacuucacaguaauuccaguaaacacggaguaugugaccucccuggcugcacacaucaaguuuccuaaaguuucuaggccuguuuuguuaaucugauuuaugguucagaaagccguuugaaaacaauuuuauuuaaaccaacaacaauucuuuuggccucuuuguccauagggauucuaauauuguucucaaggucaggagccuguagauauuauuuuaagaaggggaaaaaaugguuucuuaacagagacauacuucugaaaaauugaugggugauucacuucuucagucacuugggauugaugcugguucuccaaaucaccaaagcuuucucuuggagggguuguccugggaaccuggcuagcugggcacugcacacagucuucuggagauuguuuauaaaagcuccaggauucuuccuguaggaaugcuaacguucacccaaguguugacauugcauuucgagggaaucuagauuuuuuucuccucucccaaauguaucaaaauagguuaagccacuuuuaacgauuguguuaaacaucagggguaguuuuaaagguuauaaaugaauucauuaacuuggcaucugcaguuuacaauuauugcuauuuuacaggcucaucaguuagcaucuaugcaagugcaggcuuauaauggugggaaugccaacccccgaccugccaauaaugaggaagaggaagaugaggaggacgaauaugauuaugacuaugaaucccuuucugaugguaagagaaacagaucccuaugcugugcacaggaaaauucuuggaugauuugccacauuuuucuuucuaaaauaagucuagagcgccaaagaccaguaauacggaugguuguaauauuguccaggaguuucugaauucagucacuuagcaaggaccgaggaaggaggggauucuguuagccaacacuuacagaaagaagaggcaggugugggaaguuacagggagucauuccuacgacaaguuucuagaggaagagauggaauugcagcagagaaacccuguuuucacccuuuaguuucuagcguggcugauaaucuuggcaggagucguagacugagguugcguccuuucuccugcaccaccggcagggggcagcaucacggcucugugcucucuguuucacacucuugcucuggcauucuaguagugaaaagaaaggagaggagccucauuuccccucccucccugguuuucauaccacuaagccaacaagaucuuuccuucuggccccaccaaagagaaaaaacauaggcaaugcuaaugacgcaacacaaaaagucacacgaaugauguuaacuacagauuacuagcgaaggauucuucucacaugagaauuagguuuucaguguguuucauuugcauuaaacauuuguuagagauugcagaauguuuacucagguaccuuugcugauaguagacuguuucauuuuggugaugucugaaaggcaacaauauaauaauaagaaaaugccaagguuccuauuucuauaaacauuauauaguagaauauauucuuucuauguagaauaauuguuuugcuaaauaugcagauaugcccagaccagaaaccauuuaccauuaaguugucucaugcauuaagacaacugagcccccuccuccaaauaucugcuccucagcagaaauuugaguugucuccagucauaguucaguuuugugagccuccaucacugguuauacugcaaauauaauaccaaacugucugcccccaaauauaauaccaaacuacaucauuuaguauuuguccuuaguaauaguugauugcuccauaccaccaauuaaaagccaguuugcuacaccugaaaccccaugagcuaauaugagagacauaucucaucagauaguaagaggggaaaaaauuaaaaggagucaagacaauuucucugcaaagucaugggaaugugaauuuuuuauauuaacuuauucuuccccaugguuuucuuccccauuacaguugcaguaaugccccauagaacuaauugauucagauaugaaauaaaaaucacaccuaagaaaucaacuaaucuagaugucauaugccccuauaaguaguuaguccacuagaaaacaaauuugcucuuucauaaauuacuccugugcuuuuucuguacuucugagaauaagaaaggaaaagccuuuuuagaaauuauuauuauacuguagauuucacauaaagaaauaacaaaaaauuauuauagaugguuuugauuugcaaguaacaaaaugaacaggugggagaaggauuuucugauuuauuuucauuugggaaauuuaguccuauaccacugaauuucuaagauaguugcauguauuuuuaacaauccacauaugcagagguggaguaucauuggaaaaggggaccacaccaggcucuguuccaguagacugugauaccuggggcaaugucuucaccaccuuaggccuuagaugccucagauauguaaucaaaaguucugcgaaguguuuggugauguucuuccucuacuuccagcacuaagaucuguaauguaugaccacuuaagcccacuaccacuacaugaguauuucccccuucauugaaagaucgcucugacuggaugauucucaaacaggccuuguaguuaugcugugacuuguugaagcuuguccaguuaaggcuuccguaugugacuauuagaugccuuacuaaccacaugccuuugauuauuguugugaccaucuccacuuucuccagcagggauagagaacagaaaucuaccugcugugggaagcaccguuaccagccucuuagggggccuaaaagguuuccuagcuucucguaauaaugggucuuuuugagaaucagaugaaagcuaucaccucugaaaaauaaaacgugcucucaaaauucugcacaacugcaagaguuucacaaguuuccugagacccucauaggcauccuagauuaggaacccaucucuaaagucagggugcccgguuuaucucugugaucucucauccuugguuuucaugcccauuaaauaaaggaauuaaucuaacaccauuugggcuauaaaaaugagauaaugccuagccacagaauuauugcaagaaaacgcuaaggaaguugcaaaugagaguuauuuaucugagaaauuguaacucugccuuuuggguaauaaauucuuaauauuuuucucccaaccuuguuguuuaccuugugucuaguuuugaacauacacugcagacaaauuugaauuuacaacuuaacgcagacauauucuaugacaaugacagcacaauuccaagaaauuaaucuguuucuguacauuugaaaugaagucauauugggaguauuacagcagucaguaacugaaaauauguaacaugaaugugucagcccuuggcaugauucacauuaauaauguuuacauuucguuuacugcuaguccuugcauuguuccacagucaaaauauuaaaucuauagagcauuuccuguuucauuuauuuauaaucuaagcugcuguuauuugugcuuugcuucaugccuuuguuuaauuuaucugguguuugucuuaauuuucuccuuccuuuaccccuuucugauucuguuuuucuguagcagauguccuuacugccuccccugcuccuaacggucaggaagguaaaugccauuugaacggggcauuuuaacugcauggaugucagcauucuguuuccaauuucuugggcccgguuagcaugacguugugauacuucugugaauacaaauguaaugaaaugauuuaucucauuuacuucuugucagccugcauggcccugauuugguauaagguccuuuuggucuaaucguuugugcucugaugaugcgauacuaaaucuugagugagaaauuagcuuucuuguuuuucauuuuaaaaggucaucaucacgauacacuucuaauaccuuuagagucauuccaaauagaaaagcaaaaaaagagcaaaauauaagauuauaucuuaugauauaauauucagauauauuuuauuuucuguuaugauuaucacuuaguaaauuaauaacaaucaugaaaacuuuacuuuuuaauuauaauugugaagacuuugcauugcacccaauaauaagucuuucccccuagguuuuggcauuucucaagguaaaagaaguaaauagcuucauuucaaagugagagugagucaaucauguauguaccuucuagaagugcuucagccacuaaauccuucccaaacgugugugcugucagcuucuugacacgggguaucuuccauaauauuugcacaguuccaaucaucuguaugaaaauuggcaucuucauuuagauuaugucuauaugccagauuauuuugaaucauuuaaauuauguauauaagugacaaaaacuacugguaaauaaaucaauuaaauugaaaauaacugcaucaacccaauuuuuacaguuaugcuucaagccaucauuuuguuaacauacuauauaguuagagccucauucuuauagauaaguacaaguaucuggauguccucacagugaugcacauguagcucuuaagugaagcauuggguucguuuucacugaagucugcuaacuuauuuucagacaacauucuggaagacagaccugaaaauaaaucauguaaugacaagcuucaguuugaauauaaugaagaaaucccaaagaggauaaagaaagcagauaacucugcuugcaacaaaggaaaggugggugaacgguuucuguuaaaugacacuuugaccaugugguacucuugucaguuucagaugagauuccacuugcucccugucccucccuuucaccuuuccccucacuuucccuuagauaccugccaaaguucacuuggugauauuaaaagacacccaccuuccauuuguggaaaguuagucacugauucauccagccaauaccuacuaaugguguauguguggcagguacugaaguggcacagaggugguuuagugaugaaggcagacaugucaacuguguugaauguaagugcauagaacagugauuauacuguguuaucagagaaucaaggacaggcucucagggaagaugagguuucagaaggaagauuuggcuaaacagacaaaaacagaacauucgggccaagagggcagccugguauguccagggaauugcaagaaguuuuaaaggcauuugggaugaccaagaagauaaacgggccagauagcagaggaaugacacugagaauaggaagauaaaugagauacccagacccuauccucaagugccucacaguuuauagacucugagcaaaucuuuagacgcaguugcagugacauuguuggacaauggaauuguaagauaugucaaaaauuugagccacggaagauacauagucaauccucuauuuauuuaacaaagauuuauugaccauuccacauguaagacaguggaccaugcacugagggaagauggaggaugaauuagacucaccuccugcccucagaaagcuuuuacucuaggaaagcuguugggacauguauauggauaauuaccaugcaaggggaaauacaguaauaacaccagaggaggacagauaaaagagcuuugggaauccagaggugaguagcauauaccuuccauguaaaaugguaucauuuuucccuuaccagguuuaugauauggaacugggagaagaauuuuaucuugaucagaauaaaaaggaaagcagacagauugcaccagagcuuucugaccuuguaaucuauugucaagcaguaaaauuuccagguaagauuaggcaauaucaucuauaacuuuuaaagauaucaaagguuaaaaauaugccauuuauuuaauugggcauugugaacacucucaaaauaacuaaauuguguugcugaaaucauuguuauaauaccuccuaaauaucuuuauuauuauaauuugccuugaugcucaugaagaaaaauaccauaaaguauucauuuuucaggucacacaaugucuuuuuauaauaguuaauaauuauaaaaguuauaauacucauaauuucuaauugcuaaauguauuaaauacuuaaguacuaggauuugugcuauuuuacguacaucuccuuuaccguucauaaugauucuacaagguaggcgguauuaucuccauuuuaaaauaaagucugagagggaugaaguaauuugccccaaguuucagaguauaucagucaagauucuuuuguuugaaaguggcagaaauugaccuaaguaaagggaacuuuauugacucaugugcuuaaaaaugaagacacacagguuucagguauagcuuaaccaagguacaugcuuucucuuuccucauuucucauuccgccuccaucauguuggcuuucuccccuuuauucccuucugguugcgagacggcuacagcaggccagcacuacaugcuuccaguuucagcuucaguguaagagucucuuccagaacuucccgcagaagugucauuguuucucauuggguccuuuaccaaucacuguggccaggagaugcagugcucugauggucuggaucccaugucacauucuccacucugagcuggguagcaaggccccacccaaaccacaaggaccaaggauggcguugaaguggaaggagagauuucccccaauugaccguuuuuagaaguacaguggacaggcugaugaaccacuuuccaaaaacaguguccuuuucaauuaaugaaugguagaccuauggcucugaagccugucugucuccaaaguccugcccuuacccguuauacugccuggccucucuuguuucgggcuguuuucaaugagguacucaauuaugugucccacaaauggggcaccaggggguagaagacaaacaagaaagucccuaaguacauggaacucagaaaaauucaucuccucauacuaagaaaaaggauucucuugaauauaauuucugagaacaggaaaguggcugagauaggaggaucagucuaaauguuaguaaacaggauuuauagacuuggccuggagagaggcacuaaaaugcccucaucuuuucaagaugggcugaacucaggucccucccagagcauaucuuaagcaccuggucucacacagugccugacaaaugggccagaggcauugggcuauuuaaaaauuaggcaaacuggguguaguggugcgugccuguaaucccagcuaccagggaggcugagcaggagaaaugcuugagucuaggaguucaagcccagccugggcaagauauauagcaagaccucaucucuaaaaaauaauaauuaaauuuuuaaaaucacaguuagguaauagugagcuuuucacacaucagaguaaaaaaaaucauauuauuuaaugauaugauaaaaaucauauauuucaugauauuaaaaucauuuuaauuguaaguuuucuccuauaagcuguuuuuaaacuuuuggcagcugcuacugcuugucugcuagcaaauccuguugaggaggauaugaaucaauaaguagccagcaaagauuucagagaaaugcaggaaccuggccauuuaaguuuaauuucacagaccaugaccucauggcauauaaguacaauaugaccauuauuugcaacuggcaaaacucuuuuucugauggaguaaaacccuuuaccugucaaagagccuggaggcuggcauguccuucauugcaggaacaaggaugagcgccacucuguccaagaaucacacccacugcagcucuuauucuuuauaaaugcagcggaugccacacucggaccauuccacuggcuuugucuuuucuucucaagcacucaguaaauaaggagcacaaauucccaaagauauuugaagucugugugaaagauaaagucucuguaccaguagagaaucguggaagaucaggaggucaugugauagagcuucuaagcaugugguuguucggcuuauuuuaaaaauuccaaguauguuguuuuuuaaaaguguucacauagcauacauuucuucauagguauaguguauuuucucuuuagaaaaaugaaauuucuuacauuuuuucccugauuuuauuuccugucucaaaauagcuaaauuggauugccagaaugauuguuauaauaccuucuaaauauuucuuuuuacaaucauuuguuugaugcacaugaggaaaauacuauaaacuguucauuuugcuaugccguuuauuuuaauuuugcuacauuaucaauuucaguguaugucaccuuucaucaucccaagucccuucuuacaagccauaugcaaaaaaaaaaaaaaaacccuucauugcaaugaggcacucaacaaucaugugguaugaggcccacagaaaggaaggaacuuccccaccaucagaagcuaggucaguggcagggcaagagccagaauuccugucagcucccaggggugggcucuuugcaccacacuauggaaguaguugaauuuuuucgaccugcuuucucuuaggguuuauuucucgguugcauuuaguacuucuauuguccuggguuuuuuucuccuucuaauagaaaaaaaaaaggauaugguauuuuuauuuuaugaccccaucaaccuaguuuccaauaucuucccacaagcuccccugcaucccccacucuccucaggcaccuacauacacugccgucuuucuagugccaggccauugcucagaguguucucaaccuugccuggccuuccuucuccccuuggccccauuccaaauuccaaggacgggguccuuggaaaguaucugagacucuucaacucauugugacaucuccuuucuggagcuccuucauuuauaggcauauguuuggguaccuccuagauacccaguuguuccacaguuaggagugcaaccuuguucuuuuauuuugaauuuuuuuauuuugacagcuuuagugguacaaguaguuuuugguuacauggaugaauuguauagugaugaagucugggauuuuagcgcaccugucacccaagucguguaagucauacccaccagguaguuuuucaucccucaccucccucccacucucauucugagucuccaauguccauuacgcugcucuguaugccuugacauacccauagcuuaaaagauuacaacccuguaagacaaaaauuauucaguggugacaagaucaucagauaagaucgugggucagagaccugggcucuuggcuaccaugcuuugugauuuggccaaggcaaaucucucugagccuuucucacucaaaaguggaguugacuagaauccuuguuuacuacacuugcugaaaucuccagaaucacccaggccacuugauuaacauacccagucucaggccucucuaccagggauuuacauuuggaaggcacugggagguccuggucccuggguuucuaaggcaggcaauucaggagcagguagagccagaugaucuggaagucugauucugagggggauuuugccucauucuccuuuggauccaccacacaguccacagagcaggugcccagggauuccauggugaggcucguccggaagauucugugacuuccagggcucauuuuuauuccuacacugaaggagccacauggggagagccuugcaagugucaguccauucccuggacacacacugucauuuucucagcacugagagacaagcuuuguucaucaaacagugguuugcuaacaagccauuugaaugacaaaaguagaacccugcugccuuggacagcuuugggcuagcuggguguaggucccuggcacugagaguugccucccccacagagagccuuggccaucccccauggcuguucuggguuacucagacccacaguagugcugcagguuggaacaccuuggagggcaaagggaugcauuucaagaaaugagagggcuuggaacagaacucucgggagaaugucaaccaacacaccacugagagguagcccuguucacugaaacuuaauuacccucggugccucccaauaucuugcaaaaccagugaacacagcuuuucggaccuauagugacuggguaagaugaggcccugcagagcauggcaggcaaggcacucaggaaggaaaaguagccgugugacccugaguggcucucggaccauccccagacucagcuucucuccugauuuuagcagugccaauauguugaauccucugaugucucugggagagcauccagaagaaagccuagcacugauuauauuuacaguaaugcaucacuuaaucagggagagacauucugagaaugcuucauuagauuauuuugucauugugugaaacaucauagagugaacuuagacaaagcuacaguguagccugcuacacaccuaggcuagaugguguagccuguugcuccuaagcuaccagccuguacggcauguuacugcacugaauacgguagguaaguguaacacaaugauaaguauuugugcguuuaaacauaccuaaacagacaagguacaguaaaauuaugacauaaaagauuuaaaaugguacaucuguauagggcacuuaucaugaaugaagcuugcaagacuggaaguugcucuagguggaucagugagugagugaugagugaaugugaagaccugggacauuacuguacaugacuaucgacuuuauaaacacuguacacuaaggcuacacuacauuuauaaauaaaaauuuuucuucaaaaauaaauuaaccuuagcuuacuguaacuuuauauuuuauaaauuuuuauuuuuuuaacuuuuugacucuuuuguaauaacacuuagcuuaaaacacaaacacauuguacaacuguauaaaaauguuuucuuucuuaucuuauuuuuauuuuuuaauuaaagaccuggccuugcucugucauccaggcuggagugcagugguggaaucauggcucaccguaaccuugaacucccaggcucaagugauccucccacccuagucuucugaguggcuaggacuacaggcaugugccaccaauaccuggcuaauuuuucuuuuuuuuuuuagagacaagggucucacuauguugcccaagcugaucuccuggacugaucugccuuggccucccaaaaugcuggaaauacaggcaugagccaucgcacccggccauuuucuuucuuauuuuucuccuuuuuuuuuuuucccauucugugacuccagccaaagacauuuucuuucuuuauucuguaagauuuucucuauuuuuaauuuuuuuuacuucauuuuauuuuuuauuuuuuuacuuuuuaaacuuuuuuauuaaaaacagauacaagcacccacauuagccucgaucuacacagagucaagaucaccaauaucauugucuuccacuuccaccucuuguccuacugaaggucuucagggacaauaacaagcauggagcuaucaucucccaugauaacaacgcuuucuucuggaauacuuccugaaggaccugccugaggcuguuuuacaguuaacauauauauauauauguaacuuaaaaaaaaguauauauauauauacacacacacauauauacacauguaauguagaaugaguauacucuaaaauaaugauaaaaaguauaguaaauauauaaaccaguaacauauuuauuauuauuaccaaguauguucuguacauaauuguaugugcuagacuucuauaugacuggcagugcagcagauuuguuuacaccaaucuaaucacaagcacuugaguaauguguuaugcuauggauguuaggacagcagaaggugauaggaauuucucagcuccaguacaaucuuaaaugggaccaccaucauauacguggucuguugaccuaaauguugcuauauggcuaaugacuguacaucgcuugucuaguuagggaguugauuucaaagcuuccagacagauuaggauuucugaaggaagauaccaucauaugcacuggagucaauuuauucuuuuuuuuuaaguaauucuuuuucuuuuuagagacagagucuugcuaaguugcccaggcuggccucaaacuccugggcucaagcgauucuccugccucagccucccaagucgcugggacuacuggugugcaccacugcaucugguucuggaguugguguauuccuaaauaccuagauggcuucugcucaaacuuccaucucgaagcuuuagucaugucagauguuccaacaucuauaucuaaaauaagcauucuuauucacaaucacaaguaaaaacacagaugagaggaagacccuaaaauuaacuagagacucagcugaggaagagaggcagccaccaggcuaaccauguggauuuaaaucccagcucugucucuccaugaccuugacuugaacaguuauguauuauagcugcucugcaccugggauucccuaucuguaaaagggguguaacaguccuaacuuaaaggauugcuguaaaaaguagcaauaaaguaucuagugugauuagcacaucgucgggagcaugguggguggaucacuugaggucaggaguucaagaucagccuggacaacauggugaaaugccgucucuacuaaaaauacaaaaauuaguggugcacaccuguaaucccagcuuucuggaaauguuguuaucgguaagugagccaacgggguagaugaagguucuuuguugcuucuucauuauuuuucugggccccuucucacaauucaaaauccuuccccuucuuugaucacucagcccuuguuuacauucuuccccuccccaucccaaaagaauaaccaggcucuucacugaaguacccacauucugguagaagauauugacauguggcaggauacaggcaaaaguccagaaugaacagagccccuccccacuggucccucaucaguuuuacuugggagaaaauccauuauuaaguaauugugucaagagcaaaauguacacaaauauuaagaucaagguaugagaacucaauagucuaaguuugugcauguuugcuauuaugaauacuuuggagguaaaagaaaaccuuagaagccccacauuaagcuauaauaauaacagcuacuauggacugagcacuucccugaacaagacacacuacuaaguauggacaaguugagcaucccuaauccaaaaugcuccaaaauccaaaacuguuugaacgcugacaugauacucaaaggaaaugcucaugggagcauuucggauuuuggauucucagacuggggauccucaaccaggugaguaugauacaaauauuccaaaauccgaagaaaucugaaaucugaaacacuuucaugucccaagcauuucagauaagggauauucagccuguauauguauauuaucuuguuuauuccuaaccacagcccacuuacagaugaggagggaguguucuagagagguuaaguaacuugugugagauugcccugcuaggaacagauuuuaaauccagcugucucacuccaaagucuaugcucuuaaacacuacucuauccugucuccucugaugauguucuuggaauguguauuaucaucugaaauacgaccuccugaaugcugcuucagcuuagggaauuacucuccaaagguacaguuaugacagugggaacaauuuggaggcaauucuggccucacuggugccuucagcucacucuuuuuacauuggagccaggucuaugugguuugcauucauuuccucuuucagcaaauauguauucaguuccugcucugcaccaggcacugugccaggcaugaagcauccagggaguuguuagaccaggagugagaaagagaagccauaaacaucauuaucaccauauuucccaucuucagaguaaccauaugagugaguuccuaucauuacacacauuuuguagauaaggaaacugaggaccaaagaaggagguguuaugucaaggcuaauaucagcaggaauugaaccuagacacuaugacacuaaaacccaaguaauagccauuccuucaucucuccaaauuaaauaauuagccacugaucauuucuggccacagcaccuucuuuucaugcaguuuuucaaaaucuuucugaugcacaaucagcuaagugugugugugauuuuguggucauucugugauaagcaugcaguucuuguugcauuugccuauagagauuuuuaaaacuuugcuuuaauugccuacaaugcuauuauuaacagaacaaaaacugccaguaggguuucuguacuagguuccaagggaguaguaggacuucaaaauaaauauuaauggggauggaaaauguugaguugccuugcuuguaguuuuuggcuuauuuauuuucauuuuaugggaacaggacugucaacucuaaaugcaucuggcucuagcagaggaaaagaaaggaaaagcaggaaguccauuuuuggcaacaauccgggcagaaugagcccaggggagacagcaucauuuaacaaaacaucuggaaaaaguaaagucacuuucuuacaauaucuuugcuugauucugcaugcuggaugauuuagauauuuuacugucuaagcacuucccuugaauuuuuuaauucuuuuuccugaacauuaauauugucugaguauaguauaaauuuuuguaauugcuaacuuacacuuuuaacguacuaaaaacagcauuucaggcugggcacaguggcucaugccuguaaucccagcacuuuuggaggccaaggcagguggaucacuugaggucaggaguucgagaccagucuggcuaacaugaugaaacgccaucucuauuaaaaauacaaaaaguagccgggugugguagugcacaccuguaaucccagcuacuagggaggcugaggcaagagaaucgcuuaagcccggaaggcagagguuguggugagcugagaucgcaccacuguaccccagccugggugacagagcaagauucugucucaaaaaaauauuaaaaaauuaaaaaauaaaaauaacauuucacugaagauguuugaacaguguuugccucacgaguaaaaauuagaggcaccuuggaacauucuuggaacauucuagugguuucuuggagcuguucucuucaccauuauaacuccagaagauauggcuauuuuauuucuaguuacuuuuuauuaugaaaguaauaaauucuuguaguuaaaaacucaaacaauacagaguauuauuaaaauuccuuuccacucaauguccuggugcuauucuccagaaguaaccacuauuaaauuuauuguguuuuguucaagaaaaauaagauccuuuuuaagauaauccaaaugggauacaggcauacuucggagauauugcagguucgguuccagaccacuacaauaaagugaauaucacgauaaaaugagucacauuaauuuuuucguuucccaguacauauaaaaguuaugucuacacuauaccauagucuauuaagugugcaauagcauuaugucaaaaaaauguacauaccuucaauagaaaauacuuuauugauacaaaaugcuaacaaucaucugagccuguagcaaguuguaauauuuuugcugguggaggguguugccucaacguugauggcugcugauucaucaggggggugguugcugaaggcuagggugucuggcaguuucuuacaagaaggcaacagugaagucugccacaucaaccaacucuuccuuguacaaaagauuucucuguaucaugcaaugcuguuugauagcauuuuacucaugauagaacuuuuuuuuuuuuuuuuuuuuuuuugagacggagucuugcucugucacccaggcuggagugcgguggcaagaucuugucucacugcaagcuccaccucccggguucacgccauucuccugccucagccuccugaguagcugggacuacaggagcccaccaccacgcccggcuacuuuuuuuguauuuuuaguagagaugggguuuuaccauguuagccaggguggucucgaucuccucaccucaugaucugccuaccucagccuuccaaagugcugggauuacaggugugagccaccgcgcccggccaugguagaacuuucaaaauuggggucagaccucucaaaccccacugcugcuuuaucaacuaaauguaugaaauauucuaaauccuuuguugucauuucaacaauguucacaggaucuucgccaagaguagauuccaucucaagaaaccacuuucuuugcucauccauuaagaagcaacuccucauccauucaaguuuuaucacgaaauugcaggaauucagucacaucugcaggcuauacuucuaguucucuugcuguuuccaccauaucugcaguuacucccuccacugagguuuuaaaccccuccaagucauccaugaaguuuggaauuaacuucucccaaacuucuguuaauguugcucuuuugaccuccucccaugaaucaugaaugcucuuaagggcgucuagaauggugaauucuuucuaggagguuuucauuuuauuuucaccagauccaucagaggaaucacaaccuauggaagcuuuagccuuaugaaauuuauuucuuaaauaagacuuaaaaguucaaauuacuccuuguucaugggcugcagacuggauacuguguuagcagacaugaaaaaucaugcuguaaacagaugugcugucaucuagguuuuguuguuccaucuauagaauacaggcagaguagauuuagcaugauucuuaagggcccuaaggauuuucagaaugguccaugagcauuggcuucaacuucaagucgccagcugcauuagccccuaacaagagagacagccuuuucuuugaagccaggcauugacuuaucuucucuagcuaugaaaguccuagguggcaucuucuuccaauagaaggcuguuucauuuacaauaaaaaguuguuguuuggccgggugugguggcucaugccuguaaucccagcacuuugggaggcugaggcagguggaucacaaggucaggagaucgagaccauccuggcuaacacggugaaaccccaucucuacuaaaaauacaaaaaaaaaauuaguugggcaugguggcgggugccuguagucccagcuacucaggaggcugaggcaggagaauggcgugaacccgggaggcggagcuugcagugagccaagaucgcaccacugcacuccaacuugggcgacagagcaagacuccaucucaaaaaaaaaaaaaaaaaaaauucuguuguuuaauguagccaccuucaucaaugaucuuagcuagaacuuacgaauaacuuacuguagcuucuccaucaguacuugcugauauuauguuauggagaugacuucuuuccuuaaaccucaugaaccaaccucugcuagccuccaacuuuucuucugcagcuuccucacuucucucaaccuucauaaaacagaagagaguucagggccuuacucucaauuaggcuuuggcuuaaaauauguuguggcugguuuaaucuucuauccagaccacuaacacuuuccccauaucaguaauaaggcuguuuggcuuccuuaucauuuguguguucacuggaguagcacuuuuaauuuccuucaagaacuuuuccuuugcauucauaacuuagcuaaauguuuaucgcaaaaugccuaacuuucaaccugucuuggccuuugacaugccuuccucacuaagcuuaauuauuucuagcuuuuuauuucuuucuuucuuuuuuuuuuugaggcagagucucacccuguugcccaggcuggagugcaguggcgcgaucucagcucacugcaaccuccaccucccggguucaagcgauucuccugccucagccuccugaguagcugcgaugacaggcgcgugugccuggcuaauuuuuguauuuuuaguagagacaggguuucaccauguuagccaggcuggucucgaacucuugaccucuggugauccacccgccucagccucccaaagugcugggauugcaggcaugagccaccgugaccagccuagcuuuugauuucaagugagaaacgugugacucucccuuucacuugaacauuuagaggccaauguaggguuauuaauuggccucaugucaguaucguugugucucagggaaucgugaggcacaaggagagggagggagaugggugaagggcugguggguagagcagucagagcacgcacauuugucaauuaaguuuaccaucuuauggguaugguccauggcaccccaaaacaauuacaauaaaacaucgaagaucacucgucacagaucaccauaacagauauaauaauaauguuuaaaagcuugaaauguugcaagaauuacuaaaaugugacacagagacacaaagugaauacaugcuguuggaaaaauuguaccaauaaacuugcuggaggcaggccugccccaaacuuuaaauuuguaaaaaaaaaaaaaaaaaaaaaaaaaaaaaaaaaaaaagugcaguaucugcaaagugcaauaaaacaaagcacaauaaaacaagguaugccuguauaaccaaacauacauguauaacuuuauauuugcuauaacuuuucacauaauuuucuguacauauagcuuccuuauucucuuuaaugcuuguguggugguccacugcauggauauacugucauuuauggaaucacuucuucacugauacauuuggguugcuucuugguuugguuugauuuuguuguuuccuaugaaaaacaaugcuggagugaauauccuuguacauauauuguuuauuugugcaaauauaccacaacccaaaugaaguacugaggcaaaggacuucuaggcuuuuaauuuaaauugauguugcuacauucauuuuguuuuguuucuugugugggguuuuuuguuugguuuuauuuuauuuuuuuacuuuuuguagagaugggcucucaccauguugcccaggcuggucuugaacuucugggcucaagcaauccucccacccugaccucccaaagugcugggauuauaggaaugagccaccacacccagccaccacacucauuuuaaaacuaaguagccaccauguuguuuuaaaguggcgaacuaacucacaaguaaaauccaagagguauucugaugugguuuauaugcuaugacuguuuacugggauguuguucagguuuaucuuucuaaaauauuuaaaguuuucuacacuaaucugcggcuaauuucuugggggguuuagguuccugugaaggcauucgacagaccugggaggaaucuucuuccccucucaacccaaccacgucccucagugcuaucauuagaacucccaaauguuaucauaucucgucgcugaaugaaaaugccgccaaacgucugugucgcagguauucucagaaacugacccagcacaccgccugucagcugcugagaacuuacccugcugccacccgcaucgacucuuccaacccgaacccccucauguucuggcuccaugggauacagcuuguggcacucaacuaccagacugaugguaaggggccugcaugcucaccucgcuccuuugcaucuuacauuucaguaaaugcaguuugacagcauuuuuucaaaggggcaagauuccagacuggggcacaccauaugugagaguaaaaauaugaugauggaaaacagaagugaauuugauacugaauugugccuccgauguuucagauuaaggugauagaaaagaaucuugaaggggccuguaaggucuccugguccugccccuuuuuuaaugcaguuuuucaaauaccaagcugcucuugacaaagccaugcccgguuuauguuuaaagcucuuuuuggagcagggauuuccuaacacugcccaguuaaccugucucacuacgcaguuguucuugcagucaaaagguagugucacuccaaccacuuugcaaguuaaaaccauguuagcgucuuauccuuuuggaauugagauggagaauaauggucagugcccgaagaguagcuagcaaaaggaaaacaacuaugugaaguacaugaacagaguaaguagugaucauguuucuccaaugucaaugagacucugauaugacgccuaaaacuccagaguagaagcugccguuuauugcacgcuuacugugcauuaggcaguacgcugaauuuuugacccccuauuaucuuauuuaauauucacaacagcccuaaaguuguguaccuuuaugaucgccauuucucagaugagcaaaucaaggcacaaauugguuaauuuguucaagguugcaggaugacuuguaguaauaaauucaaggagucuggaaguuuaaaggauaaagcauuauguuuccacuugguuaugggggaggagaggagcuacagaagguaagaguagauaaauguuuccuaaaagcucuuucauaaaccacaguuuuuccuuugaacagucaagcggcaggcagcuguuaucauucaucucgcgugaacugaauccaaucucaucuaaccaugcugaaccacaaaccacaguauggccuugucuccagcugaggucaaaccacagcuuuagcucugggaccagcuagcuaccuggcacuggugccaacaacacccauugguggaugccccaaagacauaugauuagagauauuggucacauuucugcccuuguuauaugugcuucuuucaguuaaaauuaaauaagaugaugccggugaaguaccauauuuagcauagugccuggcacauagaaagcauucuacaaagguuaacuaucauugauuguguuugauaaguuaugaaaacaguaugauuugggcucacaaauggaaauaauugugaaauacuuucaaaguuguaaaaacuuuauuuucuauuucuguucauucuuuccugaguggcugguggguucacaucuccagcccugucuguaguccuguguccaccuggugccauugguuauuaucccggcauauuuuaaguaaacugaagucacuaucaaaagauuuucucaaggaaauggaagugcauuugguuuuggaugugcccuuucucuggaagugccaggacugguauagacacacuggcuccacugaauagcaaaagggagcaacaggugaaggggacacagggagcugccacuccaugggccauccugcaguccagaaguacaaacuaaagcugccuguccuccacugacccuuaaaggcuuugccucucuuccaaaucaaguugggauugagaguacgucuuuaagccgucccacucaaauggcugugcugugugguucauccucaaguuucucugcauaaucuuccaaaccgggaaaaggugcuaucauauaaccucucuccauucaaugugcugauuaaacaucuccccauguuggacaaaauacaagcaacaugcaguaucaguguguucaucuguaaaaauggucuucauuucugcaaacuggggguacagccugauuuaauauuaauacuuugcacacaguagaugcucaguaaaugcuuguuacucugaguugaggcagauuaucucugucagccccacugcaauaugaacaugugguucuugauuuuuggucaagaucuuuuccaaguguuuacuucucugaauugcaaauucaaacagauagauaaggccaggugcaguggcucauaccuguaaucccagcacuuugggaggccgagguggguggaucacuuccggccagcaguucgagaccagccuguccagcauggugaaaccccaucucuacuaaaaauauuaaaacaaaauaguggggcuuggcgguguaugccuguagucccagcuacucggaaggcugagcgggaagcagagguugcaguguaucaagauugugccacugcauuucagccugggugacagagcgagacacugucucaaaaaauacauagcuaggggccgggcacgauggcuuaugccuguauucccagcacuuugggaggccaagguagauggaucaccugaggucaggaguucaagaccagccuggccaacaugguaaaaccccaucuguacugaaauacaaaaacuagccgggcgugguagugcaugccuguagucccagcuacucaggaggcuaaggcaaaagaaucucuugaacccaggaggcaaagguugcagugagccgagaucgcgccacugcacuucagccugggcgacaaagugagauacuaucucaaaaaaaaaaagaaaaagaaaauuauauauauagauagauagaucgaauagaucgauaagagucaacaguggaagcaccauuuuucaauuguugaaaagaauuuccaggcuggaaagugcuugauuuuccaugaagcaucccaacuaaauagcagagaaacccucccagggccagccucccaagagguuucauggaucaucugcucugugacuuccuggauuucaggggauucuaacgcuccaaguggguguccauggacuuauggccaucccuucccaagcuuucugcugguuccaucaacuccaagaaggucugaagugaucuggaaccaggaguuucccagaucaacacucaauaaaaccaacucuugaguuuagaaacugacgugaggcugguaugcaaaccccugguuauugcuggcaacagacccucuaaguucuuugcaucugaggcagaacaauaccgccucacacccagacuuacaauguguaaacaugcaacccuagucaaaagaaaaacuucuuuuuuuaaagaauuuauuaagcuuuuuugaaugacagacuuccaauccucaaauauaaggauaaacauuaugugaauggugucuacauaaugcagaguauuuuaauggguagaagaccaucaaggcaaugguauguuuaucuaucauuaugugcauuguuucagagguguagcaggguuacacugauuugugcacacuuuuucacuugauuggaaugaugauuuuuaaacuauagccccagaugaaguucugggaccauguccaggggacagcaagagggcuagauuugagguccgaccuuuauuucaaaccgugcggcucuacguggaucucuuuuacauguuuggucaccaaguuagauuucaguuaagaaacugagcauuaggggaaagagcugaugcacgcuggguuuaauaccuagggguuggguugauaggugcagcaaaccaccauggcacauguuuaccuauguaacaaaccugcacauccugcauauguaccccggaacuuaaaacaguaaaauaaaauaauuuuuuaaaagcuucaaaguuuuaauaauagcuuuagaguuuuggcuuuacagcuuuaaaguuuuggaaaacuauuaggguagacacggugcuacugaaaucacuugagguugaugucaugaucacaaaaaaaaaauaguuaccauuuauugagcaccuugcaugugccaaaucucauuuacuguauccacaccccuauaagauguacauuauauggcucaguaguuaagauugggaacaaugggugaggccaucugggcucgauuuauagcauccaccacuuacucguuauguuucuuggguguuuucacuuuuucugcuucaguuuccucauccauaaaaauggagauacuaaaaggaucugcuucauagauuauugggagguacuugaugcacauaaagugcuuagaauggugucugguccuuaguaagagugcagagugcgagcugccauugcuguuguuaguacuguauguccauuucaccuuuaccaaccccauaugagcuagcuggcuucacccucuuugcuacccucaccaugucuguguuccucugucaugaaguggccugagaagagaauuuucucccaaugcaggugaggcagcauggccacaaugaaccagucacaucaggacuggcaggggccugagagaugagguccucugcaaucauuuuacagauaaggagcuuucauaugucuaagacaucuuacacuaggaauuccugcacaaaauacuggccaaccccacagacagggaaacauuuuacagacaggacaaguagaggccaacuucucauugccccagggcguuuacugcacuuugccuugauguggcccauguacagaguucguucuuacacauggaaggaaucuaucagagggaguauucaucaggugugucucaucaacuuuuugcucauuuggguaacuuuuauacagacuugcaccaucaggugagcauuugaguguguaagagcccagaaacagugcaagaauccaauuguucaucaaaguacugugccaaauaaaauuuggcaacaaaaaagccucugugaagguuccugauguuuaugauugaggggauuguggacaugaugugaaucagaugugauuauuuuuuuucuuguuuacgauuuuuuaaaaagaaauagguguauuguaauuuaugggaugaaauugagauuucaaggaaaagcauguuuuucuggcuauucuccuauucuuucuuguauaauuaagauuuuaucuuacauuugaaauagcaagaauuguccauacaauugucugcauggcuuagagauaagccauuauuccuuucuaaaauuuaguauaaaauaaguagaguugccccuccauauccuuggguuccacaucuguggauucaaccagcuauggauugaaaauauucauuaaaaaaaauggauggucgcaucugcacugaacauauaacagccuugucuccuuguuauuuuucccuaaacaauacaguauggcaaccauuuacauagcauuuacauuggauuagguaucauaaguaaucuagagaugauuuuaaguauacagaagggggagaauauauucagggcaacuugaaucuaggcucccaggggaaaaaaaaagaaaaaguaugcagaaggaugguauagguuauaaugcaaauucuacaccaucuauaucacagaccugagcaucuguggacuuugguaccuucucguccuggaaccaaucccccauggucaacuguauuucacaagauuuuucagacagauguagcaaauauuugcaaaggaguuuuuaagugauuucaccuaguuuggagugguaacacugggcauauccauagacuguaagccccagagggacaggaauuuuucucuuauuaccugcuguaucugaugccucacacaacuuggcauauaguagucauuuaucaaucugugggacgaaugggugauuaucucuuuuucaugcuggagcuuagggaaaauugaugcaaaguucuuuugaacuuucaauuuauaaggugauacuuaagcgacaaaguaacaagcuauauuggcuuucuuuguuguuuguuuuacagaucucccuuuacauuuaaaugcugcaauguuugaggcaaauggugguugugguuauguauugaaaccuccaguucugugggacaagaacugccccauguaucagaaguuuucuccacuagaaagagaucuggacagcauggauccugcagucuauucuuuaacuguaaguacggccccuagagaaagaacauaaggucggguuuaagccuuccugaaaacgaacugguuuugaauucaaggcauuggaaagcugucaugucacaauuugggucauacagauuuaguucccagaauaauguauuuauuuuccaggaagcaguagcuauggcuagacaagcuguugccagacacuguguuugccagagcccaggagcagggcauaugaggucccuguuucaccugauguucugaugaugguaacucugucuuccagggcccacagaaucauaacuaugaguauagcccauggaaguugagcuuuuuguuagaucagcucauguuaggcuucaaagcucuaagaucaaacucaugucaauauauaaauacaauuaaguauauuuccuccguauaauuuaaccuuuaucauuccugggccuuuccuuauuccuuuucaccuaauuaacuuauugucaaaacuccacagacuccucuuaaaaacagaccuggccaggugcgguggcucacgccuguaauccuagcaauuugggaggcccagguggguagaucgcuuugcgcucaagaguucgagaccagccugggcaacauggcaaaacccuguuucuacaaaaaaauaacaaaaaaaauuagcugggcauggugguucacaccuguacucccagcuacuugggagucugaggcuggagaauuacuugaguccagaaagcggagguugcagugagccaagauugcaccacugcacuccagccugugugacagagugagacuccguuucaacaaaacaaaacaacaacagagaccuggucaucucuuuccaccuuuagaucuugucucucucucuccacaggaagaaugccaggcagcccuccaaguacgacacccccaaaccccugggauaaccccauucacagacuuuccuaccacccaaacugcuuuuucucuuucccuaagacagcagggcaguagccccuuuccuauuuguuauuuuuuagauagaggcgaggguaguuuuaucuguuuacagaaagcugugaauuaguuccuaacacgucugugacuugcuccaaaaugaaacuauucaagaaaaagauuuugaaguuauaaaauccuguggcauuuugaacagaauauuaguaacaaauuuaugauuauauugcauaaagucuucucuugugagaaauuuaacuucaucuuguuugguuuuugaagauauuugaacauuuugauaguugaaagcuuacaguuaagugaaugauguugacaaaauaggcuuuucauaugauuccagucgugugauuacccaguuacaaucacuuacuuuuuuuuuuuuugagauggagucuugcucugucaccaggcuggaguacaguggcgugaucucagcucacugcaaccucugcuuccuggguucaagcaauuccccugccucagccucccuaauagcugggacuacaggcgcacaccaccaugcccagcuaauuuuuuguauuuuaguagagacaggguuucaccauguuggccaggauggucucaaucuccugaccucgugaucugcucaccucagccucccaaagugcugggauuacaggcauaagccaccgcgcccagcccuacaaucacuuacuuuuuaaacaguuuuauucaucauucacuuuguccauuccaguguucuugggauuccuuugcagagggaagcagugaggugcagagguugucuuucuuuuuuauccucggugacuuugaucccuuuugucucccucacccuagauugucucuggucagaaugugugccccaguaauagcaugggaagcccgugcauugaagucgacguccugggcaugccucuggacagcugccauuuccgcacaaagcccauccaucgaaacacccugaaccccauguggaacgagcaguuucuguuccacguucacuucgaagaucuuguauuucuucguuuugcaguuguggaaaacaauaguucagcgguaacugcucagagaaucauuccacugaaagcuuuaaaacgagguagaauaaaauuguccaaauguuaauaauuguuguagcuaggugauggaugccagaauuuccuuauacucuucucucuuuucuguuugacauuuuccuauaaagaaguugaauuaagaagcaaaaggaaauacaaauuggagcacuuuugaagcacaucucaaaagaaguuuuucuuuuacauuuuuuaagaaucugagguauuaacaauaucccuuguaaaguacagccucacccaugcuugcugaugucaggagcagugguuguugcuacccacggcacugcuggcaguuugaaagcagggauugaaauaaggagaggaaacaugucagaggggucggguguggugguggcauaagugaccgugcaguuggagucggugccuggcagaaguccaguuuuggaagcuggggcuggguuucaggugcaggaagaggggaauggagaauucugggcaaaggcuagagcuauuugcuuguagauuggcuuuguuguggcacucugaugaauuucagccugugcauuguuuuuaaacuuugaugugcacaggaaucugcuaggacugguaauaccaugcagaucgugauucaguggccucaggugaagacugacaguuucccuuucuaacauauuuccaggugugcuggcucugauggucuccuuugagcaccaauauucuaaguacacacuuccucucccagcuacacucaagcugccauccuuggagcucacaaacacauuacaguuuccuacuuuugugaucuuuuccuguuucucuucugugugcaaguagcccguggucauuuaauuagucugcucaggcugccaucauggaauaccacagacuagguggcugaaccacagaaauguauuuccucgcaguucugaaggcuggaagucugagaucaggguguuggcagguuugguuucuucuagggccucucuccuuggcuugcagaugguccccacacagucagcccucuauguugucuguguccuaauccccucuucucauaaggacaccagucccacuggauuaaggcccacccuaaggaccccauuuuaacuuaguuaccucuuuaaagacccucucuucaaauauagucacauucugagguacugaggguuaggacuucuacacaagaauggggaguauagggucgggggagacccauaacuguuauuauagaaaugugagaaaguacauagaaacaaaaacaauuuuuuuuuaauuauccauuuuuccaucucuccaacacagucacucuugguguauaagucuugcaggcuuuguuucucuccccauguacguaacacaugagcauacagauauauuuuuaacaaacaggcuuucuacuaaucuuuguguuuuguaacuuacugguuuucacuuacuaauguauacagugagcaaccuuucauguuaauaacuauacauguacauuaccauuuuuaccagcuguguauuauuccauucuauacuuacacuuacagucauaccauaaauuauaaccaaucuuccauugugggaauguucuauuaucacuaaagcugcucuaagauggaacauuuguaaaacagggacuguuagucuguuagugcuucauucacagggacuguuagugaucagguuuuccuacuagaucagguuuugucugaguuuaagguuuucuguuugagucuaaguuggaaacaguacuuggacaaauuaauugccauuggguaacucagggggcagcacucucuuggcgaaaagacgccuguugguugcaugccuguugccaucccugcccauuuuaaggucuuucuaccugucauuugccgacuuccaggagcaucuucuuuucaguagccaugguuaacaagcuuuucccaauucuguauuacuccaggauaucgacaucuucagcugcgaaaccuucacaaugaagucuuggagauuucuaguuuauucauuaacagcagaaggauggaagaaaauuccucuggcaauaccaugucagccucuucgguaaugaaguucuguuucacucaacauauuuauggggauugcuacacugaaggugggcuuuuuuguggcccagcaaaguggucggugugaguuauuaauuagguagcuauggaaauuaauaacaauaauggcugacacuuggcacugacuaagcacuuuacguauauacuaacucaguccucucaauaacgucaggcaguagcuauuuaguaucaucuccauuuugcagaugagaaagguagagcuaaguacaucugaggucacacagcuagcaagcagcaguccaggauuuacacccaaguuccaguaacaaagcccauauauuacagugucuaucagggaaguaagccaaauauaacaaagugaggaagaggcuuauuaugcgaagccuaguaggaagcauuuccaauacuucuagaaacuuuagguuaaaccaggaaaauauuuuguuucuucagcaguccaggggcaaaugucacaggcagagcaaggcuggagugagcaauaggcucugcuggcgaugcauaacuugcaccucagugcuuggcagaugcagaagcugcucccuugagaauggaagaaggacacuguagaaagugccauaguugcagaaucugcuuuuuuuuuuuuccagagacagugugucucugucacccagugucacucugucacccagguuggagugcaguggugccauccuggcucacugcagccucgaccuuccuggcucaagcaauucucccaccucagccuccugaguagaugggacuacaggugugugccacuaugcccagauaauguuuuucuauagagauggggucucacuauauugcccagguugguuuuaaacuccuggacucaagcgauccucaugccuuggccucccaagguggccucccaaggugcugggauuacaggcaugagcuaccgcaccuggccagaaucugcuuuuuaacaagugccucauggaaacucagugcccacuaaaguuugaggacacuuggaccauggcccccucacuaaugcaggaugguuuaauuagguaagaaucugggcugagugcagcggcucaugccucuaaucccaacacuuugggaggccaaggcagaaggauagcuugaguccaggaguucaagaucagcuugggcaagaccccaucucuauuaaaaaacguguuuuaauugagcauagugucgagcaccuauagucccagcuaccugggaggcugaggcagaaggacugcuugaguccaggaguuugaggcuacagugagcuaugaucacaccacugcacuccagcauggacaaagaaugagauccugucucuaaaaaagguauuuuuaaaacaacuacuuuaauuaacuggcuaauuccauuaugcuuccucuuuaaacauacauuuuaaaaguguauccauugguuacccccuuuacauguuuaauaaugugauuacuucugugucaaucucagacucaacguaguccuaacaaucuuuggaaaggcaccuucugcgcucacaauggcacuggccaugauggcuuccacugccacuuucugcuuucuuuucugcccuucuccugcccucaccacuaucaguuuugacucccgcugucccugcccuuguuugcuuagguguuccuccuuuuucccuucaucacuccacagcaaccuucacuguacauuuguaucaccuggggagcuuuaaaaacuccaugugcacaggccacaccccgcaccaauuaaaccagagucucugcaggugggccccaggcaucaguuuuuuuaaggaucaucaggcgauugcaccauguguccaagguuuagaagagcacuuuggccaaaguggagggagguguggcuuccaccuugugcagaggauugacaagcaagggcagggccgcgugguacaaagagcaggaaucacaugcuuucagaaaggcagagcagggccaaauacccaauucugagcugggugaccucgauaucuguuacagcugaagauuccacagaugccacaaaugaacuguuuuuacucacgacacuucugacaccaaaaacauggugucuuuuccaacucucuggcaacagcuggguguccuacauuucaguucaauucuaacacuauccaucuagaguuggugucagaucccacacauugagggcucagucccacaagacuacuccuacuucagaugccagucagaagucccagguugucaccaggacuucugaccaaacagcuauaaauucaggggauccauauaaauccucagauucaagaguuugcuagaaugacacagaacucacaagagugcuuugcuuauuaucaccaguugaucagaacagauguacuucaggagcagccucauggaaggaugcauggaacaagguaugggaggaggagugcagagcuuccauguccucuccaggccacccucccagaaccucgauguguucaccaaccuggaagcucucggaaccccaucauuuaggguuuuuauggagguuucaugaccugggcaugauugguucaauuauuggccacuggugaucaguucagucuucagcccccuccccuccuugaggucuggcagcagggcugaagguuucacccuucuaaucaugccuuggucuuucucagccaccaaucaucucauuagcaacaaaggacacucuuaucacuccagagauuucaaagguuuuaggagcuguguggcagaaacuggggacaaagaccaaauauguauuuuuuguuauaucacaccuugccauccuugggcuuccugggcagccauauauggauaugugcuugguaaaugugcauuugaccauggagagcaucacucuccauugcugaagccaauaacuguagaucauccuggccuucugccccauuuaagacuugaucauucuauuuccuuaguaucuuucaaauccauucaucuugaucugucuuuauugccuuggcccugguucauucucaccuggcuugugguagagucuuccuaauuggucucauuuccucuggguuugccaccucugucuguccucaucuagggcaucccaaacagaucuaucuaaauaugaucaugucacuccucuguggaaaacccuccaucaguucuccauugcuuucaggguauaguuuauaccagaaguaacaaauucacaugccaggaggaucccaagaagaugaugugcaggcauggaccugggcugagcacagacucuuagaaagcagagagcucaugggucauuuagaggggagcucaugggucauuuagaggggcagcugucaccuagcucucagcucuagcugcuuguugccuugugaugucgucagaucucuugguuuuucaagagaaucaggacaucugggguuuuguaaauguuggcaacuauuuaaucuuuuuaauuaauaauauagugcaagcuaaaugauacaauuagaaugugugcauuuuauaguaugacaauuauacuucaguaaaacugauuuuaaaaaaaucacauugugcaagcauaacaaagacaaccucuccuccccaccccaaauaaaaauuaaguacaugcuaaacaauacacuucagcccucagguccucauuuugccaguuucagucuaaauuuuagccaguuaggcaaagcccugaauggcugugcuuuugccugcaucuccagccuuucucccuccaacagguuaguuguagaacuugcugagguucccagaaugcccugcuguaggccauuucuaagucuucauacacauguuacgucaauuugggguucucuugucucauucuucaucugcuaaauuacacuagguccuucaagauuugguucagauaccauuuuucagaaagcccucccugguuucucccuuaccucuucuaggccaccuccucuggaacuuaaaaugcucuuuacaacugccuacuuuccccucuagcuaucucauucaacuggaagcccuuggcagggauagugucccauuugccccugauuuucuagggacaggcauaaugacugauucacuauaagccuuccauaaauuauuuauuucaaaugaauauaucuuaauacacaaaaugcccgaagaauugaguuacacacuuaccgaccucuuucuaacagauauauguuugcauucuaaugauucaugugccugaaugauguacucucuaaaggcagaacauuuuauuauuaccauccaaauuucuagcccaguacccugaagagagauggaacucaauagauacuauggaacaucaguuaaugaguaagaacuaacauacauuucagauaauaucagccucuaauuaugauggaaagagacacuguaauuuaaaauaauauuuuggugaugugcuuaugaaauacccucacuaaaugacugaggaagagguaccauuuguagcacuaggcuacaaauggacucucaucuuuugcauuuacauguuccuauccguacuucuaaguacuagcaccucuguaucaaauagagcuuagaaauaugugauuacggaugaaugaucagccaugugaucuucuugacagauguuuaauacagaagaaagaaaauguuugcagacucacagagucacggugcauggggucccagggccagagcccuuuaccguuuucacuauuaauggaggcaccaaggcaaagcagcuucugcagcaaguaaguccacugagccgugguugggagaauccaaaaucuaagauguauggauguauguguguguauaaaugccuguguguaaacauacacagaugcacaugaaugcgcaaaaguccauguggaugauaugccuuuugauuauuuggaaauguguuauucaacauugagauccacuccaagaaucaccugauggaucuugguaccacuagacaaacuaccuucaaccuguagagaagauuuuuaaugauucuuaagcuauauaaaauaccaggcucuagaaugauaaagaccggaaugaguggccuuccaaccauauauacacuuucgcccuaagccuagacauggccuaaucuuccuucuucacgcagagauuauuaaucaaucagaauuugcacauuaggugaauggaaucuucuugccaucugaggagcugaaucaaauucuuagagcuucaggaugggccacguggaccaaggagacauuuucugccccuccagccuaaggccuuccuuugcauguugagcagcccccuugcuccccuccccuggcaccugaccuuggcauuugagguccucuccuuuuggugguagcaagaggcauggagacccugagaccuguuaccccaagcccuguagcagaacuggccuaagucuccuuaugcugugccaccuccgcccuagaucccccuccgaaggaucuuuguggccuucugcagacagguccccauccauggggggacuucuaagagugagagagccagggacauggagcagcauccaaagagggagggggcauguccuccaaagggcgaggcagggcccaugcguaauuccuuuuuucaccacaccagaagcgcuauccuugcuuggcacaguggccuaaaauccuugcagaugauuuuauccuuaacccauuucagaauuccuucuccaugcagccaggcgcaguggcucacaccuguaaucccagcucuuugggaggccgaggcaggcggaucacgaggucaagagauggagauaauccuggccaacauggugaaaccccaucucuacuaaaaauacaaauauuaggugugguggcgcacaucuguagucccagcuacucaguaagcugaggcaggagaaucauuugaacccaggaggcagagguugcagugagccaagauaacaccauggcacuccagccugggugacagagugagacucugucucaaaaagauaaaaaagaauuccuucuccugaauaggaguagacuaaaggaagcaaugaccaagggaauggcccuuuagcucccucugaaguuaggguguaugaugaaauguagcugggaucauaacauuuggaggaauuaaaaaccaacugaacaaucacaaauaauaagugucaauaaauggcucugucuuucaagggcacaucucuauagacaggcuaacauucuguccaacauuuuauaacugacuuaaauagagaaaacagcucaggugucacauuucauagauuaucaaacagaagcuauuaccaacaguuuguuuugguuuuguuuuaauacaucaguccauguacuuuaguguccacuaucacaaagcacugcugaaguuuuguaaaggaaaacuuaccaagagccacccauagcaguccauugcuuuacugucacccgugcaaaucagcacacagauauaaagcaggacugagcagggggugaugcuggcccucuuguggagguggcccagaagcuucacauccugaauuaucccuauaguauuugccuuggcccccuuuugagucaacagcauuucaucauuuauagaccaagggcugggguggagagauuucagucuuccugagaaccuucacucccacugcccucaguccaucacauucugcuuuuccuccuggugagauguguucgcucugggcuuugccuuauuggcaggggccugaggagaaggguguuugcuuaauccagaccagaugguggcagcuuucucucaucaccaagcuacuucucacgggaaggcaacaaagggaguuucuucacugcaacugaccuuuacucccuucaaauucagccuuuuguaguaaccuguacaauaugagugagaaaauacauugguaaaacuauaaugccuguaaucccggcacuuugggaggccgaggcgggcagaucacuugaggucaggaauuugagaccagccuggccaacauggugaaacccugucuccacuaaaaauacaaagauuagccaggcaugguggugcacaccuguaaucccagcuacucgggaggcugaggcaugagaaucacuugagccugggaaggcggagguugcagugagccgagaucacgccacugcacuccagccugggcgacagagggagacucugucucaaaaaaaaaaaaaaaaaaaaaguaacuauaauggcucaucuuuauugaguucaccuaauguacccauguuaugauuuaugcuucaaccauaaaacaaaauuaagauugcuacuauuuccauuguguagaucggaaaacagucuccaagggauuaaguaucuuacccaauaauucguagccaacaaguauuaaaggcagaccucagacucaggucugucugguuccagggcuuugucucagcugcccuguuugacugcacagggucagcagccaacaaagaaaacaagcccuuuaagcacacugucagaaguuuauuuaaagaagaauucccaggaacuuagaccacaugagaaccuagcccuacaaaccuuccaugagaagaugaccgaguauuuccaaugugagaaaaagagauuaucuuaguaaauacuaaacuagguuauuugcccucaguccuguguugcaagauuacaaagggcuaaguucauggaaugagaaaccuaaaauuuuuaauucacuaggagcucucauuccagcagugggaaaaaauaguuaugcugucuggggauuaugaauaaguugugccguugcccggagugaacauaaacaauccauucugaacauaagagaauucuuagaucuuccaaaaagaauuaugcaauacucuagaguaaauuucacuuauaaauugcauagcaaaccuaucugaacaccaugaaaguugauuuguuuuaaguuuuugccucacuccucaguuugccuucacuuuuucuuuagauucugacaaaugaacaagacaucaaaccuguuaccacagacuauuuuuugauggaagaaaaauauuuuauaucuaaagaaaagaaugaauguaggaaacaaccauuccagagagccauugguccagaagaggagaucaugcaaauuuuaagcagcugguuuccagaagagggauacaugggcaggauugucuuaaaaacccagcaggaaguaagugugucugggugcagccuacacaguaacgacucauuaugugauuagccauuuaccacucacaaccucccugaaauucagaauuucuuguaauugcaacuugguuuauauucuucuuaaguaaauguggaugaacaguuuuauucuucugcacauaaucagaauauuaucucuaagguacagaaauucaaucuaaaaaacaucccuuagaccgggcgugguggcucacgccuguaaucucagcauuuugggaggccgagguggguggaucacuugaggucaggaguucaagaccagccuggccaacauggcgaaaccccaucucuacuaaaaauacaaaaauuagccaggcgugguggcaggcaccuguaaucccagcuacucaugagggaggcugagucaggagaauuacuugaacccaggaggcagagguugcagagagcugagaucgugccauugugcucuggccugggcaacagaacaagacucugucucaaaaaaaaagacaaggaaauauguuuucucacacaaauaaacuauuccauuuuaaaaauaaauaaaaacauaccuuauaagauaaaggaagcaaagauuccuuaugcaugucaucagcuauggguccaguauuuuauuuguaugugugaaaagacaucguugugagggucacauuacuguauaaugcaaaaccugcagguauuuucuauucuggggaugacugacuuccaguuuuagcuaauagaaguuuuagcuaauagaagcuuccaugcuuacaaguaaaauaauaauauuucuuugaaaauauuccagaacuucauacaaaguaagaauaauaucuuggccugagucagaauuaguaacaauuuauauuacgugugcuaagauucccaugaucauuccugggaaggaaaggaugcaacaacugccauguugacuccaaacugauuggcuccuguuugacuuaauugaugaagcacuuuuuuuuuucccugaauuaacugagaaaacccuacuaacuuaagaaugacauauaaggucauuucucuagcauagacagucaugcgucaugacauguugauagucaagcaguugagucuauucaacaauuugauuacauaaauauugagcaccuaauauguaccaagcccuguucugggcacaugaucugcuccuuuggggcauguaauagugcuugccugauagaaggugccucaggcccaugcuugcuagggcacagugaagauaauagccaauuuuaaccauuguguguuuucacuuucuagucacagugagugaaugugaccuaaagccucuacagagcucuagcaucaacucuagagcccagagccacugccuucuuucccugaccuugccugagacaaugaaagggcauuuaauuuaagcaaaaaaauguaauugucuccccagccuucucucccuauuaagacacacuaauugcuaagacagagaccaggcaacccuaauaauaaucacuuuaugauaaaauaucagagggcuuagcuguacuuuugaagccaucuuuaaugucuaaauuuuuguccuguuccuaaauugucuugccuuauuaauuagcuacauguaaaaaguauguauccucuaagcgaugucagaaaaucaguaaauuuguaaaccucauacuuguguaugauuuacagcguugaaagcccucaaacacuauguugaaugauauaauggaaaccauuuuacacuuaaggaaauagauucagagaggugaaaucaugacaggguuagaaguagaaagaacucaagucuauggcuuccaggucaguguucuuuccaccauccugugcuacccaagcugaaauuguguccauccuuguggaucacccacacucagcaccuugggaggagcaggaggcaguggguaggcuagagggaagacaggcuggcugcugagugucacaggaagcuucauuuuaugcucagaggagcuggggaggugagggacacccaaaugcaauuuaaauguauaccacaacaagcugggcacgguggcucacaccuguaaucccagcacuuugggaagccaaggcaggcucaggaguuugagaccagccuggccaacauggcaaaacuccaucucuacuaaaaauacaaaaauuagcagggcgugguagcaggcaccuguagucccagcuacucaggaagcugaggcaggagaaucacuugaacccaggaggcagagguugcagugagccaagauuacaccacuguguuccagccugggugacagagcaagacuucaucuuuaaaaacaaaaaaaaguauaugacaacaggcaguagggaccucaggaauaugcuuccaaaaggcugguaaaggaaggcauuuugaagaaaaaggggcauaaaucagaagggaaggcuaacaagauuuuucugauaaguaaaauauggcaaguuguccuuuauaugccuuuguuaggaaauuuuugaaaugacugaaauauaucucaaaagauaacuaaauuuaguguaucuagguuuaccuggugcauagugauacccaaauaauaauugcugauugaauaaaugaauucaguaauuacugaauguaagagggcacuacuagaggagacagauuugggcuauaaguauuuccauuuauuuuaucccauggaacuaauaagacauauaagcaguuugcccauauaugaaaauucuucaguugcucucugugaccucugaucucuccugccuuuuauaauuuucuugucuccugggcuuucaagcugucagauaccacaucuuccuguggucaauguguccucuucuguuacuggauuugaaauuggguaaaccaggauugucacaaugaacagaccaccuaacuucuguaaaccucacugcccuaauuuguaaaaucuauauacaaacuacccuacuugacucaaagaaaugaucaugagacucaugucaaacauguacacagacaagguguacaacaaugcuuaguaaaaagggauauaagugagggcuauuguuauuuuguucauaaccuguggcuucgaacuaauguggcuagaaauaccuuaaaauaagcucugagggaggcucaaaggugcucuuuuuuuuuuuuuuuuuuuuuuugagauggagucuggcucuauugcccaggcuggagugcaguggcgcgaucucagcucacugcaaauuccgccucccggguucacaccacucuccugccucagccuccuaagggugcucucuuaaaaauaaagcuuaaugcaucguuguugggacauuuuaugugccaacucugguuuucugauuucuugccuccugguuugggggacaaagauuauaaauuaugucaugugaauuaccucucaaucuuacucucugacugguuaaauauaugaugaucagugcaaugacauauuauuaagcaaguuguaaaacaguauacauaggauacaaucucauuuuauguaaaaagagacaauagcucaucucuucccccccuuccauuauauaauggaguauucauucaugggaaaaaaaucaaauggauuuuuucacucauugaaaaaaguuaaaauagauuauauaucuuuauuuauuuaacaaaaaaucauguaauuauaaggccaugauugcaaaguuaauuaaaugauuggggcaagcuucagaagccaguccuuucuggcccugguugcaguuuuggcgccaccugguggcaguuaucuauucugacuuuaaucaauggguacaauucuaguuggaacuuccaagauagcgacagcaacucauggauucuucugguuaguuaguuagcacccauuucaguagccuggucuggagagaugaggcuagaauucuggggauaagggaguuuuccugccaagaccucacuugcugagaugagguugucuacuguuuacuuacuuuaccucucccugcccuuuuacuaagucucccucuugcaaaagggaagcuauccucauuugaaaaugugguggacaaagaacagcagcagcugcuugacaaucacauuauaucuaaauucaccuaauucaaggguguugcuuuacauagucacauacacaaaaauacauuugaacauccacagcaaauguuuaaaaggauguauuauccaaugacagugggguauuuuguggcgaauaaggugggagaaggaaaaaagaugagaaugggaaaaguuugguuuuucuuauugauacgcuucuguacuguuugaaaauuuuuaauaagauacauauaucuguagauacauaauccaccaaaaagccaauuaaucuaauucucauaauuuuacugugaauuuugucaaaauuuguuucaauguggcuuaccuccagccauucauucagccuugucacugcaguuuuguucacccaaccugucaauuucaugguuuauauuucagaugucuagcauuucuuaaaugcucaacgucuguggaaaugggugagcuuucuuuuaaauacaauuuacuguguucuuauuuggcuuuugcuaauuggcaaaaugguauauugucuuucuacaaauuuaccuacagucaacuuggacucucaaaauccacagcuaggcggggcacaguggcucacaccuguaacccugguacuuugggaggccgaugcagguggaucacaaggucaggaguucaagaccagccuggccagcauggcgaaacccugucucuauuaaaaauacaaaaauuaggcaugguggcacacaucuguaaucccagcuagucaggaggcugaggcaggagaauugcuugaacccaggagguggaggcugcagugagccaagaucaugccacugcacuccagccugggcaacagagcaagacuccaucucagaaaaaaaaaaaaaaaaacccacagcuaauaggagcagauaaauuggcuuguuauggaucuaucaacaucaucagaagcacaguaguuuccuccucucaggagauagguauauccuuuuagaacaguuuaugaaauaauaacauaguauaugagauauuaagcuaagaaguuucuacaucaccaagauacaagcucagauuuuugcuagauuugucuuucuuuauucugcauaaaccuauuauuuacucacauuuuuucuuuuuaaacauagaaccuagaagagaaaaacauuguucaagaugacaaagaggugaucuugagcucagaggaggagaguuucuuuguccaagugcaugauguuucuccagagcaaccucgaacagucaucaaagcaccccgcgucagcacugcacaggaugucauucagcagguaaaagccucucccuuccucaccugaguccuuuccucagcauaaauuauuggaacaaaugucugugcacugauggcucauuuuaugagugaaguuccucaacaacagggaccucaaaggggagugugugccucuuaaggcugggaaauugccucacaugguggcucaugccuguaaucccaguuuuaggaagcugaggcaggaggauuacuugagcacaggaguuggaggcugcagugagcuaugacuggccacugcacugcagccuggaugacagagugaggcccugucucuaauugaaaaaaaaaacaaccaacccaguggcucacaccuguaaucccagcaguuugggaggcugaggggggcagaucacuugagcucaugaguuugagaccagcauggcugacauggcaaaacccugucuuuacaaaaaguacaaaaauugcugggcacggggguucacgccuguaaucccaacacuuuguggggccaaggcggguggauugccugaggucaggaguucgagaccagccuggccaacauggugaaaccccaucucuacuaaaaauacaaaaauuagcugggcgugguggcaggcaccuguaaucccagcuacuugggaggcugaggcaggagaaucgcuugaacccgggaggcagagguugcagugagccgagaucaugccauugcgcgucagccugggcaacaagagugaaacuucgucuaaaaaaaaaaaaaguacaaaaauuagccaggcaugguagcaugcaccuguagucccugcuacucaggaggcugagauaggaggaucgcuugagccugggaggcagagguuugcaaugagccaaaaucgugccacuuuacuccagccugggcaacacagccagacccugucucaaacaaaaacaaauuuuaaaaguuuaaaaucuuggaaauauuaauucauuccuucaacagacacuuaguaucuacagugaguuuggaucucuauaaagcauugauaauaauggauuuaggaagugacucugcagugacaaugucauggucccagaaauaccuaagccaguagguacugaccaucucucaaggauccuacagaggacaaguaggaggccuacucugauccucuccccuccucuaaaucacgcuucucugagaguuuacaugguuucagagaaguuugcuuccuucauagccuuguuaggguaggccauucaucaaacaccuauuugagaagacauacaacacaacaauuaagagcacagacccuagaucaagcuguguuagauucaaaucccagcucuacuucugagaccuggaguaaaagcucagaucugugccuuaguuauaguagugugcugguaaaccagcucuuuguaaaagaaagauaaaagcccuuauuuauuucuuuuguguaaaugccccuaccauaucugauuucaccagacuauucccguuggcuccagcaaaacacuacaugguaagucaccacauagaccaccacauagacaauauggagauaguaugauaguacuuuccuugaagguuaaguauauguaagauguuuaauacaaugccuagcaaaugguaaacauuacuuaaggguuacuugcuguucuuacuguaugauaacuuaguuaauauuagccaucuuauucaacugacuuugaauuccaaagggcccagacuuacauuucuuuaacuuaucuuugucuccccuaaaaguacagcacaguaucugggacauaauuggcccucacuaaacauuuaaugaauuaacaaaugcaucaaugaaagacauucuuauauuaaaugaaaagagagaucaguugacuucuaaaauucuuucaacauccaagacucugugauagagauagcccagugggacagagacgcuccugaagagcaagauucuauuccucacuggcugacuuucaugucugugagcgcugguacaugcagaaaaucugguucagaccuuuauuguuacuauuauagcuguauauauccuggaaucuacuuaaccugucuuaaguauaagcuuccucgucugaaauucaggauaauaacaccuaauucauagacuguugcaaagcuaaaugagguaacgugggaaauuacauuacaagcuacaacuauacaacugcaaaaugaguuggaugaaaugaucuggaagauccccuucaucucuagucugggccauuuuuccaccuuaaaguuucauauagaaugaaugcaaauguuggagauucugugucuuuauucaguugaucauaacuuaccuuucagaccuuaugcaaagccaaauauuccuacagcauccugagcaaccccaauccaagcgacuaugugcuuuuggaagagguggugaaagacacuaccaacaagaagacuaccacaccaaaguccucucagcggguccuucuggaucaggaguguguguuucaagcccaaagcaaguggaaaggugcaggaaaauucauccuuaagcuaaaggagcaggugcagguaaaguuuaaaguuauuuugcucuguucuuaaguuaucugauacccauaauuacacuguagccagaucuggaagcuggugaaauuuaggagaaaguuccugagucaaggaauggaguuaggagaaaauuguuuggcuuuguuuucacugugugaaaaaacauguggccgagcuugcgguuaagcaguccuagaggggagcuccucagcccuacucucuccaaagcucuagagagaagaggaaagcgcucuucugaaauagugucaugugacagaggaaccugaguuuaaccuaacaccaauggaagguucuuuguucccacaggcaucucgagaagauaaaaagaaaggcauuucuuucgcaagugaacucaagaagcucaccaagucaacuaaacagccccgaggacuuacaucaccuucucagcucuugaccucagaaaguauccaaaccaaggaggagaaaccuguggguggcuuguccuccagugacacaauggauuaccgacagugacuaagggcagcauguuuaacccagguauaguaagucauugcaccauccuggaacagggcuuaacuuaaacuacuuuguaaggaaggcauaauuaguacaaugucuuuuaucuuuuccaacaggaggaugucccuugaaggcagguaggaaugggaccuuaaaacaggaaaagggcucugaagauauguguaacaugauaugcuauugaacaccgccuauaaagaaaaagggaaagaggcugggcgugguggcgcaugccuguaaucccagcacuuugggaggccaaggcaggcagaucaccugaggucaguucaagaccagccugaccaacauggagaaaccccgucucuacuaaaaauacaaaauuagcugggcaugguggugcaugccuauaaucccagcuacuggggaggcugaggcaggagaaucacuugaacuuggaaggcagagguugcagugagcugagaucacaccauugcacuccagccugggcaaugagagugaaaacuccgucucaaaaaaaaaaaaagaaaaaaaaaaauauauauauguaacuugagcuuuuguaauuuuagaccccuuauuuauuuuguagauaaauaagcaaagcucccaagaagucaaucaacuugcccaaaguacucugauagccuuauuucaucagacaacugucuucaguauuaauagcugacagaaacauucuucaagggcucuauggaucauucagcuuuuauucuuuuggauuucucguuuuauuacuguucuaauuuagguuugauguagcuucaacaaccucaucuccuucugccucaauuaaaaaaauaaaaaucuggcauccgggaugugguuaaaaagaaagcaaaauaacauaacagccucaaucuuggaaaugcaguaaacugacugcuugauagucacacaaauuucauucuaucuuaaagcaaauuauuuacaugagaccugaauaaaagcaugugagggaaccagugguaagucucuccuuuucgcuuaguuuccuaaugaaccuaaggguucauuaaagcccacuuuucaccuguuccaugguaguucacagauuuaaaauucccaagaugaacagcacagugaaagcauugcuguuuaugugacagagcuucaccaucugccuuuaugacaaugaggaacuucugauauaaaacugccaaacugcagaaacucacaauuaaagaacucagugaugccucuucccagagccaaauuuuacuuaaaacagcccaaaagaaggcccaauacauugagaucauguuuccacauuuaaagagcaacuccuaaaauaacugauguccuauauuacacucugcaguggucaaaauuuuaaauauuguuuuccauauccagaaguuaguaucaaauaaaucauaggugugauguuauacacaccucuauaacuucuguaaugaggugaaauuacacuaaagcuaguaaauuggucauauacuucucuacauauaaagagcccgauaugugcuacaagauuacuucuuaaguacagaagaauacaacuccauuagaaauuugacuuaaaaauaauaugccuacuauaaugaacauugcuaauugcuuauauuuuaggagacugggggagggugauugauagugauuuagaugauugccuuuagauucuauuguccuguagcaaguagauauuuauuuuuucugaccaauggauucacaugacuuuuuuuuucuuuuucuaagcaagcagauauuuagaaucauucuguuaacuucacagcuuugcuuaaagcuggggaggccuggccaggcacaguggcucacgccuguaaucccagcacuuugggaggccaaggcgggcagaucacgaggucaagagauugagaccauccuggccaacauggugaaaccccgucucuacuaaaaauacaacaacaguuagcugggcgugguggugugcgcagguagucccagcuacucgggaggcugaggcaggagaaucgcuugaacccgggagacggagguugcagugagccgagauugcgccacugcacuccagccuagcgacagagcgagacuccgucucaaaacaaaagcuagggaggcuucucuuauagucauuggugcaucuaugugaauugacaucccauguuaugaccuccuuuacaauggucuuuucaagaaagagcacuuguaaaagaaaagaagagcucauaagaaaagaaguuuagaguuuaggaccaggcacaguggcucaugccuguaaucccagcacugugggaggccgagguguguggaucacuugaggucaggaguucgagaccagccuggccaacauggugaaaccccaucucuaccaaaaaauauaaaaauuccuguagucccagcuacucaggaggcugaggcaggagaauugcuugaacuuuggaggcagcaguccagccagacaagagggagagagagcaaaaagaaaguuaguuuaguauuguuuccacuuuuuagguaacauauuucauauuuguucuaaaaugaucccuuuuaaaguuucaauaaucuacagauuuuuaaagaacauauucaucuaucugaaguaguaguuagcugaaggaauuccaccuuuucuuaaaguugaacaguuuauuugaugugaucuuuuuuaaaaaaacaaacuuucuaaagaaugugaaauauuuauuuccaaggcagaaauaaccuaauguucuacuuccuagaaacaucauguucuaacauugugaguacagaggaaacagucucuuccccaaaccuagccacuagagcuguggcuggaaaacucugaacccuugguauaccgcaaguguuucuguuucuucauuuucaguauacuaauaagccucuguauacaacauuacaggugaagaucuuuaagcaagaaguuaaagagugaacaugguggaaaaaauauaauuauuuucaucagacuuaaacuggaaauugaugauuucugaacugaagccuucacacaugugagauccaugcugaggagaagcaaaauggcacagggcuaguugccaccaaccaauuuacugaugaaugaagcccaggggacugccauuuuauaaaugucagcaguuggaaaaaucgucacgaauugacuuagagcaagggucagcaagcuugucuguaaagggccaaacaguaaauauuuuagggcugggggccauaaaauauguugcaaccacccaauucugccauuguagugcaaaagcagccauagacaacacauacaugaacgaacguggcuguauuccaauaaaacuuuauuuauggacacugaaauuggaauuucauauauuuuucacaugucacaaauacucuuguuuugacuuuuuuucaaccauuuaaaaacuuaaaaacuauucuuaauucaggggccauacaaaaacagguggcaggcuagauuuggcccaaggaccuuaauuugccaacacaacuaagagaagagaacugggaacaaggagcacaaagaucugaaaacaggaaaggaaguuuagccauacauuuuauggccgagaauuagaagcuuagaauuagaagcuuuggggcauuucaaguguaaauauguccuauaacauaagagucauuaaaauucaauuuaguuccuguauuguguaccacagugcacuccucuuuaggauuuuuuuacauauagaaauaauauuggguuuuuuuuaagguuauugccuauucaguuaauaggguugcuuuaaaaaagguuauugcuuaaucauagauuagauuacucauuuuugguuuucaaaaugaauuuagaaugacguauaauuuaauaucuacugaauugcaaugucuuaacaagaaaccuaacaauuuuuuaaagcaaaaguagauugaguuggcguuuaaauuuauuuugcaagguuuguacugacacuauacuuauauauuuauuauacaucgcucucuugauauugccauggauuagaagcauuaguucucaguacuugaagacaaacuucuaaaaagaaaauauaugcucugaacaucugaaaugggcuagacuuucaaguaaaauugcuucauuucucauuaacugaagagcuauugauccaagucauacuugccauuuaauguaaauuauuuuuaaacuuugcuguacaaaaccauuaaguguaaaggauucuucauauucuuaguaugaagcaaauuaugaauuuuaaaaaugaaauauguauuccucuaaaacccaaacuuuuaucuuuccauugguaucuuugaauuuuaagacacuuuucuucaaauuacaaaacacuaaaacucacuccuaaacuucacuuugagaaacuuuuuuaaccaauuauaaaaauaaaaccauccccauguguuucuugcauauucuaaaaacagaaguguuaaaaauacaccacacaggcugggcagaguggcucacgccuguaacuccagcacuuugggaggccaagaugggcggaucaggacagagaaugaggccauccuggccaacauggugaaacccaaucucuacuaaaaguacaaaaauuagcugagcgugguggcacgugccuguaaucccagcuacucgggaggcugaggcaggagaaucacuugaaccugggagguggaggcugcagugagccaagaucgcaccaccacgcuccagccuggugacagagcgagacuccgucucaaaaaaaaaaaaaaaaaaaaaaaaaaaaaaaaaaacaccauacagcuuucaugucauugaaaguucuuacugggucaaagccuuaaggcuagaacuaccauuuucuugucaacagaauucaggcuauuccaguuugauguaaucuauacaguaguacaguuuuaagucaaauauucauucuaacaaaugcacaaugcugcuccauuuuaaaaauauuccggaaacacuuuaucaagccucuauaagugaacaugccaaacaguuugcccuaccacguguugaaaacugaguugcuggucuaaguggcuagaggccaaaugaaaacugugcagaguaacaagaugaaaagacucgucucuuuagguuuaucacauuugauucugaugcuaagcgcugccccacuccuccuccaugaccuuuaacacagguguauguuuuacaacauaaaucugagacugaaguugagaccagguuguuuagcaagugagagaauccagccuacugccuagguugcaucccaauuuaguuguuuaucacauuuugaggugaaaguacauacuucauuguauuugagucuuugggauuacagaaagaacacauuguuucaaaauguaaagaguuggcugggcacaguggcucaugccuguaaucccaacacucugggaggcugagguggguggaucaccugaggucuggaguucgaggccaacauggugaaacccgucucuacuaaaaauacaaaaauuagcuggguacuaaaaauacaaaaauuagugguggugggcaccuguaaaucccagcuauuggggaggcugaggcaggagagaauugccugaacucaagacgcagagguugcagugaguggagacugugccacugcacuccagccuggguacaagagugagacuccaucucaaaaaaaaaaaaaaaaaguaaagagucuagucuacuauuauacacaaauggccagcacaaucugauguuggcugaaaauauuuaaguuuuauuuaaagcuuucugaauuaaacagcuauauuaugccaagugaaagaaauuauccuaaauagccacuaugacuauacccauuaccauuucacacuuuuuaggccaccagaaaucuggguagcaaacucuuc

SEQ ID NO: 21566 - RNA, 5245 nt, Homo sapiens
accaccugguccaaaccaguuauuguuuucuuugauuuaauuaaaaaguuaaaaaaauuagaaaacccaacccugcauguauugguugucuaguaccuauggccucacagcaguagcaauaacuuauugggauaaaagggagaagcagaggcugaggaaugaaucccgggaaucgagccgcgggcggaccagaagggggucuaugccgaggcugggcugggcuugcucuccagucuggggggagcucugggccuuggggcagggaaaugggcaagcuggggaaggcaggggguguggcuggaggcacugagacccuaacuccuuuccuaaggggggcuaggaugacgcguacaggggcgguggggagaacuuucccaaauagcuuagccuaauauugagacuucccucuucaaggugaggccccaccaccgacagaggggagcuggagcugacaccaccuucuacucugaaaccuccgccucagggugcccugagccccuccaccuuucccuuacccucuccuccccugccuacuuucugagacccugaggucuucacccagaugaagaagcccugcuccugagagaggaagcccaacaucccagggaccccaggaccccugggucaaaaaggacagccugggcuccgugcccaucccuuaggccuugugccaguaacaacauucgugaaaacacccuccaguagggccgggucagccuggaaguuggggcggggccagagggcaagcaaggcacagcuggcagggcaaggaggagugcccuucaguggggcucugccgccccguagaagaaaggguaguagagggagcagggguaggagaacaugaauuugacugcaaacuucaucuccuuauucuucuugucccagcgguagacggccaugagcagcagcuguccauccacuuugcggcccaugaccaggaagcugcccgccaggcuguccagcugugggcaggggcagcccgcgccauucuucaugugcagcaccagccgcuugguguccuugcgcuucagggggcccggcuugagcagcuucuucuuuuucugggcuccaaucagcuuccgguccccauucucuaucuugaucuccuugaugcgcauuuugaccacugugggaagaaaggacaggggcaaguugggaauggucagaucugugugggaugcuggugggcacagaguugguguguucuggaccuucgggcugggggagccugaugcccugcggggcuuggaaggguggagcucguagggcacauuuucauauuuaugaagcacuuaucaugcugcacucucaaggacagcaucacguuucauccucaagguacagaagaggggaauugagggguagagagcuugugaccugcgugaaucgagaguccaagcccuucugagacaccaaaggcaggguggagagcucuugauggagcagcauguggggcuccccagggaggggauaaggaguggaugggacuggggccgacugcuuggaaggggauccuugugauggagggaagcuggacuuccugaucucuggggaugauucccacugggauuucuggcugugugugaguguaugguauggaguauauaugggguguguauaugugugugcaugcacacacggugagugugguuggaacaguggugggcuggcaaauauuuaacagccggcucuguggacagggagcccugcuuugcauucauugacauccaugggguaaauacucccaccauaacugaccgcaugacuggguguggagcugggaauagauacacacaguucagcuguugcuggugugaacacaccacuguacaguaauguguaugugugugagagagagauuguacggugggugggaguguguuugugcuauguuuaggaguggggcaggggguguggcuggaggcacugagacccuaacuccuuuccuuuggggggcuaggaugaaggcagggucugugcccagagagccauggugcaggucacccuacaguggacguagagagccuaaggaguccugggccucagggugggguggggagucccucgggcuggucucucccuucuucaggcuucugggcccccaucucuguggggccagggagaagucagagaauaacugcccacucuuggcaggaaauugucauaaaaucuuguuccuucucuuuauguccccuucccccucucuuucucucucugacacacacauacaccccuugcaauagcaguauucucuuuccaaacaggcuaccaacauaaaagacuccucugaagaaaggacuucauuaucaucuccuuuuuucuuuuuuuauagacagggaggcuaagacacaaaacagggaacugacuuggcaaagaucacacacuggacugcguggcccaugugugagccagguccugaccggacuuggcuggauugucccagaaaaugggaaggcucugggaugaagcuguggggacaggugaccacagcuccgcuggcaggaggugugcugagucccagguggagguacccauggacaagggugcuccacuuccauccuagagccaucacuccccaccuggcuccauccaucucugggcuaagccugcacuauccacagagaugauccagucauggagggcccucugaaaaugacaccaagggagggcugugggagcccuggccggggugguuucugaggcccaaggcccauggccuuaggggacuugugaugguccugagaugaugcagaaagaggugcauuucucuugggaaaggguuuaugguuauaauuggcuucuaaacgggagccaugaugcaaaaacuguugggauucacugugauggaugugggcauguauguucccgugugcgucaagaaagaggggcugggggugaugucggggcaguggcagcgugggccccacacucaccaaagucacuggagcacaucugcuccaugaggccgucagcacugugcuccaucucacacugggcgcagaucuuggucacugaagagagaaaguggggugggguugggggacaguuggugaggggauuggaguuccaagagccacuuggggugcaggcuuccucacugaccagccacuuccccuugccaagccucuacuuccuuaucaggagaugggaugauggcaaucauaucacuaccugcucacagagugauugacaaucaccagacaggcugugcagugacaaaacugccaggugggcacagugacugccccaugacccuggcggcugcagccaugaugugcauugucuuuuaaauuuuaucuccucucauccucagccuaugaaauagggauucuuauuccuauuuuauuuuugagauguagucucgcucugucacccaggcuggagugcaguggcucucuaaucucagcuuacugcaaccucugccucccagguuuaagcgauucuucugucucagccucccgaguagcugagauuacaggcgugugccaccacgcucggcuaauuuuuguauuuucaguagagacgggguuucaccauguuggccaggcuggucuagaacuccugaccucaagugauucacccaccuuggccucccaaagugcugggauuacaagugugaaccacugcgcccagcccuuacuccuauuuuggagaaaagggaaccgaggcccagagcgguuacucaagucugacagcagacggggaggaagggggagagggcauggagccagccuggaagagcuauguggaccagcacagaaaaggggaggcugagaccagggagaaauuaggguucaggggacugaggggugggugggaggagggacuuaggaccucauagguuucaugagccugggauggcuuccuauuuuauggauggggaaacugaggcucagugaagucaagcaacuugccuaagggcuucucuucaggggcagagccuaaucugcucuuccuuccgcacugagccuuacccgaaugacucccagccaggggaacuggggaagaggguggagaucuuaggguuccagguacagaaaacggggacgcagaucauaguccagaacauucuuaguccccagucuuucuccacaucccuucccucaccucuccucucuucccaaggucccaacacggaguggggaugaugcuugcuuuggugccucgggauccaggugaaaggcauuguuuaacgaccccaggcauucuugggcugagaggggucauaaggcauuuaucaggacgucccaggauuggggggacggcauugggggauucucagcagcuugguuggauggguacugagaggggugccagggguuuccagggaacgagagccagagggaaggucuggagccgccgggaggcacuaugcugccacucccuggggaggugggaaggcgggaaggcugcgggggauaauuccggggacgcugggcugagcuaggacagcgugugugugugugugugggcggagggggggagcugcaccucuugggggguucgcagagcugugcuaggggagcugcagggccgucggagcgcgcggggacggcggcggcggcgcuaccuggaggcgcgguggcgggcaggugcccgaacugcacggcgaugcagaggucguuguccagggggaacuuguggcagugcagcaucucaggccaggggaagccguaggccuccaugagcggcgcgcagccggcgcgcacggccucgcacagcgagcggcacggguagaugggccggucgagacagacgggcgcaaagagcgagcacaggaagaccugcguauccgaguggcagcgcuuggccagcagcggcagccagcugcucgccugcugcuucacuucggccaggcucucgugcuccagcagguugggcagccgcaugcgcuuguagcccaccguguggcagagcggcaggucggcagggaugucaaggcacugcggcggcuuggaguaggagcggccgugcagcggcucggccugccagccauaguagucguacuccucgcagcgcgccggcgcccagugcagcgcccccagcagcagcgccagcgcggccguccgcacgcccccccccgccgccgccgcccgcauggcugcgcccucuccaggugcgcgccgcgcagccccccgacgcucggugcccggcggcccagguguuccggcgugcgcccccggcccugacucuacccagccgccgccgccgccgccgcggaggucgcccagguggguggcag

SEQ ID NO: 21567 - RNA, 14284 nt, Homo sapiens
uuguuuuuuauuuuauuauuuuauuucucuuuauuauuauuaauauuauuauuauuugcuuuugcuguggucacuaucauuggcaaaguuccuuuuccccuuuccuggacauagggguccugucuuuaaaagauuccacucugaggcugaaggugccaaaagcugcuugagaaguggccuuugaacuccgucugggaagauggugaggagaaggaagcaggagaaaucauucuugguuuaaaaaaauuuaaaaaaacaaaaacaaaagucgcacaaucuaaaggucauuccuuacucgaucagugaucaaacugcccaaaaggaaaacaagaggagaaacaagcccggggcccugggcguuccucccgggugggguaagaagggugggacccccaagcuuucagggaagccgagguuccuuccagccacgggggugugaaggggaaggaguagaggaaaaaaggagaaacagagagagagcucagcgccucgacacagacacuuucccaucuccagggccaccugccguccuggcccaggccagcucccacugucaccucugcguccaggagauucauaauaaaaaaaaaucaaaaacaaagccaaaaccaaaacaaaauccaaaaggaaaagaccuggggcaauggaaugaggaagaggggaggcgaggaagguagaagggcaggucucuggaugcauaacucccgagcccgggggcuggggaggaagauuccccagcgccccgccgccugcguggcguuagcucgucacguaguguuugguggacggcugcccauacacccuguagaaauccugguggccgggcugcugggaggcgucaagccagucucugaccgccaggcugggaagggacugggggacggagggugugggcgggagcgggugugaguacuccugcgagggcacuguccagggaaaguggccggagcggggguagggcugguggccgccaugguuggccacggaagaacaguaacaguuguccacagaacagacgagaaucuugcggccgccauacugggggagcaugggcugcugggcggcggagccauugggauacugcgauggggggaacacggggcuugagugcacugguugggcgccgcccggcagggccaccaagugcugcguggagcugcagggccccaggggcugcccagacuggcccucaccgcuggcugugcccgccgccccguacuggccgcccacagggcccgacgacgucucuaggaaacuggccucugggaaggccguugagugcuugcgcuuuuccgccccagagcugcucacgccgcaaggguacagggggacacucugcaggaagggcaccggcgugcugaaggggccuguggagaguuggggcaaaagucgccaaagcucccaccccaagcaacccaggccuccucucccuggguuggaccuggggaccauugacaccuagaggcccaagaauguuacaucucaggugaugcuugcuccucuaccauuaggagguacagaauaguuauauccccacuuuaagcugaagaaauggaggcuggggaggucauguugcuuacccacugucccacagcuacaaguggcaaagccuggauaugaggacaggucucccagacugggccacacugccucuuggagggaaggcuguggcgcugaaccccuccccaaaggucccugucucccuucggcggaacaccccacccucaccuucuagcauuuuccgcagcugcuucuccuucuuggccacuucguucaggaagagcuuggaguucagguggccgaucuuagugggggaaaggcugcugcucgugcaggucuggguccugggggcaguggacggggcaucugcugugaggaggcaucaccggugagcccgcccuaccuccccgccaugggccuggccccccugcccuccccaggaugugcccccgggagggcuagggcccucagcuuaccuguccaucaggauuuucacagacuugguguucuguuggggagagaaaagagucaagucaguggaaaaggcaguccagggagagcccggggagaggggaagacaaaagcugcccccccugagccucccccaggcuggguggauccucucauucuggacagaaaguggcagggguagggguggccauuugcggaagaagagcuaacauuuacugagcucuugccacgugacccaggcauuguaagugcuuucugugcauccauaacuucauccauacccgaggagaagggcucugcaggcccacacuguuuuagcucaagucuuuggggccagauguguuuuggaauuuggaauuuuuuggauuuuagacggagaauacagugccuguaucauauauuacauuaucauccccagcaagacacaacaaucuaauacagcaacauuucugcagcaaaauguuugaauuuucauacuaagcaagauaaagaccauaaauugccuaacaucaguuuaggucaauuuuugcuguuaaauuagaugccaaaauuuguuuaguuuccagagauguuuauaaauguggaauuguggauaaagaauaguagaccuguaucaucaacaccacuucguaggugagggaacaaggcccgggauguaccuaugacuugcccaaggucacagugcuagaaagagcaggcagguggauuugaacccaugcaugcuggcuccaaagguaagggcaugugagcuacaggugcaggaaacugcagaucucaauuuggaaauggcccucugggugccaccagccugguccugagcccagcccaccuucaugaagcugacauccuccgucuuaucaaagagcagcugcagggagcccagcagcuucuuggccuccugcaugcgcuccccgaggugcagcgccugcgcugcguucucgcugcagaacuuggccugggccuugucuaggaccuccacugucugccgcagguccucguccagcagcuggugcagcuucucguacugcagccgaacuuccuccuucaguugguucacuuucuccugcgaguacagagggcaggagugggcaggcagguaagcacuggaaaccuuugguuucccccccucuuacccuucucacauccuagaacccuaagucaccaggcugccccaggcucccaagggcaaggucugaccugccaguuccccacugguagcacagggcucugggccagcauccccuggcaccagugggcauccacgggcaguugauugaaugacugauggagugguucuggcauagggcuacacaaucaauccuuaguaaggaacucacccaaagcccugcgcucaagccacccccaccccgcagcauggccuugggcuuagcuaccuccaccaggcgcuugucugacucgaguuuguacagcugguccucaauguccugcucucgcuccuccagccgguccugcugcuucaugagcaucuucugcagggacauuugggugggaguaucagagggacuguggcuccaacccugacccaugcuucccucuacacaacacaugcauccuauggauccuuugacccgauggcaccaagccucugcuacccagccccuuuggcccccuccaaucccaggggccuauucccagcucuccccagaauagcuucccaugcauauuuauuuaucuuauuauuuuuuuagauggauucucacucuguugcccaggcuggagugcaguggugcgaucucggcucacuguaaccuccgccuccccgguucaagugauucuccugucuuagccucccgaguagcugggauuacaggcgugcgccacaacgcccagcuaauuuuuuuguaguuuuaguagagacgggguuucaccauguuggccaggcuggucucaaacuacugaccucaaaugaucugcccgccucggccucccaaagugcggggauuaugggcgugagccaccaugcccagcccccaugcauauuuaaacccugagcuuucugagggcagggcuacaccaaccucuguucuaaacacuuuuccuguacagauuuaucuaaucaucccaguaaugucaugagauaaguacuaucauuauucucauuucacagaagaggaaacugaggccuagagagguuaaguaauuuguccacagucacacagcuuguaaauagcagagcuugggcacaaacacaggugaucuggcagcaggguccguucuuacccaggcugugcugccucucccuggggagcauccucuaagagaugaguacccuaagaugcagggggucaaauucccuuccauagccacgugaaccucugucccaguccaaagaucucacuuuacccucgccuuacauuagggggcaucaggccagucacccccucccuuguucuuaagacugagagcuaggacucuggaguccuggcuagcucccucagcccccucagugggacccaggcagaaaggagauuugaggucuccuaagaccugaggccaggcugcuggaaggugcuggaccaaagugcucuucucagcucauaaucuccuguccccacaaccccuuuccugccagucacuccaucucuccugcccuccucucaccagauaugccucuuuagacaggcucucuccccugcucaaaaacucuccgugacuccguccuaucaacuacuuuagcauggcaaugaaggcucuuuuacacccugacucuuccagccagcugggcugguauccuguccccagcccuccacacauggaaacucccuguagcucuagguacauucuucugcagcccacagugccuccucccuccccugucuauucuucaaggcccaacugaaguccccacuccucuaggaaacuuuccaugaccccugcucugagccugugcaggucccucccuguccuggcuacgggguggggcugucccauucugcccucccucucagguugugcuguccaauaugguagccacuagucauauguggcuauuuaaauccaaguuaacaaaaaauaaaaaauaaggucaggugcuguggcucaugccuguaaucccagcacuuugggaggccgaggcaggcggaucaccugaggucgggaguucgagaccagccuaacauggagaaaccccaucucuccuaaaaauacaaaauuagcugggcaagguggugcaugccuguaaucgcaacuacucaggaggcugaggcaggagaaucacuugaacccgggagacgaaggcuguagcgagccaagaucgcgccauugcacuccagccugggcaacaagagcgaaagucugucucaaaaaaaaaaaaaaaaguuaaguaucgguuccucaugcaccaaccucauuucaagugcccaguaccuacguaucacuagucucagauacuaaaguuauaaaauguuaccaucaugcagaaguucuauuagacagcacuauucuggagucuucuaauugccucacaaaccauggucucaucucccuacaagacacagggccucuuaagaauggggauuugcugcugucuuucuccaccuuccuucagaggcaggccacacaaaggccugggcggccugagaugcauaacaaauucacucaauaagcccauggguuccauacacaaacuaaaauuugcaaagcagcucuguguaaccacagacauucacaguaacugucaugcugcaaggagugguucucuuucuuccucugugggggccucaaaguaacccuccaguucaaccccaugacucccaucccagccacucccagcuggcuccccgaagacaagcugccaucaaucccuuccucaccccgccagcccauuuuacguaggggcaaaccaaggcccaccacagacuucagccugacccuauuuuguguuggaggcuacuguggaaaaaaccagaacccugggagcaggaggaagugugggggugaggcuuucaccuuauaagcugggugcagggggcccacacacaacuuaaccuuucagugacccaggacaggaccucuaaaagaaucaggccugggagaccuugcccugcccccagaagcaccaagaggcacaggaaucugcugccagcccaagggucagagcccgacagcacacacagcaugagugggcaggcgcaggggcaccuggcacaaagcugcgcacgcacaugggaauaccuugccaccugagccccgagcccgccucagguaugcuggcgggcacagccagaggugcaaaggcacuugacccaacccccucacagggaaggcuggaccuccuggaggccccagacaauggcaagaggccuggcacgauggcgagguggccaggacacucugggaacaucaggcccacugaccuccccuggaacaauuggcccucaaauucuugccugcugguugccccaagcccacccucaggaggacagggccccccaggugcucuucagaguccaggcugaucccuccauccagugcccaggacaucugaaaggcccugcuggccccacacaucucacaccacaggcuuacugcauggcugcuucuccacgaccaaacccaccaggagcugguucagggaggauucaggugagucccaggggagggguaggaaagaggcagcuccaaggucccagcgcagcuuccuuggggacaggaacugagcuguccacacccaccccgcaggcuggugggugccccuuugccccaucccuugcugaugcccagggagugaccccucagggcacagcagagggagggccuuccuguccaguccuggggggguggggcucagccccuucccucuucuuccgggcuuuccucagccuccccugacagcacuucuacccugggagccggcagggucuucccaagcuucugucugucccaggcaaucugggugggacaccagcccaggccacacagucccuagcaggugggaggguuucauuucccccuccugcugcugaggccacugggcuccugucucugcugcagggguuggagugagagcaggaagaggaaggaggcuggccagggggugccagccagggaggaguccggggggcugcacuggucuggccugcucucccucagggccaacuccugcuacagacagcgccugggagaacagugggagcugcugccgcuucaagccugggaaacuggaaggaagaugggaaauaccugccugccguccccuucacgaccccaccccaguucaccgaaugagcaaaucagguugccaagacacuggaaaaugcuggaaaacagggagcagaggaagcaaggcccagaccccccaccaccagcagccuccuuuccaucccaacccccaccugccuccccagggaauggcuaagagccaaggccccacuucccaccugggaaaaacccauagcugagauccgaccagauuucccagcucaguucagagcaaguacucucugcgcaggcaggugggcuggaggcaccuuacacaugccaccgccccauccccccacagcagugcauggccuggacugcguacacuggagcaugcaggagcagagcagaguggaacguggccugggcuagaagcucuggaggccccaggccaccagggagacugggacuagguggggcccagggaggaccuucacacccccagcccugccugucgggccucaggccuuuggugaucugcccggggccuaugaggacaaaagcaugaagaaucaggagccgccauucccacccuccaccaccugggcccccacuccucagcuuugccgcugcuuccucugacuccccucccggccuggagcagcgaacccugagccccuacauuccugccccaggaaagccucaugucccucuggagacugacuggccaggccagcugccauuuuugaugccagacuagacugggcagacgggugaggcuuggggacucugggcuguauaaaaguuaauaaauaauaauaauaaaacccucaagucaaccuugaagagaaacaaggucaggaggaaacagggccccagggacugggacagaggcagucccuagguuuucagacaagaccauggcuagcuccagaagccccugugguggugggaggggcaagaagagggggcugggcagccucuuccugcuuaggucccugcccggccagcuccaguucuggcuccagcccccuucucagagccaccccauccuaacccuccccuacuccucccccuggucccuguccccaucucucccugggucucugcgcucauagcacucuccccuuuccucagaaaagcuucugccugcccuaaacccccuuuccaugccucaagccacugccuugggcuaucaugugaacugaaccccaggcuggggaaaccacaagcugcagagggaaggggcuccagggcaggcgccagggcaaggagagaggcagcaccucagaugcgagcccggcagaccccagagagggcuucccagcugcagaguggaauuagcuuuugccaugcagagagcagcgcucuggggcagcagaacaaagaggcgagagagaaagccccccuuugucuggcuuugaaugccaggccagccgggaaaggaaggcuuucccagagccagggaggaggccagccaggccagccugcucggcccggggcaggggcccaagccgggcuugcuccgccucgccagacugcacccaacacaacagcgcaggacccuuucagcuccugccuccaauacccgccacaggcucaccccaaggggaagcccaucuuucccuccuuuccccaacaaccccaccacagggggaagucccaggaccccugacaaacucacagccaccaagcaaggaucaccugagcgggcacucacacagcagcacaguagugcugccaacugucaggaaggcacacucaacuucaacucgcaggcgcucagcaagcccggcaggcagacacggcugcgcaacuagggacugaagucaggcaggcugcgccuucucagagacacccaugugagaugcaaaaagaucagucacauccaagauacacgacccagacgugcuggcuacacaugcacgcacacacacacacacacacaccugcagacagacacagaugugcagccacccagggccgcagaaggcagaguaauaauagugugugcaugacaggugccuggccaugucagcaggauccugggguaggggugggcagcugggccucugccugaggcucccuuucacgggcaacggagaaagccaagccagggccuccuuccacgaagacucggggguggccaaagaaggggccacaugaccgucacaccacaaacacacgugcgugcacacaaacacacacaccccugcaggaguauggucugcuguagggagagggagcagugagguuugcacugcuggagucaggcugcagccccagccucagcaccagccccaguagagccagcccucacucucacugcguacucagagacagauaaauggagaggaaacccaggauucccuccagggucucagggugaccccuccagccaccggcaaugugcacaggauacccucacuccaagcaggggcaaaccccacacuggcccaagcagugggaucuccucccccagagaaccucuucuugacucugaaccucugaaaaugcaaggaacagggcccuagcaacaugucuggccuugcucugggacaccagggacgaugcagaaacacaaccguaacugcacaagacucaagcagauacaccugcauagacacauacgcaccacauaccugcaggccccucacacaugcaaccgggccugcucuugggucuucuuuccaugucauggggggucaugagauaaggaugccccccagcucccaccaguccuucaaugcuuagaugaaccccugaaccugggggcuaggaggggucugaccacucaggacugccaggccugagcccaccuggauguccaaaucuugggcccuuagcuuccccacagccucaugggagagcacauuuaggaucuaggcacauccuagacaauggucucgggaucauccagugaguauccaggccucggcaauguggccgacacacuggcuucccaagggaagauuagggcaacaaccugcuugggccugauucugagagucccccuuguaguuccccaggauggauggaggaccuguuugcucuccugcugggucccugcucuaggcuauggcccaugugcaccuguggaugcuguaaguauaugagggugaggccaccagggagggguuaaucagaguuuccuauuucuagccaguugacaggcaugucagcaaucccccugggagggcagaagaggacgcacaagaagcagagccuagauuuuaaggcaggugccaggucucugugcuucugccccuguauccuggggaauucuguggcccucgcccacaacaccagcaaaggcccuuuaaggcagacucccuccgggaagagaaaaggggccaaggaagagcgcuccacccacucccccuguuuggccuacagagagugcagaggguucuuccauuuagguuccuaugguucacccccuccucucccuccugggagggcaggcagggccccuauuccuccacauucaauaagucaaacucauacuugagugacacugggcuacugaaggguuuccaaccccaguggccuggggcaccagaaagaaucaggggccuggggagggggaaccuggagaaggaugaggcucaggcugccacugcagggcacagcugcugaacgcacagaauugcacaucuggcccugaugcaacccacuacuucugagccugcccacaccaggcacaagaaagcacgcgcaugcacgcgcacgcacacacacgcacacacgcacacacacacccugcggaguugccgacaaaguucagugccugcuuccauccaauccacgagucuggaaaugaggggccugcuggggggcaccccagggaauacucugcaugcacaugccacccacccaccccugccugugcccugaacuguagagacaggagacaggugcauuggagggcgaagcacacagucucaaagacauucaaaaacacagacaccuaaagcuauccuccuacaccaagucagguauaaugacguuuucucccccaccccaauuaaagacaucccuagaacucagaccagcuacagcagcacugugggugcgggcaggcauccgcccaucgcccagguugcugccccuccccuguuccuuucagccacaucuccuuuccccuccucucauuuuccacugccaaucccaggacagaacuggacagcccuccuuucuccugccucugcacuuuucccggccuccucccccagcccuuccaucuuuauuaauagcagcagcuucccaauacuggggaaagugugggcugugccugcccugaacggggauggaggacacaggggguggaggacacacuuccuuuaagaaaccagaggccuauccuggcacacaaacccagggcuaguccauccgauuggaaacuaauuauacagcaaaucguauuugcugcccccgccccagccugugguggcccuccugccuuuuguugguuguauguguauguuuuuuaauugcuaaacagugacucauucugacugguccccccacacaggaaacagccccaucuccaaucaugcccugaacagagcuuccucauagccagccuccgcacuggccuccacuaaccuccagggauccccacccagagacacucccagucccaccagagugcagccuagcccccagauaucacacccaggccccaggccccaagguggggcuucagagaggacuccucggugucaggccaaccccuucauuuugguaugacucaacccugaaagccagaggacuggggagggaccuaggaggagcccccuccacugaaggggacggaaguauugccucaguccagcuccaaaaccaggcccagaggccugaggggggaggcgguuugacauuggccgcggccgcaggguguauacaaugggaggggacgcgguuccguaaucacccagccggcagcccaggggagccagcugccugaaaccagauuucaaggcggcucaaccuuaaacccacaggauucuuuuuccgucuuccacuuccccuccccaaaugugggagggcggcgagagggcugugcuaggcgaaagggccaggaugaugaagacagauacuugaaggcuuguucaugcggcccgugcgacacacaggcacacagggcagcgauucucacacagggagagccggcucucgggaggaauccaaauagcggagccgcugucggggccucgcuggcugcccaggcccuguccagagagacggccggaguucugcucucccucuggaaacuccccccacuccccccccaguguguuuccaauagcgcugaaaacuaacauggcugcuuuuguuuacuuccucauugguaugccagcaucauggaucaugucagccacagcagcggcaccgggacacucauuacauaaacagcagcuggagaggcaggaccggggucacugccucggugacuucccguagggccuacagcaacaagacugggggagggagcugcgcaccacagaaaagcaacacccagacucuaccccugacggucccacaccccaaucccauaaagcacucagaagacggacccugugcgcacaggugcgagaauguaccaaguagcgacccggggcccuucuucccaggacccuguccccaaacuuucagagaagaguuuggccaggggccacuggccugaugucacaagagucagccugucgggauggguggucccggggcgggagagaggaagggacugugugucugugugugugugugugcgcgcgcgcgcguaggguacuugcccggauuucauuccuucggaucuccacgucgcacaccgagugucccugaugcgcgccgcuguaguagcagcaguacuggcacacggccaccugcucggccucgcagugguagaggcgguaggcguugugcugcgggcagcuccaggcccgcacgucguccgccuccaccaggaggugcccgcgggcgguggagggcugcugcaggugcgucugcacgugggacuggcagcagggcgccucgcagcgcaggcagaccuucugcgcgggcagcggggggccgcggcggcagaacacgcagugcagcgccgccggcggcuucuccacgugcagggcauugaacuucuccacgauguuggugagcuucagguucuucuccaggcccggcuucugguuguaggccugguugcacucugggcagcguacgaggccgcuguccuuggcccacgccucgccgaugcagccccggcagaaguuguguuugcacggcagcugcacuggcuccacgaaaacgugcaggcagauagggcagaugagcuccuccucgaagcaguucuuccaauucuccgccauggcggccgcgggcagggggccggggcaggccuccccgacuccccagccccggggguccguccggagccgcuguaggcccaccgagccccgagcuccggccccagccggccccgacggucgcucagucagcagcgccuuccgcgugcccgccccccggaggagggagccgcgguccucacgccgcgcgcgcagcgggcugcgucuccuccuccucccgagcgccuagcgggaggcggcggacugcgccagggccgcggccgggacuccagccuuggaggggagcgccgggguccaaauuccauauaagaggccgccuccccgucggcgcggcuagggcaguggcggcccgcggccugcgcucguccccgcggcugacauuggggcgcgccccgcggcagacggagcuugggagcagcacacuucuuccggcggcggcggcagcggcggcuccugccuggcucgucggcgccgcaccucccucgcaggggccggagcccggggucugcggggccaggaggcgagggcggccgcgccgagggcugcuagauccggacggggcgggaggggcaggccggcgguccccgggccacggugcaggcgucccccggcuggcuggccgggcgcgggcugcggggcgcgggcgggccgacuccggggcgcugcgugcgcgcaggggcagucauucagaugaaauuccaguccccggccagagacaccagcccgccucugccuuccuccucccuucacaaauagaaacggaagggggagggagagaaguggaaaaaaag

SEQ ID NO: 21568 - RNA, 72340 nt, Homo sapiens
ggaguuuuccagcccggccuucgcccgcccgcuagcacgcagucccuuggucucuucggucuccugccgcccccgggaagcgcgcugcgcugccgaggcgagcuaagcgcccgcucgccauggggagccccgcacaucggcccgcgcugcugcugcugcugccgccucugcugcugcugcugcugcugcgcgucccgcccagccgcagcuucccagguaggaucggaggcguggcugccuccucagcugggcaccaaagacccccggagucgccguugggacccuucgcucgggauagagggaggugccgggggcgcccuuuguuugcgcagaacuccucuuucgcagcccgaggguggggaugaugcggaucggggcuggugucugggcacgcgccgggaagaacugaccaucccaucuccaggcgcggggcgcccucgcggcgacgggagcccuagcaccuucugcguccgggcuuccagaguuccaaucaaacccuuuucgguguaggaggcuccacagagaaaguuuggccgcagacuaguuugcuacuuucucacccccagaauuuugccucucacaugguugcccacuggaggcuggcagcuuguccuggaaggagccucuaugcccucccacuacacgucccaggcuacccccuuggggccgcaggacacgagccacgguaaagcgacuuuuguggaaggcacgggcggggccuccccugaaucucuuaacccccccugcuggggauuccgagaaagucugcgccucugaggaagaauugccagcugagaguggugacauguggcaugcacuugauuagccccagggaaagagggcuacucgcgcaaggaucugcugggcagagggugcggcuuauuccuggagggcguggucuccggcaucuaagggggcccugguguuucuugggggcucucauggugugagcaaaauucucuuuggagaugcacuuuaaaaagcuccagcuaacuuccucacccuggagucuuagguuagcgaagagcuucaggggaguagggcaaugugccaugcacuccuguugccucggaauggagaggaaauccauggaugcguuuuaauuuaguguuaaugggaaagugggugacgucggcuauagggcgugcaaauauuuggcucugcguucaacaccgugggcagcuuaaaucuaggguaugagaaaugaaccuacugaguucugguagaaggauagaggaugcccaucuuucuagcagugugcuugggagauguagggauggcugcgggaaauucucugcacgcaccuaaauaaaugaaugaauagaacaaauuuguaaauuaauaaacaggaacauuuguguuuugagcugacucuuaaguuuuaagcugcuuuguaggaacugauucaggguaaaguggaaaggaaauuuuauccuuacugccaggcaacuguuauucccaugguguguuaauaccuccucucccacccccuuuagcaggaaucagguuaaaaugaaccuguaggggaagaggaagucauuaagcgucccagaagcagcuuucugggagcgggcaaauaaggugagaagcuagagguagcuuuuccgcacugaguugggaggugccugugagcugccugggaaccucaacuuuuaguugagccuuucucaagcuggggaccccuucuccuuuuccauccgaccucccuccguucuccuccccugcccuccccucuccuuucucucaucuuccaccuuuauauaguacagcuugcuaccagggcccagccacagaaucaugaguucgccaguuugggcauucacuaccaccugucuuuugggaccuaucccuggcuuuccuggcucccucugccagccugcaagcugcucccaacuuuuagccaccauguuccugcuugccaccaccuccacugacuccuaaccugcccuccggcucugcucagaccacaaaugagcugaagcugauuggagcugcuugauaaacacuccucuugagccuccuuuuggcauggcucaauggggucucuugggaagugugcuccgcugagguugugagauccagaggaggggauuucaguccaagccagaggcuuuggaaggcuggggaggggaaaaucucuaggcccuugggucugaaagcaaaucacauaggcugaguucacucuaagugcugggugacaaauuuuaaagaucauuucagagacacucucuuagcaaguggacaucauaucuucaguaagagagaaagugaaggacuugaaucuggaacuucugaaagaagauggagaucuagggcuccaucagcaagucgauuauguaacuaucugcacgugaauagcacaucugucagagugagaguaaaucauucucauucccacuccuagaaggucucuggaguucuuccaucuuagaauuuaaugcagcuuuucuggcucucugaucuauuuuuugcagccuagcaaagaugcagugucuauaaaaaccuacaugaaguguauggaaaauuuguagaaaaguuguuuguguuugacuguguuuguaugcuuauaacagaugagaauuuagauucuguucuuaaaauaauucuuagagcuguauuugcaugugagauaguggugguucacucugccuccuucugcaaacaaggcugaagauggagaaugaguaccauggccucuaagaaaggcuucgugaaucuuacaucuggagaaaacugguaaaguagcgugguuuuacuagucaggaaaaccaagugagguuugcuaaaagccaaaccagacuacaucagcugaagcagucuuuugaaauaccacauuuggagauaaguacuaggaauggagcaccuagcucagguuauauaauuaaggugucaccgggaacaggcuaggaauuccuauuuagauuuaaaacauguaaucagcugacaaaaguacucugcaaugaaaaggaaauaugcuggggagagcaggucauuuuccucuggcauuuucuucauugauaacacuuucaguacaguacaauguuguuuguuaguuacuacucauuucgcagauuugggagcugaaugagacaccagaaaccauuguuaaagcagcgucuucacaucuucccaccucaucaguccucguaccauaaccaaagugcugcuuuucucuuuuagauuauugcuauaacauucucacuuuuggucucucuaauucuagcucauuuuacuuucucacuuuagauaauggucuuuuaaguccauugacuuuaguacuguuuuuuaucacaucacucccuuacucaaaaacuuagggcagcaggucccuguucucacucaaguaaaaaguucucaguuguuuuuagggggcuacacaguuugcuucuagccuaauuuuccagucuuuucccccugguuuccuaaaauccuauccuuauagaaccugagucacauuuuccuucuuggcagaugcugcuuucuguaccuggaauccuucccccuugccauuuguccaaauucugcccaucauccagcaacacccccacuuugaugagaccuuuucuugaucgcuccaaugggaagcaacgugccuuccuuuuaacacccauggucucacucaugucucuuauauuuaucacauauaucacauauuugauaaugcuguauauuaucauaauuuaugcacucuucuucuuguagauuuuaagaccuuggaggcaggggccgugcuaugucuuacccuuauuuguauuucccacggugccuagcagagcacuuugugccacauggauauuugugcguaauggauuaacagugccuguaacuccagugaugggccauuggacaggaaaggagcugagggaaacaugugcacagguacacagggcuuugugccaccaugaaucuacauacauagaaacgauggcuuacuggauacagagguuccuuuuaaauauacgaacacucucuguuuaagcaauaaccuucucuguugggggcuguaagaugagagacugacugcaaccgcaagcuggaguuugcauuuauuauuuuuguuggccaccuugaucugugccuuucccaagugguugaaugguuuccuuaguaaacgcaaauaugugugcuacgucaauuccccuuucagagaacacaacugaaauuaguaauugaaagugaagagagaauuugaacagaagaagguuuaguuuugccaggcuauaacauaguaugaaauuuguagcaggcaaguuaugauuaaugcccagguuagagauucgcuuccaaaauagcagcgugaauaauaaccucucccaacuuccaauucauagggaguuucucaaaccagccccucaguucuugacugugugaugucuuaacugcuaacuuuuaugggccauuuguuuuaggaggguggucuuuuaagccugaaucucugggaaauuuggguuuaguucugaaauagaaucaguuucuaccuuuucuaauaaauccugggcucugcccagagacuuauuuuuaaagugaacacugaaugaugaagcauuuaugugcuugggagaccacgaugaagaagguaugcaauuucuucucucucguagcuuucugucuuguggggaaauagagacauaguuauuucagguggucaauguuauaauacaauuggauugacaggcccggggagcacagagaggagcuaugugggaacacuggaauugguuauugaagaaugaugcugagacuugcuggugcggagaugguggcacuaaaggcccaagaaaagugaaaguagaggaugugugggcuucucuaagaauguuuugaaauuggagacaaaaaucugugugaguguccuuuuucuggggagacggcucuaucccgauucaaaaccacuaguuacuagagcaccuucaugaauucuaugagaaaauaugcacuuaaugggcagaaaaaucaacauacagaguaagaugaaauuaccacaguagguaaacuuugauugaaccagugagcagguggccuuuccaguuacagccagcuguauaguuuccaguuauuuucauuuaaaaagcaguaccaagcaaaacagauguaaucguaaauuguaauugccuucaggccugggcugguaacuugcuguaccccccugccccacuuaguacacagugugacuugggggaggaucuuuagucaguauuuguggauuaauugauugaaguaauugugaaucaaaguauuccauuucaaaucuccccuguaggauuuaaccagaauuuccaagaugacacuuuccugagaaaacggauugcaagauagcuaaaugucaaaggaaauuuguccauuuggacaggcaacgaaucagggcauaguuaauugcgaaggcucuuggaugucaaaucaccguaagacauucuaagagacuuagaaacucaagggaguucugggggcaggaugugcagauaaagauuuagaggaaaagcuugugcaagagaaaaguccuugguagcacugcuaagcucccaaguuuuccagaugauaauugguagcaccuggaucuuacgggugucuggcacauucugaccucagaaaccucuggaguacucauucccgagcugaaugauucacucacccguaauccuuagcucacaauggaugcuucuuuaugcauuguucuccagggagaagauaaauggguuuggacauaauggcuuggauuaucccagagguuugggguuguaaauugagcauaaugauuuucaaacuuucuucugaguaauagauccaaacauagaaucuggggacagacuuucugccuuggccuugaaauaucauugcaauauuucuucugucccacucuuacagugaccuguaguguagucacauguacuagcagcucauuuccccugcuaucacuagcuguuugcaauguacauccaguaguacuuaaugagaaucuccucaaugcugauuacaccccaugaucugcuaauggaugacgcucgccugccgcuuauuguguggguggcugagcugaaugacccugccaaucccagugauccaagauuguucgcaaacacgguuaaauuagggccacagggugagaauuaagccaagguuuggcaggcccauuguggaguggugaggaagcgguggagcggcuacauccuccaccuccugagauucugcccacaaaguggcaauuccuuauaggaacucugacagacauguugguacugacucaguguuagucagaucaaggcuccaauuccuuucaauccccaacacugaaauuuuguuuccacuuagauuuuaauucagcuuuccaaggaguagggucauuguguugcaccauuaccuauucacggagcugaugcccccagccacgugaguagguugugggaucuuguucauuuuuguauucucauggucuagcagggagccugacuucugggaggcucucaguggaucuguggagugacaugugcuggggggcaugccucuggccaguucugagccucugggugggugucuuggucuuuaucuagauuucugcaggaguuucucuguuccacacccaggcucccuugcauggguugccuaauucauggaaccacggaaccucagacugggaggaugccugagaugguaacuugcccugcauuuuagggaggagccucugaggcuuagcaaguugaagggauuugucuggggucacacagagaguuaaaugcagaguugggaguagaccucagucuaguggcuauagaauuccuuucacuucauaggcaugcauugaauucaauuuuugagugaucccuacaugucaggcauccuguggggaaccagagauaggcaggcaagaaugaauggcacugagcauuugauaugguuuggaucuguguccccacccaaaucucauguugaaauguaaucuucagugcuggaggugggccuggcuggaggugauuggaucauggggggcggauuucucaugaaugguuuagcaccauccccuuugguguuauuuuugcaauaguaaguuaccauaauaccugguuguuuucaaaguguguagcaccuccuuccucucucucgcuccugcucuggccauguaagacaugccugcuucuccuucgccuucugccuugauugcaaguuuccugaggccuccucagagguagaagcuacuauacuuccuguacaaccugcagaaccgugauccaguuaaaccucuuuucuuuauaaauuacccagucucaaguauuucuucauagcagugcaaaaauggacgaauacagcauuguucacugagccccuguccaggguguaucucagggcuauucuuuauauugacacuuggcuguacucucagcaucucauaucuagagcuguuuggauguuuuucaagaguucugagaaguugcugccucagugucaguccuugcccucuuuugagguugucagagucccaaaugcuuccucucuauaccauuugcuuugagcuccccaacugauuugugauuaaauucauaacaguuuuauugagauacaauucauguaccauaccucauucauuuaaacuguacaauucaauggucuuagaauauucacagaguugugcauucaucaccacaaccaauuuuagaauguuuucauugccccccaaauaaacuccaaaccuuagccaucauuucuuaaucccccaucccuaggcaaccacuaaucuauuuucugccucuauagauuugccuacaauugaccuuccauaaaaauggaauuacacaguauuuaucauuuuguguuuggcuucuuucacuuaguauagugcuuucaagguucaacuguggcaggauacuagccagagucagccaauggugccuggccaccucucaaugcuggcugcagggccaccacuggugcauaaagcaccuuugggugaauuagaaaaagaggcccccaucuggccacauguagaucuguggacacagggcuuggucaggagacagacuuugggcaagaaaaggauagaggcaggcccaagacucaaggacuugaggccuugaguccaaggauucaagacuuggagaguggaggacaggcuugauuugagaccccacuugcucuuuuugagggugugacggugggugcuguagugcagggaacucccugaacuauaucuauguaguccuggaugucaguagcuuaacuccaaguggacaagcuauggaccccauauucuuuuagagcuugugacucuguaaaauaacaaaacagaaagcugugcuugcaugccagcagcaucuguggugaacucuugggucaccugggagcacguuaaaauugcagaagcucaggcccaaacccaagaccuacugaaucagcaucuucauuuuaacaagauccuuccaaugauucuucuacaugaugaaauuuaggaaguacuggucugaugaaugaguucagcccuuggccaagacagaguggcuugccuguuuauaacugacacacaaugguucacuuccccuccucucccuuuuccuguuggcuuugccuucaucacugaauccucugaccuuccuuuccuaaguccccagcauuccugagauaagcauguacagccuguagguuagguuuuuccucccuucucuaacucaaaaacaaaugcaaccucccuuggcuucaucuccuuuuaagccuuucugccaggaauacagccccugccuggcuuagccuugagcagcagcaaagcacaucuucaggcugauugguaacaggggccuugcauggcuuuuuccugcagcuaagauguauuaauaccugaugaauaacuuuagcugucaagaaaaccaggcuagugugaucagggccgcuccugccacuccggcaagacuccuggggcugagaauuccuggaacugaucagcucuuaaagacacagggacuucuuaucuucauaccagaaaucaaugacacugggguuagcggggaggcagcaccuugggagaugagugagagugagaccaguggguuagucaggaaaacacacagccccucacauuaagccccucaagcuccaugaauuggggaugucaggaagacugaacuguuaacagcacuuaaagagggucucucaccuuuucagggaguuggguaaguaguaguuuccaacccagcaaugguauuuuuuuucucuguucuuuuccucuuuuuuuuuugaccgagucuugcucugucacccaggcuggaaugcagugacaugaucucggcucacugcaaccuccaccuccaagguucaagagauucuccugccucagccucccgaguagcugggauuacaggcgcguaccaccacaccuaucuaauuuuuguguuuuuaguauagaugggguuucaccauguuggccaggcuggucucaaacuccugaccucaugaucugcccuccucggccucccaaaguguugggauuacaggcgugagccaccgugucuggccagcaaugguauuuguacaggcugaguaaggaucaccuggggagucugaugaaauaugguuucccuggcuccgccucuguguauuuugauuugguagaucuagguuagggaccaguaaucuagggugaaggucugcaaacaaaguccaggcaggccaaagauggcucacugccaguuuuuauaugauuaguugagcuaagaaugguuuuaacauuuuaaacugauugaaaaaaaaucaaaagaauaauaauguuuugugacaaaugaaaaugauauaaaauucaaauuuugauguuauuggaacacagccauguucauuccuuuggguauuugucuauggcuacuuggugauacgauggcaguugaauaguugugacagaguccauauggccugcaaagcugaaauauuuuccuuuacagaaaauguuugccgaaccccuaauccaaggccuuacucaaagugugguuugauaaccagccucaccugggagcuuuauagaaauguagaaucuugaacaccaucacagauaugaaauaagcaccuaccuuuuaacaagauuccuggguguuuggggcuacuucuuccccaccacgaggcucagcucaggacucaucuuggagguccaggccagcaugcuauaacuagccuuguauacgguuaauuuaucugacacauaacugggugucucauucucaagguuugaggcuugguagccuccugauaucuuagaugcucuaaaaacuagguugcuguuuuauucuugccaauucuuggcuaggauccaguguccuaaucugaggcuggagguggacuggcuuuugcuaccugcugacauauuucuuaaugcuuccuggauuucuagacagcagucuccagaugugcugcccugccaggaucuugguauguaguauggcccauagcucuccaccgucuccuacuuccuuccaugaagcacugcuucccagagacauucagaaaugguauaugggaagcaggaugcacuguaauuuaguugcaaaaggcuggguuaaauagguuucuuuauugcaggacugcucagggucauugauaugccaguauaccuuguuacucucugagagaggacaaggaggaauagugaggaccacagaaucucaaaguggggucuguagaccagcagcaacagcagcagcaucuccugggaaccuaguagauauauacauucucagaccacaccccagagcuacugaaucacaagcuggguaugugggaagugggccuagccaucuguauuuuagcagauccuccaaaugauucuuauguacacucaagugugagaaccacugguguggacguuuccaaaugguuuucuccgaacaucucacuagccuaguguuucacauuuguugauuucagugaacacuguguuuuugguuucaggacaggacauuugggaacaugacauugaauuuuuccugaagcauuuacugguggcagugaccacugcaggcuuggggagguggaaguggggaagaaaaaaaaccccaaccuuuggguagcaucaucugucccacaucugucucucuagcaauugugucuugguuaaaggaaguuuuuuugagacgaaagccaccaacuuuuggguguugccaacauguguucuuuaaaauguguuuuuguguauucaaauguaaagaaagcuggggaacagcccuugggguguuucucucuccucuucacguuacuuccuuucagaauacuuucuucuguaaaauuuccucauccaaauuccaaacucaucuuuucaggccagccaaguccaaauggcuuucauuugagugagugacccuuuucuccaugggaagccucaggacacauucagauaggagggaagcuauggcucucagcaugaggaggcugugucuuccuucucaaagcucagcucacucccucccauuccagaccuucuuccuuugccuuccauggcuaguggugucacagccaugggucugugugugaacacuuuuuaguguuuacucugugaggauauguaacugcuguguugucacuuaguuugaaauucucagugauagugaggcuugagggugaguugggaggaagcacuaaguuauucuacuuccuccaugggcuggccgcugaggagaggaaugaggguugagaaagccaugcagaccuugauuuucagugaaaauagaugagacaacugacaacuuccauuucuauguuuuuggugggcagaaaauagauauuaucguuuacuuuucuuggcuugguggucugaaugcuacacauaucuauaaaauggcccaucugauauugcagaugagcugaaaguauccucugaugaauguacuuuaacaaggcuuucaaaaauuguaggcugaccacuuuuuuuccaaaauuuuuugcaaaaaaaaaauauauauauauauaggcugagcacaguggcucacaccuguaaucccagcacuuugagaggccuaggcgagagaaucucuugagcccaggaguuugagaccagccugggcaacaucuugggacccuaucucuaaaaaaaaaaaaaaaaaaaaagaaauuagucaggugugcuggcacucaccuguagucccggcuacucaggggcugaggugggaggaucgcuugaacccagguggucaaggcugcagugagccaugaucaugcacugcacugcagacugggugauagagugagucccuuucuuuaaaauaaaauuauaaaaguaaaacaugcucauuaugaaaauauucaaauagaggcauaaaaaguugaaagcaggcccacccuucauuuuccucuugauuccauucucuuuuucugaaauugccacucaguaguuugauauaaacuucuggacacuuuucugugcuuacgauucuuaaacaaaaaagguaaaaaaggaauguauugcuacauguaacaacagggaugaaucucauacauaauguucagugaaauaaaccagacacaaaagaguacauauggcaauuccauuucuacaaaguucaacaacaaugugcaaaacuaguccaugguguuacaagucagaauagcaguugucuuuaugggguagccacugggaggggccacaagggggucuucaagggugccagcaguauucuguaucuugaucuggguugggaggucucauggguaugcacauacauagaauguauugagcuguauacacuuaagauuugugcacuuuacuauauauguuuaccucaauuauaaagaaaaaaauacccacaaauguaugugugggcggggcauaaauggauuuaagaugucuuuguuaaauuuccaugccauugccuaugggaacuuuggaaauauaugguagugauuuggguugucauaaugauagagaaggccaggccuacacaauaaagaauuggcucccuuagaaugcccauagcgcccacauugaaaaacacuguuuuaaaaguuugcagacuguucuauugggcagguguucagaacaugggguaggccuuugaaauagucuugccuggaucuuuacucugucuuuguuuaaauggaguugaagccucaagagcugauguggauggauggguucuugauuuguuuuugccuucugaaccaaauuguaaaggaguggaaucaucuccuuugccagggaacagaggcaauuugauaacccucaaaugugaacuugaugcaagagagagcucuucuccagcucaguguaucccucccaugcucauagcucucugaggccauguggccuccgccagugucuuggucuggagucuucugcugaaagucuuacugcauccuccuuuccuuucuuagauuuucucugugucccauuugaccucuauagaggagaguuaagcauuugaaggaccacaugccacaucacaaauugcuuuuguuccacugucugguuuuacuuuaaaggcuagcccucuuuuugucugucuguguugacuggggacagucaggcuacagagcuuugugaaugccccuuggugagaacaggacuuggcauuuauugagguccccugcuuugggcugaccuccucagauuuagguguuugucuuuuuucuguuucuccucucucccaucucugggcaaugggcagggacacacuuuggcccuucguaguauuaaacaauagaaggagacuaaauuggaaaaauauuauuuuccccuuggaccagaguaaugccuucauuuauaaagcuuuucuuuuaaguuuauuuuuguuggcucuguaaaguaggaccacaauugauauuucacaagccacaugcuguuuuaauugucuuugcuaaugaaagacagagggccuggggauuaugggugccauggacucugccuagggucuuccuuuuggggucugcauagaagaguuugaauaagaggauggaauauugucuaauauugccucugaugaaacagcuguggaagcaaggcugucucugagagcucaugucuggcagggaucauucucucaccagccagccauucuacugccauuuauuucuggaugaaauaaaguuaaaaugaacauuuaaguguagccucaauggggaaagaaguuauguaacgguaguauuuggaugccagagagggaggaagaguccccagcaggauggagccccaauugcccacaacagugacucacagcaguugcccagugagcaguacccuuauugucuuucuucucuucgcugucucucugcucuaguccaucgcuaugcuuccugggauugcuucccaaaugaacuacuuguacuuugucuuagagugugcuuuugggggaacucagacaauggcuaagcuggaacuuaacccaggauuuugguuucugguccagaguucuuuguacugcugaauugacuccugcugaauagaacucucuaggucacugaaugaacuguaaagaaggcuucugugauggacacuuggagguuguuucacuuaucuuuugaugcauaagaaaccacuccaaaacuuagugguuuaaauaagugacaacuauguauuuacucaugaucccgcaguuugggcaggacuuugggggacggcucaucucugguucacaugguguugucuggggugacucaucugggucuagaggauccgggaugguuccacucaugugucugugucugacacuucaucugggaugacugaaaucgcugggauggcuggucccucucucugccucucugcagucugcauaguuuagcucuuuuccaucuccccguguugccuuacucuccagcaggaagcuggcauuacaugcagcuggccucccaguggacaaaagccaaagcuaccaggacacuuaaggcauagauccagaauugucacagcaucacuucuguuacauucuauuagucaaagaaaaucacaaggcaggcccauauuugggaugguggugguaguggauggagucuaccucuuauaugcaugugcagggugggaggaauugucgguggccacugugcaggcaauccacuacagagcugguuugggacggcauauuggagaugggaguuuaauuuuccaggauguuugcugggugccuucugauuagaugcuggaccucagguugcuagccaaguguauuaggcuguuuagcuacagaauguggcauaugcagauucauugaaaguucauagaagugaguaaaucagcaucccugggaauaucaaaggcucauuuuccaaugguuauugauacuaucaaagacaaagacuuuauuaaacaaaaaugaacucaaaauagaucauagaccuaaauauaaagccuauaaauaugaaacuucuugaugacaacaugggagaaaaucuuugugaacuugaguuaggcagagauuucuugaauaugacaccaaaagcauggucuauaaaagguauaauugauaaauuuuacuuuauucaaauuaaaaacuucucuuccaaagaccccacuaagagaguaaaaagaaauauauaaagaacucucuaaacucaauaacaagaaaaaaagccaccuaauuuuuaaagcagacaaaauauuugaacagauacuuaaaccaaagauguucaauauuauuauccaccugcuaacuggauuaaacucaggcaacuucugcuuucgucugccaacugugaacaaagccaccugcucuuuuagggaagugauuuguaauauacagugcaaauguaagguaugguuauaccucccacaaaacaacuugcacacauuucugcuccuuguagagggcugacuagccauuuucucugucucucucacuggacuuuaugugacagacacccgcaaauugcuagccauggccguuaaguaaccacuggccacuggcaauuugaggcagaucauuuacuguaagcucaaguggacgugggugucuccuaccaugcuuuuccaaaccaggcugguuuuuaggccucccuaaaaaaaucucccacugccuacuuguucugcccucaaguguccugauguccuuucauuucaaggaacuugcaucauuugagccuguaacagagggcuuuuagucuucuuugguacuauugauauguaagaaauguacuuugacuuugauguuuuucuuugaauucauuuguaagcaaugguaaaguuugaaauguauuacuucauauuaucauauauuauucuucucaagaccuaauguuaaauucaaugcugagugcuuaauaaggauacugauuacaugagaaguaacagaacaguuuucaucuaguuucuaaauuuaggggaaaaaaaagcuuggaugaacgccaaauaauuucccacuuuugugaaucccaaaggccccucuucaugcauugaacauuccugaaauuucuggaauaaaaaaaauugugagaagaacacacaggguuuuuaaaaacgacuuuuuacuugagguguacuugccauguaauaaacuguacugaauugcuuucauaccauuuucaaaaauuaauuggaaauuuuuguacagaucuguuucuggguucuuuauucugauccauugguuuaugugcuuauuucuucacuaauaccaauacugucuugauuacuguaguuuuguaauaugucuuaaaauuggguagugugauuccucuaacuuuauucuucuuuccaaaauuguuuuggcuauaaauuucauauaaauuuuaggaucaguuuguuuauaucugcaaaaccuugcuaguauucugauggcaauuaugucacaccuacugaucaguuugggggagaauugauauccuuaauauuugaaucuuucaauccaugaauaugguacaucucuccauuuauuuagauauuaguugauuucuuucacaaacauuuuuuaguuuucaguauacagaucccauacauguuuuguuagauuuauaaguauuucauuuuauggggcuacuggaaauguuuuuauuuucuuaacuuuccucucuaauaguuuauugcaaguauauagaaauacaauugauuuuugugguuugacuuuguaucuugugauauugcuaaccucaaguguuauuuugucgauucuuugagauuuucuacauagacaaucaugucaucugugaauagggacagguuuuuccuuucuuccuuccugccuuccuuccuuucuuucuuucuucucuccuuuuguugcgcaggcuggaaugcaguggcacaaucucggcacacugcaaccuccaccucccagguucaagugauucuuccaccucagccuccugaguagcuggaacuacaggugugcaccaccaugccuggcuaauuucuguauuuuuaguagagaugugguuucaccacauuggccaggcuggucuugaacuccucaccucaggugauccacucgccucagccucccaaagugcugggauuacaggcgugagcuaccgggccuggccagagacagguuuauuucuuccuuuccaaucuuuguaucuuuucuuucuuucuugucuuauugcacuggcuaggauuaccuguauagugcugaauaggguagugaaauugaguguuguguuguucccagucuuagggggaaagcaccucagucuuucaucguaaaguauaauguuaauugugggcuuucuguagauccccuucaucagguugaagacauucucuucucuuccuagauugcuguaauuuuuuuuuuuaaaucacgaauggauguuaaauuucguuaaauuccuuuucuguauuaauugauaugaucaucuggauuuucuucuuuaguuuguuaaugucauggguugcauugauuaauugauuuuugaauauuaagcuaggcuuccacugucaggauacguaccauuugguguuaccauauuauucuuuuuauguaguguuguguuuuauuugguaauacuuuguuggggauuuuugcaucuguguucaugacugauauuguccuguaguuuuauuuugaugugaaguccuuaucugguuuuggcaucagaguaaugcuagccuuguaaaaugaguugggacauguguucuccacuucaauuuuguggaagacauucuguagaauucuuuuaaaaauauuugauagaauucaccagugaaaucacugugccuggagauuuauuuuuaggaagauuaucuauucaucuugagugaguuuugauaguucgugcuuuuugaagaauugguucauuucaucuaagcugucaaaguuauguguagaguuauacacaguaucugcugugauacccucuguuucauuccuaauauugguaauuuguuucuuuucuuuguuuuucuuugucagucuugcuugaguuuugucaaugauaugaauauuuucaaaaaacagcuuuugguuugauuguuuccauuguguuguuucauuaauuucuacuuuugccuuuauuauuuuuauuauguccugcugcaugcuuuggguuuguuuuguucuguaguuucuuaaaguggaagcuuaagguauuguuuugaggccuuuuccuuuuucuaauauaaacaucugaugcuguaaauuccccucugagaacuguuuuaucccacucacuguacucucucuccucuccuuuuugaacucuauugacugaaauguuaaacauauggauauugucccacagcucccugaaaaaaccaagauuaaaaagaagauugaaaaaaaaaguuuauugagcaaggggaagaccaagaaagacaaaaagucacaaggagucuuccuacccucuuaagaccacaucuucucuacagagaaaaaaaucuccauucccagaguuuuagguaucuagaguuugcuauacaauugcuguagucgccacugcugucacuccugcccacugucaccacaggguuauaugggggcugggucaugaaauaauggagaaaaugaacauaaaagaaaaccagggaauuuucuucauucucucugaagcauuacaguucuucuuuuccacucuuagagucagagauagagggcuucuccuggaacucucucuguacccagugucuacuucuguguuugggcugauuuuagucuaguccugggauaccagagcaacaccaauucaguguuaccccaaauucuuuuuuuuuuuuuuuuuugagacggagucucgcucugucacccaggcuggagugcaguggcgugaucucagcucacugcaagcuccgccuccuggguucacaccauucuccugccucagccucccgaguagcugggacuauaggcacccaccaccgcaccucgcuaauuuuuuguauuuuuaguagagacgggguuucaccguggucucgaucuccugaccucgugaucugcccaccucggccucccaaaguguugggauuacaggcgugagccaccaugcccggccccaaauucuuagucugccugcuaauguuuacuuuuucagaaucaccaaagagcuguucagaugcacuuuguucagguuuuucagcugcauucaguaggaaagacagggugaaguacgauuacugcaucuuacccagaauuggaauauugugaccuuuuuuuuuuuaacauuacauuauccuuuucaugguagucaggugguuuucuuccucccuuccuucuuucuuucucccuuuguuucuucuuuucuuuauuuucuacuuuuucuucacuaugaugccuaguauauuguuagaccuggauaaauaacuuuugacuguugcagauggugaaaagucuuuugugugagguuuuauaguuauuacaauuuagagaaaggauuggauuguuuaucauuggaaaacacuuuguuuucuaaagauauaucuacuaggaugagagaagaaaaaaucacgaucuaaaaaguggggaguaauagucuuauagagucacugugaaaguucagaggaaugauauauuuguaccaggaacaaauauguuacauuuguuccuuuaaguaaauucagucccauccaaaaacguauuuauugacauuagcucauuuuugaaagccuuuuuaaaaugagcuaauaucaauaaauauguuaauaaugaaaggaaccuaacaaugcagaaugauuaggcaucaaaugcuguauguuuacugugguuugaauguuuguccccuccaaaagucauguugagauuuaauugcuguaguaacaguauuaacaggggaccuuuaagaggugauugggccauuagggcucugccuucaugaauagauuaaugccauuauagcaggaguggguuguuaguuaucucaagaauggguuccugauaaaagggaggaguuugccuccucuuucccuuucugucucauguacucccuucugcccuucuuucaugagaugaugccgcauuaaggccucaccagauaccagugcccuguucuggggcuccucagccuccagaacugugagcugaauagacuucuccuccuuauuaauuaccuggucugugguauuuuaacaacagacaauggacuaagacaguguccuucuucugcuuuauuagauagcuuauuucaaaagugaacaagcaauccugcuuguagucugagaaauggaaauuguggaguugagggagauucaguaaaagaugaucuuucagaugaggcuauuguuaaacuuuucauuaaauugcuuuuauuuuggcccuaguauugguaucaucaaacauuaaacagucuuaaaaagugaaaugauacccagucaucuauaaaagagugaauugugagaaauuauauggcuuauuucccaguagagacaagugauuucacauucugcagcagacccaugagccacacaagucacaugaaagguggccauagcucagguguuuggcucagcuuucuauucuauccaagcuauuucuaaucacagaugaaccagccacacauucuuauuuugagcagacaucugaaauugacuucagcuuaauugcaauaacacugaggauuggaaaacauuuguguuaacaucuacauucuguucaaaacaucaacaaaagccaaaucccccaaauuaauaggcucuuuugaagacuucucuuuugaauaaacaguguugacauguaauucaucauuaacucauaaaaacacuucaguaauauaaaucaggauugaagucuaaaagccauucugcuuucaauuagagcauccaaaucugguauacgagaccuuuucuccuuuuuuuuuuuuuccagccacucuguuauuuugucaaucuaaucucaucuguauccugcucacgcucuaggaaucaagucuuucccucagaugcaaugccugcauucuaauuuuaaaaguaguuaauagaauauaccaauuccauguuuaaacaggaagaaacuaaggcuccugagaggugauggggcuagccaaagucacauggcuagcuaguagcagagcuagaugaggauucuuagcaccucacuccauuauuuuacccuagucuucuagaaagacccugugcuguucccagagucucaccucugaaauaucacacuuuuuuuauuuuuuuuaauuauuauuauuauuuuuuugagauggagucucgcucugucgcccaggcuggagugcaguggcgcgaucucggcucacugcaagcuccgccucccggguucacgccauucuccugccucagccucccgaguagcuggaacuacaggcgcccgccaccacgccuggcuaauuuuuuguauuuuuaguagagacgggguuucaccguguuagccaggauggucucgaucuccugaccucgugauccacccgccucggccucccaaagugcugggauuacaggcgugagcuacugcgcccagcccacacuaaaguuuuaaauucagucacaaauguuuuucaauaccuuauaaguauaugaaccaaaaccaacuugugaugacauuagguuggugcaaaaguaauugcgguuuuugccaauggcaaugaaaaaaaaccucaauuacuuuugcaccagccuguagacgucaggauaguggcagguuucugaccauguucuguuucuugaucugaguucucuuacauggguguguucaguuuauaacaguucauugaauugugcacuuuuuaaaaaauaaaauauuuauuacgaguggcuuaugguauuaucccugauuguugcucgggccccagaacuuaauauguuaguaauguccuuuauuaugcaacgagucaccuuucucauccagcuuaaaaaauaauuuuccucuuaacauuuuuuuauuuugcucuccaguauacuuuugcuucccagcgccugccuaauguuuguaccaucaguguuguagaauccuacuucaaaagaagcauuugcuacagcccagaaucauagcgguaaucaugcagugaucuuagcccccaccccagggugcuugcuuguuugauagucacugugaguguuccuaauaagccagggcauaucuggauucaucauuuaucauuuucugugcuccaaggcuccaacaauaugugugauaaauagccuguagcuuauuuucuaaaugacagcagugaaaccuccuguuuuucuuucuuugaauugaaucugagacacaugaaauugguauucucugaggcuucucucuucucccuccccacauuucuuuuacagcaggggaaaaggcagaaaccuaaguuugugauugguaguggauugaaagccguagauccuuuucuccucuccagagcuaaggaaaugaucuuuugugagcauucaucacucugccuuuuuauuauuucucucucuuaccuuuagagucuuauuucguccuguccuccaccuuucuguacaccacucccuccccaaagguugcuuuuucauagcguaaaaguugauccugaguaugugugcaagacauuauuugguacuacaauuucacagaaucauauaaucuuaaccuuggaaagggcuguagagccccacccuacuucccucaucucaccccucuugccagcauccuucggccucaugggaacacuuccagcuucaguaagcuuugauggaaucucaagauggucuuggagucuuagaauacccugccucacacugggcuaaaaucagcucuacaugacaucuagccauuguccuuauuucucacuuuugguacugcacaaaguaaguuucucucuauuuuuauccaugggaugaccauugagaaaucagaacacagggauucuauuuccuuuuagucccauuuucuucaggcuacaaaucuaaaguuuauucaccauucaacaaacuuuuuauuuauuuguuuacuuauuuauuugcuaugaaagcuagucucuguuggucauuuuuuguuuuuucuuucuagcaucuucuggcaugucuguguccuucucaaaguguggccccaagugauaaauauuugaggugauagauauguaaauuaccccaauuuaaucauuaugcauuguaugcauauaucaaaauaucacucuguauuccauaaauauguacaauuauaacauguccaaaaaaaagaaaggaaaaaaaaagaauuggcccaaauggucuguuauuccagugugguugcuucagucuaggauaagccagacuucuuugguuuagccucuguccucuugcaggccacuguugcucucucuuuuuuaagaaacuauuucaccugcuggcucacaaugugggcaacuagcuggcugcucuuucccaagccugccagggaagcucucccccuugcuggguguacagcuuaguguagggagagaaauacaagacuucauguuuauaaucucuauuuaauuucuccuuguagguuucaaacuagcuauggccuaugguuucaucaucuguugguuuugcccaucuguagccaacauuguugaugcccugugccaucuccccuccgcccaucucuggauucaucugcagcugagguagacaguucucaaacaugcugacaguuucucaccuuagauguccacaugucuuagaggcuuugccuuuagauuuacuccaguccugugggagcucgcucagcaagaauuucuggaagaguaggagauguaacaccccgccagcucuuagccaaaaaaaaggcaggagucuguggguaaauacccaaccuuucgugucccuggguuguguuuccucagaggcuccucagugggaaugaauccagguugcccccagaaguaaccugcucauuagcauaucuuuaugggcuuuuccccuauuccuuucucauuuccccugcuuucucacugugcuuccugggaucaccuuccaaaugaacaacagcacccaaguccuuguuucagacucugcuuugggagaaagaaaacuaagagcuuguccuccccagcuugguuaucuucuacagauuuguucuucuuaauucuuccuucacugguagaaugacacagagcccuauagcauaucuccugagaggagguuaccuguuaauggguugugaaauucuuguaguggucaugauuagcacuuuuuaaacacucaaauguaauagaauagcaaauaugagagggcaucauacuuaaauauuguuccaugaaacuuauuuuucgaucauauaaauguauguguguacugagucacaagaugaaacauuuucuguggauuguauucaaaaaagugaaaaguaauugcuuucugugaauacaauucauaaaucaguauuucucugaauggaccuuuauguaaacuagauuuacuagaggaggcauucucuuggguaaaccaaagaaaugagguuacuuuggccugauuugcuauuuuugaaccaacgcugauuccaaauugucacuauucuaaaaauuucuuccuauuuuuuuuguuaauaaucuguucuaaaauaacgcuuaggauaaaauugaaacuuuucaugucuaugguuuccauacuccauauuuuuacugauuugaaaauugucuauccacagccuuugacacuucuuugguuucccuuaauuuuucagugauuaugaagaauaauuucacguccauccuuuauauucuuuaaggcccugggauguaguuuccuuggaucuggaaauuugagcucagguaaaauugccagcugggaucucguuacucuugagcccuucuuccuaaucuguggcuuuuccccauauauaauauuaaagcaagaaagauauuuagguggacuuuaaggaagaaauuucaacuuuccuacaaguaaaauguugagaacagcuugggaguaggcugggaaggcugucuccaaacuuuugaguuuucauugggacucucucaguacuugaggcuggcgugugcaucagauugucuuccaagaguauuuccagaucuaagacucucuaauuuuauuggcaaagcauaucuuuuaguuggaggcccaaaugguaauuuuuaagaacuucuuggauaaacauguucuuaucauugcaaacaaaugagaaacaaaccuaacaagcucuuugcaucaaagauauuuuaauugcucugcuugaaaaauuuuaaauuaaacaaugaguagaaaaaaagaauauuuacauaauauggguaugguaaaaaaaaaaaaaaaaaaaccacaaacaccucuacuuaccagccaguuuaauaagaacuuaccaaaaaaagagcaaaaacuuuacccuguaguccuugcuauucuuuccuuuggauucuuuuccuuucgcuaucuccucagagguaaccaauguccuaaauuuuguauuuaucauuccuauuauuuucuuuauagaauauguuuauaucucuaaaaauacauuauuuacagccggguaaaguggcucaugccuguaaccccagcacuuugggaggccgaggcaggcagaucaccugaagucaggaguucaagaacagccuggucaacauggugaaacuccaucucuacuaaaaauacaaaaauuagcugggcgugguggcacgugccuguaauccuagcuacuugggaggcugaggcaggagaauugcuugaaccgaggaaguggauguugcagugagccaagaucgcgccacugcacuccagccugggugacagagcaagacuguaucucaaaaaaaaaaaaaaaaaaaaaaaaaaaccaaaaacaaacaaacaaaaaacauuauuuacauuugcaugcuuuugacuuguguauaaauggacacaugcugaauauagucuucuauaacuugcuugcuuuucuucacuuaacauuagauucuuaagaguugcucauguuguuacaugcaguugugauuuuuucauucacguuaucuuguaagaucccauuguguaaauaugccaucauuuauccaugcuacucuugaugugcauuuuggguuguugcuaguuuuauguucuuguaaacagugcuauugggaagauucuugucuaucucccuugaacaaugugcaggaauuucucuagacuaaguaccuaggaguugaauugcuggauaauaugcauacauaucuuugacuuuguucaauaaugccaaauuauuuacuaaggaaguuauaccaaucuaaacuucuagcaccaauguguauuuccauugcucaacauccuuguuaacacuugaucuuguuauauuuuuagaguucuuccaaacuaaugggucagaaaugguaugacugugguuuuaauuauuguuagugguauuuuaguaauaauauaauaguaauaauaauaugguuauuaauucucaggggaaggauuuuccuucuuucacucacugcugggguacaagaugagaacuuuucuuuguagucccuauacaugggauggauuuauuucacucuuuacacugagaguauaggcuguugguauaucagcuuuauguaggaggugagggugaggggauguaggcagucuccucuaaaacugaugaccuugaauagucucuggaguuugucuucuguauccaaggucucaccaguccauggaaauuaaagcucaguuuuggcaguuauccucagaauaaaaggugagccuuaauaucugguaccuaaucaggauccugcuuucacaguauuucuuacuuucuugcaagcuaaaaguggauuuuuuucauugauuuucauguaagcacagccaggcuacauggcucaccauacugccugaaauaggauccuaauugcuugacuuugaaauugauuccauuuucaaccuuuaguuacuuucaaauguauuucaugauauugugccagagcaaucuguaauuugauguuugaaggacauauguaccuccucaaauuauccucuucagauuuacaaacuagaaaauucucaguggagauggcugaccuaccacuuguucaagauuuuacaaugagacaaaaaguugccauuugcaagcauuugaggaaaauuuuuggguguucaucaagggaggagagaaaaagacugccuaggguguuucccauuugcugccugcuuuaauuuuucauuuauaauuccuugcucagaauuucauugaagaggggaauuucuaggaagcauuggcauucaugcucuaaaaaugcccugucuuaacuucccuaaugcagccuuaacaaugaugaagaucccauacccaguuugauugugcuguguaaaauuugaaugugacuugacuacuacacauagaagaacauuaaaagacccauacuaacaaaacaauuacugacagguuuuguuagggcugcaaaauaguguguuugcauuucccccccuccccaccuuucuuuuuuggauagguuucaugugaauucaugugaguaccuugauugaauuaaauaauucauguaaaucacccaaggcagugccugagguagugucuguuaacuaaauaguagguauuucuucucucuuacaagcuaggacuguaaggacuguguuaggacucacuggugucuaccuuggccaguaagaccagauaagauggugcuguacaaagcugcuccugcaugguaaaaggcuggagaaauaguugcuacuucauuuaauuuaccuuuuauuuccuucuuacccuggacuuucaucugcacaccaggaugcuggaaaauugcucagaaagacucaauuuuuggcaaaguucccuuuagggcacauacugccuuuuucacuggcccaugguuucugagaacugcccucaucgcugcaaaugaggacuucaccagccccuccagucccuucccugcagacagccugccuugguccuaggggaaggacaaagggagccugucacugcaggcccuucuccagcaagggacugggaaggggccaacaugccugcaggcuccuguauugacaaguugcagcauccuuaagagcagccaagaaauaaaaugguaauuuguguuugcaucuggaauuucugagcuucaaaaucuuggaucacagcacucucaauaacagaaaacaggacacacauauaaauauccauauccauauuagccucuuuguuaaacucugucugggucagcagcucgagacugaaaaguagcaggaugauuguacaggaaguagaaugaaccugaaugcuguguuucagggcaggggacagcgggcaugagagggacgagaauggccuccccauuuaguggacccugagccauccccccagggacaucuagaguuugacuauauuauggcuuaaaacagcucuuauggacucucuaggggaccugaucaccacugauaaugugguuuccaaggaaaagccaauuucaaauuauaagcaacugauuuauaaaugcacuuuggggaugcugccaucuguaggugagaggccacaugacuccccugucaucagugcccugauacuuuggcaggguuacaagccacgcugugccucuuuguggggcucucuuuagcugggcagugggcuaaaugugguauucguuggauagcaccagaagccuauccaugcaacauauuaucuccacuugccuguucugcugccugagguuuccccaugaggaucaggaaguuuccacaaugagaagaaagccauuuggggaacccuguaaaaaacuaguguguuaaggcauuauguaaauaugagaguggauaaaugacuuagcugauauguacagcaaagacuauucugauuaucaacuugggaguucuagauaagguguguaauacaauuguuuucaaacucuuuugauugcuaccugcaguaagaaauauguuuuauaucacaauccaaaacacacacauaccaugcacacaguaugccaucaacuccaaaacucugucagucgucagucaccauuauuuuagguaucacuaaaaaagaaaaaugauaccaauuaaacuaugccauuccauugauuauagagcucaucuuggguucagggaaauuaaaauguuaaaaaguguuguuuuagagucaauaaaauaugguauaugugugugugugugugugugugugucuguguauaauugaaacaaaagugucaugaaacaaugcucacuuuuacuauguaugguauauuauaaguaucugcuauuuuccccuauucuaaucuaauguauuuuauugcaaauaaagcuggucccacuaaauuuauggaauggcucacuaauguuuuaauuuaauuuuaaaguguuaagucugagcuauaguauuguuuugaaauagggaauuggaaaugauacacugagauugauuucuuaucucaaaccagaugucaugcuguauguuuuagucaucuauuucauucaaauguaaauugauggucuacuguuuaaguuaggacucuugauggcacaugacagaaaccaguuucgaaaaagcuuugaagaaaggaugggcuuaucaucuuauguuagggcagagguaugcuuguggggccaagcaauacuggaaccaagggcucaaauauugugggaucucucuuucucucuuucucuguuuuguuuuugcuuuucuuugauggcuucauucucucgaauuagcauucuguaugagauuuaaucuuugucguuggcagcuucagggcucacaucuuccucauuuuaccaccagagaaaaauccuuccaagauucucauugguucauguaauugguucauaugauugcuccuguagucaagggauaggauaaacucaccucuacuagaaccacauagguaugaggaauaaugcaguuuuccaaaagaaaggcucuucuuucuuugagaggaacacaauagaugucuaucacaccuaggaagugcuagcaccaggcauugugugcugggguguagccucacacaacagguauugccaaaagccugcagaugaucauuuugaaaacuagaauugccgucagcuuaguugcaccuucacuuucccacuagagcuugagucucccagugaagauaauaauaacugacaacagcuacugugugacuaucaguucaagggcaccgaauggagaaaucggugcuuucaagagagaagcuacccagaaaagaaaugauucuaccucccaacacaggcagagcuggauaaaauagccaucuguaaaaaacuucaaguaaaguccagguuuuuguucuugggugcucguguucuauucccuguuggggaaccggagaauguuuuauaaggaagaagccuuagguuucagcugagcagacugcagccugucacuuucaggcauucucaugauguucauuucaguguuucagugcuguuuucuggaaauaucuuucuucacacucucuucucucugucucucucugccauuuaauguacuauauuaaaauaucaaucuacagcuggcaauuaaaaguuugcugccuacaauucucaguacacacuguggcgauuuuauuuuauuuucuuagacucugucuucucugaauucaguuauucucaguuuugccaagaugugccagaauuuuguaaguuauacugcuggguuacugccaagaacgacguaccagucgcagcuuuauuugggcagcuuuuugugccuuaaauacaguaucuguuucuguaaguacagccuucacugagggagauggaugucucauucugauauugauggaacagcuugagcauaucaguaauguguaggcuaaagucucaaggggaagaaaacuuuugagagccuuuguuaguuucacaggggcaguaaggggaaacaaacccugaccguauucccugaagaguuugaugucuagcugggaagaaaaaacucgaaauggcuucugaaaauccaacgcaacauaaaaucagugcugauuuaaaaaugugaacagagugcaucaaugugaauggaaugguuaggaaagauaaacugggggagcuaggcuuugaaauagcuuuaaacacaagaaaggaacugagaggagggaaagggcuuucagguagguuucugagucaugaagacagaaacaaggagugaaauugcaugagauuuagaaucagaaaaguucaauccuuguucuccuauaacugauaaucacuucauucucugagcugagaauacaaucauaaacaaagugucaaagaguuguugcccuccccagguuuacauucuagucacugaaugauaccugccucauaagguugcacugaggacuuaaagaggcaauggaaaugaaagaccaggcagauuuuuaaaaugaugugccaugguaauuuguuuauugccagguguagaaggaggagggcaauuugauuugcuugacugcuguugucccagcuagagguugaggaugggaguguucuaggguaacauaauuugaaaacagguacuaugcccuucuaaacacuucuggugucccauuuuacagaugagcaaacugaggcucaggaaagaaaaguggcuucccaaaucaggauggcacuggaacuuaaucccagggcuuuuucaguugcauccuaccagagaggauggccaugagcaguugaggaaacucagugucugcuugcuguuucaugggauauaacaucuaugcccugaacaaaucagauaaaaguagacuucuaccaccgaucccccaaaggcuuucucagauuuucagauuccuucauucugagggaggaaaccgaauuaacuuaacaaauguagguuuucaaaguauuuaaaucacuguuuuucuaauacuuuugacaagacccacaggaagaaauauauucuacugugaccuauuguuagagugaauauauuauuuauuguacaaaucaggaagguuuugagugugaaagagaaugcuauuaauaauaauguuagaugguaaccaugugaggugauggauauguuaauuagcuugauuauggugauuauaucacaauggauacguauuucaaaacaucauguuguaaaccuuaaauauauauaauuuugcccauuauaccccaguaaagcugaaaaaguaaugcugggacaacaggcauaaaaugggacugugcuaugcaaacuggggauacccuaccacacauacaccuauauaaaaacaaaaauuguacaaaguaagguuuauucuuuauaugugcagugcacccugacauuuucaauucuauuucacuacaaaaauacuagucaugaccuacuaaauggggucaacaguuugaaacauacuauucuuaguugaugguugguaucgcugaggcacuuaugaugguaguaaagacagggauuugguaagcugaaugucugauauguccuauaaacuuguuucaucugaacauucuguugaaucuucugccacaagaaaagcacugguaauaaacauuuucuucaguucauuccccaugauuagcaaaagguuuagacuaaucuuucuggaucccuuuguuccauuuggaacaagaaucuuccucuguguauuuccccucuuuucuuacucuugcgcuuuuaucuauuagucugccacuuauuuagggauguaaggaauccaaggaagaaugucucauuuacagauccugguucucuguguacuuguucugagccuucaucuugggguugaagcuggugcucugaaaagcuaaaguuucuuuuucgcucuacuccuucaaacauauacaccuuuacacacaacuccuggacaucucuccucuguugaaacuuugccaagauauaacagaauagaucuugccugcuagucaggcauacggaacugacuucugggcuucuucaaaagcccccauaaauuaggacuuuccagaagagaagcuucugcagauuuagcuauggaggagagaaggguuaccacuguaccuguguccacacaagcuauggacaggcccuuuguuagcccauuucugucacuagaaauguuuguacacucaccuguguuaacaagagcuucaagaauacaagagacccggcaauagcaccuuucagcaauaaaauaacuuuuggugaguccccauuuuguaaauguuuuuaagucauaaaggcauauagggaaccacaggguuuuuccuaccucaaaguguaaacuaugguaaugucuugagccuaaaaaucacuuuuuccuaaagcaaauuuuauuaucuggaucaucugaacucauagaguaaacuugacaacaguuuacuuuucugaaaaagauugacuguauggcuuuuccuggugguuauuaagaugaauacauauacauauguuuaugaaagauuuucuaaaucacaaaucauacaggauuguuagaggaauuuuaaaaaacacacagaaaacuuuggaagcacugagauucuugaccauguuucaugcuuaaacuuuaaaaaguauaucaugccagauauaaguuugucauauuuuuacauuuuuucaagaaacucauuuacacagcagcucagggauguggaggccuucaauuuauacucacauaauuaaguagaaaaugugauuaugaacccucaaauuagaaacuuguaaaacuaaaacauauauauuaugccauuuaauuuauggcaacccuguugaggcaugccuaauugggguauuugaggcuuagagagacucaguggcucucuuagcuugguuuccuagaagcaaagcuuaugguuuguugagggaauacucucaggaaaaaaaccuauaauugaggaagggaagcaagaaagagcuaagcaaggauagagucucagguaaauucuagcaccacaggguucuuagaaacauaaauacugcaagguuguccuuccacucaccuuugggggcuagaagucuggcuucauguuccuccauaucaaucaaacauuggcugccuccaggaaacagguggggaggaagaaguggcuccuaucagcugaggacaauucucuggagaagagggcaacugugaguuauuugcagucaaaggcucccagcagcuaggagaugggcacaccagccugaguaaaggggaucugauugaggaauaagcaguaucuaccgcagugaccuaagagaagacuauuaaaccaaggcugagagguacaucagaaucuucugacuuuaaggcaaaugcccuuucuuuuucccuuccuccuuuuguacuuucuacucuuccuacaccuuuuccuccuuuuguuuuaaaaacaaauacuguuuauuauguuagaauuuuuauaagucaggaucugggcaugguuuagcuggcucaaggucucucaugagguugcaagcaaguuauuggcuuggccugcaguuucaucugauggcucgacuuguggguguuauguguguguguagcuggggagaucuucuuauaaccuuacuuauguuauuguuggcaggcuuuuggucccucaacacaugggccacuccacagggcgcccucaugacuuggcagcuaacuugacccggaaugagugauccaagagagagagugugagacaguauucaagauggacaccacagucuuuuuauaacuugacuucaaaagagauauggugucccuucugccaaaauuuauucauuagaagcaaguuaauaaauucauuccacacuuaaagugaggaguuacaaaagguuaugaaugccaggggacagggauaauugggggccaucuuagaagcugcauaucagagucuacccucuggcacccagugauuauuucccaccaacaugcaaaauauacucacuccccccccccuuuuuuuuuuuuuuagaaaaauagcaucuauucacagcuaagcagcucacugagccugcuuucugacaguauaauuguaggggaucaaagaccucuccuuauuccuuaaugucucugccuuccuaagucaagcuagugauauuucagcauauauaacucuuuuaagaauuuugugggucuccugugaaucuucuuagaauucacucuauuagacaaaaguucacccuauuagccaccuuacaaaucucauagauauagacucuucucuguuugauugagaggaacuugagauacccuuaaucucucuaaggggccuuuuguaagacugaagguacuuuaaggcacuaccuugauuuaacaaaggauuuuacagccguaauuuugccuucaucuuuaaaucauguuuuucuggcaaugccuuggauuugaucuuuguucagaagcuauucaaauguccuucauacuguaccacagcugcucuguaauccauuggcagaucauuuguuagcacuaaaucaucuggcucccacaaauaaacacccuauggcuuccaauaguacaaaauacccuuuuguaaacauccaaaucugcaguauugucacaguuuaaauuuauauacggaagcuggacugauuagaauaaaaccauccaaaauuauaagcaugaggacauaauuuaugugucacaagaaauuuaaggcagauuuuucucuuuuuucuccaacauuuuuaccaauuccaaaucauauacuggguauacaagguaaauuagacauaguucccaccccugagcaauuuauagacaugauuuaucuccauagaauacuuuuaaaaaguuaggucuaggccugugcuauccaguaugguagcuauuaaccacauguggcuauuuaaauguaaauuuaaauuaacuaaaauuaaaugaaauaaaaacauucacuucucuuguuuuacuagccacauuuuaaaugcuuaauaaccacauaggacuaguggcugccguauuugacaguacagauaaagaauauuuccaucauugcagaaaguugcauuggacagcacuaaucuagaagaaaccaguaugauaagcauuuauccuuuuuaaaaacauauuugcuucucucuccccaacacuaaaaugaguuaaauaucaaaaagaaggacacuacaugcuucuucaguaaauauucuaacaugcuuaacaauaaagaaugcuguaagaccauggcuuuuaaaauuuauuaaaaucuacugaaagcuaacaucuuuuuccccuagaaaaagcaugcuaguaccaaaaggcauguaucaaaagcauguaccaaaaaacauguucaauuacaagggguucaugggcccuccaaagcccuuucauuaauucuguaguaggccaugauccucagguuaagaaucccuacugcaaaguaaauuuuauuuucccauugacuuucaguauaaaauugauggugcaauuuacuauuaaauaugcuucuuucugacaauauuaaaauuaugucuagaauaaugaugaagggagaaacaaaauguaaagaaugaagaacugucuucaaaaugacuaaaaaauaaacccaacacuuugagcuaaaaauauaauacagagccagcaaaucuaccaauuugggucagguaucauaaucaauaaagaacuauguaguuuuagcaaauuugccaaguuuuccauuagucuuaaaucucuaccacaucccuaccuuacggugagaaaccuuauggcgugauagcaggaacacucuacuagccuucagaaaucuagucuccugauguaauuucaauacauauaauaaguauuauuuaagagugacuuuggugccucgaugaucuuaucuaccuggacauucagaaugaaugggugggguuccauaggccaggaagacccuaauuugaacuuuggaaaaaaaaagaguggcuauuucuuugaaaaucuguugaauuagagaaaguuuuugcaaggagagcaaaauuauaaaugcaguuggcuccagguauggcugagagacagaauccuacauggcucugaguuucugauuucugagccaacguacaauuuguauuuguguggaagaagcacugaagcauucuuuccagagugguaaucugaaccauauguagacugauuaauaguuaugucauaauaaaaccucaauuagcagaauucuagagggauagccuuuuauaaauaaaggaaaguuuacuaagaaaccucccuucucccauccuccccaacuucuuucucuauuuuucuuccuuuugaaaaauuuuaaugguggggaaaaucuuuccccaauguacauaaagcuccucugcugcuuuaguaaguacagucuacugaacauaagugagucugucuucgagcuuauuguaucuuucagggugucuauuuugcagacuagucaucauauuuuuauagaaguuaauauaugagcucaggcugaaaauaaacuggaaauuuucugagaguggcagcuaauacccauuuauuuucuuuucacuuaaaaaacaccuaucaaggcugagggcaguggcucaugccuguaaucccagcacuuugggaggcccaggcgggcagaucacuugaggucacuaguucgagaccagccuggccaacauggugaaacccugucucuaguaaaaauacaaaaauuagcugagcguaguggugcaugcuuguaaucccagcuacucaguaggcugaggcacgagaaucucuuggacccaggagauggaggcugcaguaagccgggaucauaccacuacacucccuccugggcaacagagcgagacccugucucaaaaaaaaaaaaaaaaucuaucaagaauaugcaguaaaguuuucauucauuuguguaucaguuuauaugcauacaguugcauguaacaaacagugcuauucacaguggcuuaaauugaaaggauauuuauuguugaccuaacaagaauuguggagguaagauguauaagguugauguuguagucuggugacaucauccaagguccuggguucuuuuuaucuauccacuuugccauccucaacugaaaaucuuuaguccugugacaucuuaccuugugguugcaaaauggcugcuccagcuucagacguuuauccuuacacaauagccuccaaagcugaaaggcagaaaagagggaaaagucuucuccuugcgcaguuuucucuuuuaucagggagaaaaaucuuucccauaagcucccucccccugccccuaagcagacuucauuuuacuugccauuguccaauauuggguuacaugcuuaucccuggagcaauuccuggcaaaggggaauuaauuuuuugacuuaagagucaucaugguucaucguuuggggagggacacauugcugcugaacacaaccugugaucuuuuaguaagaaggaaggggagaauggcugcuggacaggcaaccagcagcuucugcuacacauggauucuucauuuugcuucugugggacccacucuuggcauauuuguucucacacuacugaagaagccauuugcuguuugccuaucagugaucccaaagccagcuaucucauuucuuugaaauuguaggcgcagaaggcaguaaggccuagugaaaaaagaaugauagauuugaaggccaggcagacaggauucgaaucccugauuuaccauuuacuggcugcauaaccuuggacaaguaaagacguuagagacuugguuucccuaaugauaaaucuaaaauaguaccaaauggccaguguuauuguauagauuuaaugagauagugcauagaaauugccuagcauaguacacauaucauaggcacuuaguguguguuauuuccuuucccaugugaauucaauugcacagaaaucagauugcauuuagcuuagcagauagaccaauucggaaaaagaguaaguuugacuccaguagguuuuuuuuuucuuuuuuccuccuuacucaucuauguucacauaaaaguccccucucuuaucuacaaaagacuuguggguagaaagcagugugcccuguguuaggguaguguccaguuacuaagagaaagcuauaaaaccauauauucauuucuuaauugguuugcuuaaauaucuguuagguuuaauauaggaaacagaauccucucuagguauuuuaugcaaaaaaugauuuaaugcaggaaauaagguacucacaaaauuggaagggcuggagcaauggaagucaagaagucugcauuaaaggucaaauggcaccaugacuucaguccagaugccagaaacuccuccuaucacucaggcuaggaaacuguugcugccgugauuaucaccacugccaacgucacuauccucccuaccacacaaagcugaugaggggacaguggacacaguugacaacacucacaucugcuguagccuauuuucugcaugcacaacuguagaaaagaguuccuucccuuugauuccuuccaaaucacuaaaaguagacccuuucacaaccuagggauaagggaaucuagaaacuguacuuuucaacccaaugccaggcuuucuuccgccuuacccaugugaaagcccuccuuaucuuacuaaucugugauuccccugcugggcuaucugcccaugugcauucucucuuugccccuguuuucccucuaugcccuguuugggcucugacauccugcucuggccuaccaugccucccuguccuuucugguacagaugucugccuugcucuaaaggccuuagaacucaguuguucaagaagagaagauuaggaaaggguaagaggucuccuugcuuuguuaaaaauuaccguacauaucuuuguauuucccaacaauuuaguguuagaaguuuuugaacuuuauaaaaaaggagucguauauauaguauauagucuucugggaccaacuuugcucacaauauuauuuuaguuuuauucauccauauuguuguucucacacaugagcuuugccauauuuuaaaaucuuaaugcauuuuugcauuuuggggguuaugcuucuuucuuuauucauucagcauucuauaauauuuucccauguuaagaaaccucuucaaaaugaacauuauuauguuaugaauggaucauaauaugauugaccauuucuuguaguuggauauuuaaguuaauuccuaucuuagaaugugguagaugaagaagauagaagaaaaaaaggcugagauuuuccauguggcagaguagcuggaagaugguuauuugcugaaaugggaaacacugggggaugcacaaauuuggugauaagaaaaggaaucugguuuugagcagguugagugugaguguggagauauccagacaacaguugaagauucuagcuuggcucuuaggagacaguucaaggcuagaaacaauggauuuaucaucaguacauggggaaugguuugaggcaaguaugggagugagauggcccaggaaaauagucuggagauauguaaaggaccaauacuggacuccugggaaauacuuauguccaaauggcaggcugaucuagaugugcuguccagagagucuguuuagaaaggaggaagaaaaucgggaaacuguugucauuuggaagccacugcagaagagagcuucaugaaaugaauggguagucauucauacuaaaugcuguaaauacuguagacaaguuaaccaggaugacaaccgagggcaaaauauauguauguguguauauguguguuggagggcugggcggggggagaaagcuugcugcucauguaucuggauuuuuuuuuaauuuggaugauugaagguucacaugcagacaugcaguucaacuguuuccuuggguagauuccuagaaguggaaugacuugaucaaaggguuugagcauaggccuuugauucauguuguuagguagguuuccugguuuucauuguuuuuuguuuuguuuuguuuuugagauggguucucacuauguuauccaggcuguuuuuugaacuccugggcucaaguaauucucccacucagccucccuaguuucugagauuacaggcaugagccacugugucugguuccagugcucauuuuuuuauaugcaaugaugaauaguuuguaauuuuguacacaucugggugugcagagacaaggugaggaaaucugcagcaaaggaaaauacagaauugggcuucuguaguugcgggucuuuuccuaaugaacacaguccagcccucaucuccucuccacuuucaguuuccacacucuacaucucucauccagaacacaaguggaacagggaccauuacucauuagcugcauggggauuugaauaaccucacaguggaggauguucuugucuguuaugguggcaaguaacuacaacuaaaugcgugaccaagacagagcuaacucgagucauuaauuagacugugaagucuggagggaaguucucugaauuuaagauuacaguuuugaaguuuggcaucugcuaccacuucaaggauuaaggauuuacugcucacuggaauucaauauuuaauauuuuaaaaaccauucagcuccagcuugcaaaugaguuaaauuaaaauaauacacagacguucucucugaggccgugguuuuuauugguagcaacgcucauuaagaaauuuuacuggcugggcacgguggcucacgccuguaaucccagcacuuugugaggccgaggcgggcagaucaucugaggucgggaguucgcgaccagccugaccaacauggagaaaucccgucucuacuaaaaauacaaaauuagccaggcaugguggcacaugccuguaauuccagcuauucaggaggccgaggcaggagaaucccuugaacccaagaggcggagguugcggugagccaaaaucacaccauugcacuccagccuagcaacagagugagacuccgucucaaaaaaaaaaaaaaaaaaagaaauuuuacuugagccauacguucaugagagguucuaaauaagcacacagauagucuauuucagccuucauuuccuacaaaugcuguauauagaagcaacuuuguguuucuuuugucaagauaagacauuugauuuaccuccuuaucuugcauuuaaauuuauuucacaagauggaccuguuuucagguaccauaaacacccaguucuacuggguuuucuuugacugcuggggaaacuguggacugugucugaugcacacauuuuauugcaucuccccuggcaugagauucauauacauuggcaucuucucagagugaaguugacucucucuguuucccuauuccagaauuucacuuggcauauggugauuccaaaacaguuugaggcucauuuugcuugguuuuuggcaaucucagcucagccgguuucacucugagagaucuccuguuuguuccuucaugaauggccacagaagcuuuugcucuuggcucugcauucuaauagcaccuccugcauggucuguggcaaaggaaugcuuugaaauaugcguccauacuauguggcuuuucuugcugcaguuucuguucuuuuuuauuguaggaucgggagacucaccacuagaagacgaugaagucggguauucacacccuagauauaaaggugaaugcuuugcuuaugugcuaaugaggaccugcuggugccaggagaacuuuccuuuuugccuugugaaacagauuguaauaaagugaccagacaacacauuuaaguucuaauuaucuaucaaggaaaaaaaaauauauauauauacucccuuuuuuaaaaaaggaaauaaagcaaaaugcauuggaaaucucugaaaugcugucuuucagcaucccaauggucauuuuauucucauaaguuucuuuacuguccucacuucugcaaaggcagcuguagcugaugaaagugaaaaucaagccuaauucauacauuacagccagaaucauccagaguaaaccaccuaaggucaaaucuggaccaagugcugauaauguacuaagaugaauggggaaggagaaaacuugauuuucauaagcucauuucaucgugcucuuucugagcccagcauggcuucugaaacgguauguuaaaguauguugcucaaaugaaacuuaaugauaaagaacuccaucucuacauauucccagcaauccacuccccagcacguauaaaaagccuaaacaagaaccuucuguccagacucagguaaguauguccacaaauauuucuacuggugaaacauuucucugaagcuuagggaaaccugggagaaaugaagguaaauuuagagaugcuuucucucugaaucuaguuccucuuacaguggaggaagaauuugaaaaaaaaaaaaaaaugguuaacaaaguuucacugcggcauuuugcccuggaaauuuguccuaauuccugggaugaggacauggcccuuguuuguugugaugugucucagauacaggagaaucaggguaggacuggacaacuuuugacuggagauguccuucaguuguuuucuacacaagugaacaauauuuccaauauaaugacuggugccuggugcuuaugugcaggugugcuucccaucacauaccacauuuuuuugugagaucugaaugcaaauacucauuccuaccuauaguuucuaucuccauagccucaggaauuaaccaaucaagcaaagcacaaauacguuaaucagaugcuugggguaaggaaagguucuaauucgcaaaacuucuuaacuauuuauggguuuagauuuuuuuuucuuugagucccuuguugaaaaaucuuccuaaaacacaugcaugcacagaugacccuucacaucuacagcagggguugccuagugcccucagguccuuguucuucacauccaucuucaccucacagcauugcaaaugugacagguagaccagauggccaaaaugugugcuugcccuagaacuuacccugaauguuuaagaauaaauuuucuuagggcauuguuucuauugucaguuaaauugcuuacugguagcaaucauuucaguauguauaaguauaucaaagcaucauguugugcgcuucauacaauaaaauuuaaguuuuauuuauuuuuauuauuauuuuuugagauggagucucacccugucacccaggcuguagugcaguggcgugaucuuggcucacuguaacauccgccucccagguucaagcgauucuccuaucuuagccucccagguagcugggacuacaggcacacgccaccacacccagcuaauguugcauuuuuaguacagacagggguuucacuauguuggccaggcuggucucgaacuccuaaccucaggugauccacccaccuuggccucccaaagugcugggauuacaggcgugagccacugcaccuggccaaguuuuuuuaauuuuaaaagcuagagacaagccauuauuaagugaggguuuaguuuuagauccugaggccccugcacaauguccagcacagaguaaguguuuuugaauuaaaguaaaauaagaaagaaaauuaaauguaaccaacauuuacggugcuccugguauguggcaagcauggcuuuugauucuuuugcuuggaauaccaucauauauucauauuaauugagugaguuugugauguaugaguaugcaggucauauauauacauacauuaguucccccuuaucugcgguuucacuuuccaagguuccauuuaccuucagucaaccgcagccccaaaauauuagauauuuugagagagagacaguacauucaccuaacuuucauuacaguauauuguuauaauuguucuauauuauuauuaguuguuguuaaucuuuuaucaugccuaauuuauaaauuaaacuucaucauagguauguuuguguaagaaacaaacaguauauauagcguuagguacuauccaaggcuucaggcauccaauaucccccgugggcaaagggggaguacuguauaucacaaauauauguaguacauacagauuauauuaaaacccuuagaggaaggaaaauuuauucaaggaaguucuuuaggccuugugugagcuccuacacguuuauauccacaugguuaaauuuaaucagcucuagguuaagccuuuaggacaucaccuuuaccuagaaaguccagggaagauuacuugagucuugaguuuagggcucacuugcagcugucugcaaaacaugauaugacgaaaguauuagccagaccagggacgguggugcgugccuguaguuccagcuacuugggaagcugagacaggaggaucacuugagccuaggaggccgagacugcagugagcaaugaucaugccacuacacuccagccugggugacagagugagacccuguuucuaaaaaagaaaaaaaaaagagaaaguauuagcugaaggaaaugugaaggcaaaacuaaaacaguggucuaugcauaagacguggccagaacuguugguuuuuguaacugagaagcaguuggaggcauauccucagaagagaauuccugggaaaguaaaacagggucuguccuccuuccuggccacaugauggcggucuuaccucacucacugacagcucaggugcuggguuggagugaugagccaggcaguugcagggaaguggcuccuauucauggcauugagagcccggcaggcuuuagggaacuccucacuguuccccaucaauugugggacaauggggcaguggcugcuguaggaacuuauccaccaaggagcuaguguugcccuuauauuuuauggaucucaaagagaacauuucaaaagcacagcagggagguucugauuuauucauuucaucccagcugugcuuugggcaacuaugagaccaaaaucaaaacaccugcaacuuugccaucuggggagggugucacccuguuacguaaauggggcauaacuggggacacuucucuauggagagcaauuguucugugacuuuaagcgaaauuuauaucuuguuacaaacaccuggaaauuguagcaucauuuagauuaaugccaguauuacaacauuuuagagagaaugugcauacggcucagacgaaauccaaauuaaccaauuauugaaucccuaccgcuauguaugacaucaguugcccuugaaagaauuaucuaaaaaauaaaaauaaaaaaucuuauguaucuaguuaagggaaauacuaaaaagaacaagcauuuauugaacauauaugcuagguacugugcuagaugcuugauaugcaauuuuuauuucguccuuguaacagcacuauggcauaaguauagauauugacucagagagguuagcuaacuugucuaagaucacacagucaguuauagaggaacucagauucauguucagauauaucugacacuuagucccaugaucauaaccucccuacccggagacaccuaagaaaacauggggcacuaauugaagguccaaaauuuggaauguagccagccugggacaguaagaguaaggggacacauuuucugaaagugucauuucauauuuaucuccucuuuuguuucugcuacuuguagauaccccguggugcucccccaucaaggugaaguauggggauguguacugcagggccccucaaggaggauacuacaaaacagcccugggaaccaggugcgacauucgcugccagaagggcuacgagcugcauggcucuucccuacugaucugccagucaaacaaacgauggucugacaaggucaucugcaaacgugaguaggccagcucuguguuggguccucagggaugaccagagccaaaguucuuuugcucugagauugaggauuuucacugaauauugaugagaaaaauucuccuuaugaucagggggacaccagggggauucuaagauaugguggaagugaguuggcuccucucagagagaaugauaugaucagcuguuugagaaaaggggagagaagaucauuguucagaaaaugaguuacauuuguucaguuagugcuggauccugaagagguguuggggauuuagaaacaaauaagacgcacauggguccugccaugaagaggcuuuaguaaggcagaggugucaacugggagauaaguacaagaaggguacaaagucagggacauaugguagcagauuaaagaagaguucuccuggcugggcgcaguggcucaugccuguaaucccagcacuuugggaggccgaggcggguggguugccugagcucaggaguucgacaccagccugagcaacacggugaaaccccaucucuacuaaaauacaaaaaauuagcuggguguggcagcgugcaucuguaaucccagcuacucaggaggcugaggcaggagaauugcuagaacccgggaggcggagguuguagugagccgagauugugccacugcacuccaaccugggugacagagcaagacuccaucucuuaaaaaaaaagaaaaaaaaaguguucucccaaggaguggggcuuagggaggcaggaaagagucacagaagaagugaugcuuauuuaugaaagugagugugccucaagggagaagcuuagaggagcagcauuucaggggcuggcuuuuagcuucaugacaagucauaccucauuuggaaaauugcaagugguacagcauuguugaagcacauuuuagaugucuuugguauucaaaacagccaccacuuuuugagcgcuuaugguuugccaagaauuucacauacauuugauuuuuacaguaacacuaucaauaugggugccauuauguuaacuucauugucagggaaacugagguuucaaggcugcagccaugucaucgagacuaugcagacucugcaacugggugacuguaguggacaaucugcucuacccagaucuccucgaugccuuuuacuaguuguauguauccaguacccagcuucugaguacuuugcucuuaaagacuuggaacuucaaccuuauucagaagacugcuccuucagaggacugaucccacucgcucucucucucucucacucucucacucucguucucuuuucacaagagaaagcaucuccugugagcagccuguagcugcccaaugacugacugauaaagaauuaugaaagcccagcuuccuugccugggggcaggacagaaugagcugucauucacacuccagagcuucccuaugggaucaggcugcugcugacuuugccugagaucucaucuugccuggauuucuccccuucccuguucugcuuuccucacccccucacuagucucccugggagcacuuucuuacuaaaccucaugcacauaaauccguaucucagaaucugcuucuggggagcucaaccuaagauaguggcuuagcuggguugccaacccaagccagugugacaggaaacuuugugucuucugugugacauaaaaccauccauuguuucuuaaauuccauuuguuuuauuuauuuauacaaagucguguucuuguugcccaggcuggagcgcaauggcgcaaucucagcucgccgcaaccucugccuccuggguucaagcgauccuccugccguagccucccgaguagcugggauuacaggcaugcgccaccacgccuggcuaauuuuguacuuuuaguagagaugggguuucuccauguuggucaggcuggucucgaacucccgaagucaggugauccaccugccucgaccucccaaagugcugggauuacaggagugagccacugcgccuggccuucuuauauuuaaauuaacuuuucaccucaugcuuucagaguuucuagacucugaaaugaaacucuauagacaaaaacuaagaaaugcugaauaucugauuuucucauuuucagaaaagcgauguccuacccuugccaugccagcaaauggaggguuuaaguguguagauggugccuacuuuaacucccggugugaguauuauuguucaccaggauacacguugaaaggggagcggaccgucacauguauggacaacaaggccuggagcggccggccagccuccuguguggguaagaaaaugccacagcccuuaggaggcacuugcuuugggaggagcaggggguguucacaucguggauuguaaagggagcaucacuauuccuccuguaaggccuaagcaugcaacuuugcucucaguagcaucacugguucucuggcucagcccuagaucuaaccucagugucuauccuggagcugacuucguagcugauggcuuccaucugacuuuugucuuuuucuugguuugcuauugaggcaacuacaggcuggcagagauguggcauacuccugcugauuuuaguucgggggccugagcaaaguuauugacacuauagggacaguccaguagagaacaucuaugugucuuucagccccaauguagcuucuuugucauugacucugguggucagcaagcacucaauuuguucagcuggaagggauuuggauauuuugccuuacucuggguuuguugggcagugagugguucccauggugugguccugggagcagaagcagcaguagcaucuccuggucuaagaaugcaaauuuuuaccaacccacccccaccaccugcugagucagaaacuuuaggggucaggcacagcauuuuguuuuuuaaugagcauuccagggauugugaggcacucaaauagagagcuacugaucuaaggcacugcuucucaaacuuuacugugcagcgaaguccucuagggaccuugggaaaaaugcagauuuaaauucagcaggucugcgguggguccuaggauucugcuaaacgaugcuuuagggcaaaguuucugaaccucagcaugauggacauuuggggccaaauaauucuuuguuguggagcccuguuuuuuuuguuugcaggauguuuagcagcauccuuggauuuuauucacuaagugccaguaacacugcccacagggggcaccucacagauguugcuuucaauauccucccugugauuagcuaugugcauagcucuucaaaacaaaccaaaaagaaaauugaaucuacucccucauauuggaaggggcagaggugauggugggaggagagaagcucaaaaaucuuucugcuaagcaagcuuuggcagaguacucuagggaucauacuguuuaaauuuccagauugugugcaacaauggaaagaaaaugcugauuguucucaaaaaccaacagcaugucuuaagcuggaccagaugcgccuggaaccuucccagaggaagagagaaugaaccccaaauucaggagauucauauuacaguuugucagaacaagguucaggcauauuugggagaaggaggauuguacaugcaauuaguuagggaugacaaaaagggguacagcgauccacaagagagccuagagcucccaggaaaaaagagagaaaugggcaaagcaagcaggcaauucuuucuuugauuuucgcgacagacaagcugagguuuguccccagugaauuuuacuccagggguauuauuuacuuuuuuggcuuuaaauguauuaaaauaguuuaauaaauuuguuuuuguguugacagggguaggggguccuugagcguaacucagaacuucaaccuauuuuaggaggugacacauaguggcuaaguaguucccagauuuccacacaaccuucaacagucuuggccagagcuguacugaguggugagaaaguugucccaguucucuucuagacugugagggaagagagaagacugggcuuacuuuggacucugagguggucaguucuguggucuggcuaauuugaaggugccacaaguuaaaauuaauucucuuacacagaccauacucuggcaaugagcugaaauucauaguuauuucagaaacagauauagauaaaaauaagucaauguaggaggaaaaaaaauacugcaaauugcaggaggguaaaaagucuuugaagagccacaaccuccauugaucuggaagaaaauaaaccuuagaauguaaccacuauuguuuucgggggauauuuuucuuucuuuccauuuuuaguuauuuuugguuauguuggcauuuagauagaacaaugaacaguuggaaucacaacaaguccucauguaaagaccagauuuugaguagacacaugaucucuccuuuagaccaacacuucuuccuaggccaaaacaggaagaaaacaaauuaaagauacuuuaaaaaccacggacaaugaaaaaccagcaaaggucuuuugacauucagagaguauccauuuaauuacuuuaacaaaagacaauguacaaacuuuccuuuuugcccuguggaacggauuguaauaaagugaccagacaacacauuuaaguucuaauuaucuaucaaggaaaaaauauuuuuaaauaaauauauuuuauuuuuugcucacuuauuuuuuguuuucuacagaguagaauagguggagauuuauuaacacaaaugaaauucuggaauaaaacauuuuggagauguaauauauggaaauugauggcauacguuucuugugucccagcugucucacagcugguuuacccaaugacccauaggaaugggaucauugcauuauugcugggcugcauugcauuauucaguugaugcaaacaucaguagggcuaagaaugaauguauccaugcauuguugcaaaugauguuaaauugugcuaaauucuuccuggguugacaaauacacauucuuuugcaaacuuucagaggcuaguuucaguuaaaacaacuugauugacugagauacugauucacuuuuucccuuacaugauuuguuaguacaaacagaacaggucaacuuuuaguggcucucucuaauauaaauguaucaccaaugaauuuuuauuugggcuucuuucuugugaagauguugacuuuuagagaugaggucucauuauguugcccaggcuggccucuugcuaugucguccaggcuggucuugaacucccaggcuuaagugauccucccacaucagccuccugaguagcuggggcuacaggcaugagccaccacacccggcuaugaucaugacuuuuaaauguggauuucauugccucccuucuugccucuuuugucuguuuuggaaaguucucuggauuuuuguauggugccaaacagaggaaaccacuucccagagccauccacagagauuacgcucuggcugggggaagcaaacaacuggaugaguuuucaauggccagguuuguucugcauuuggcagucacucacuuccuaugcccccuugaaaagaacucuuccuuucucuaucaccaaacucaaacuauuuuauauuugcaucagugaucuguugcugcacaauagaccacacaaaacuuaguggcuccaaacaacuauguuauugcucaaagauucuauggguuggaaaguugggcagagcucuguggggacagcucaucucugcuguaugugguaaugguugaggugaccaaguggagcuggaggauucaagauggcuucacucacaggucugguaccucaguugggaaaaguuguacugacuggggucuggcugagucucuuucucucucucucucucauuuauaauuucucauccugauuacauggccucuccagucaauuggacuucuuuagauggcagcuggcuuuuaacauagugaaagcagaaggcaccagauucuuugagggccuaggucuggaacuggcacagggucacuucccuugcauuuuauuguuaucuguugggcaagacuuuguccuuuugagcuucuuccuuauuuccacuaccuaccggguuagaugugucaaggauuuccaaguaaauaguucagcuucagcugggugcugguggcucacaccuguaaucccagcacuuugggaggcuaagacaggcagauuucuugagcccaggaguucgagaccagccugggcaacauggcaaaauccugucucuacaaaaauaaauaaauaaaugaauaaauaaaaucagcuaggcaugguggugcaugccuguagucccagcuacuugggaggcugaggugggaggaucacaugagucugggaagucaaggcugcagugagccgauauugugccacugcacuccagccugggugacagagugagagccugucucgaaaaaaaaguucagcuucuuagauaaauaguaguugauacaaugcaauauauuuguaucucauauuuuauaugcacagagauaacuagagcacagagaagggagacaguuugucagaugucuccaaugaauguggcagagagcaaaggccagaauuuucacugaagguuucaagauuuuuauauaauugcaggcauccuaauucaacaggggauaguaauuauguuucuauaguaacuuuguuccuuucauucauggaaauguauaacuuauaaaaugcuaucggggccaagucuggguaauaacaggcuuaggucucuggagcaucagcugaagggcagaccagcuugucucaccagccgagagagaaggcagcugcuugaggaugugucaggaucaaguccugcagaggcucuucaaggguucauggggaagcuaugacagaccaucacaaaacaguaugugugcaaagguuggcggaaaacacuaggucagcagcaggcagauacacaaaaggguuugguuuauuaaaauagcuuuaaaauauguaauggcauuuaaaaaucccagaccacaaagaaauuccaaaagagaggaaaugcuucuucccagucuauaaaugaggaugcuaauaacacugcuuagucuaaugggugguugugcaaauucaguaaaauaauauagggaggguacuuagcauggggugggcauguaggaaggaguccuccaauauuaguuauuauuuguaaugauuuauuucuucuuguuucuucuuuggaagagcacuguuucugaaaagcuaggccaguucagcugaucauuguuagcuagagauaagcuggcuuugggaaacucugagacucuucacccagauaaccuaucuuggagccugugugcuuacacuguuaguacaucuugauacagaaaacaaacaacaauguaucauccagacauuuaguuuaccugacagagacuaaguugcuuuucacucugaccaugcugcaccaagaaaauaugguaacacaauguaauuuuacauugaaaucuguaugcuaauaaauauacuuucuauaauguaauugccagcuauauuugaccagcagggggcagucauuauauacuugucuuucugugaaauguucaucugaauuauaaaaguuugucuucuaucaccuaucauaguaaaaaauuaaauguuuuuaaaaacguaacagcugaguauagacaucuugaaugcauuuaaagcaucuuccauuucaucauaguauuuguauacuuuauuuuaucaauucugagaagcguauuauuucuaccuuuuaauaucccugaaauagggaugcauuucacaauuaggagugacuuagauucaacaaaauauggugguuauucaauuuaggauuggugcauuaaggcuguuaaguucacacuccacugaagcacgacauagaaugaaaaugaauuuggauagcugaaggcaaaauuguuuaauaaguuauucguaacuucuuacccugaauaaaaugagaaauuauuagacaagacacaggagaaaguauauaaagaauuuuacuuggugcauuuagucucucaaagacaucugucauucagaaucaaaaggacauuuaacuuucauuaaggcaguaauagcacuuaauacuuaucaguugauauguaaaguaacaugaagcugaauguccuuaauuugcuaugccuucuuuaaauacauucucuaccuguucagaaauauuaaguagaauuugcagaaaugugaacuuccucuugugauuucacuucagcuauaagaugaaauacaacccaguguagaguugacaucucauuuacuuugagcccucauuaaccacccauccuuguuaucacuaucgaggcagaacuccuauuaccagguagagaaacuacuugaagaaauuugggaggcuuuuggagguccagagccacaguaaaacugcugucccagaacauaaaaccauaaguguaguucaguagcaguucaaggggagaguggacccagacagaccauugccuauuuuaagauauuaagcaauauguugauaauagauagcaggaagagagagagcuuguuccaguggcaagugcuccgacuuagauuguaauucacagugccauuaucuacauguguggucuuaaauaaaucauuuaaguucuuugagccucaguuugcacaucuguaaaaugagagaguugggcggcuccucuacaccuccauagcauucacuuuuaccuugccuggggcaauugccauuuucuaccucauguuauauuucaugugugauaauguaaucccuccaauacauggcaaauucucugaaaugucaggagcacaugauucucuugccuuugugcacccccaaccccagcaguuggaaugaagccuuggauaagauugguacucaugaaaaauuuguugccuugaauugaaucugacuagaugauagcuagaaugccuuucuguaauauuccaugaugcuguguucaaagcaggaaguacucacuaaagccaaaugacuucuaguuucagcuggguaacugccauguggccuucgguaggcagaguuuggaagcauggggaggaaaggcuguaacuaaugaauuacccacaggacaccuugcaaggccaguugauugcagguuuagcccugcaaaugugaguauuuaaacaaucuucaaaacuuagcaggagaguaaaagcauuaugaagggagaaaaggggaauauauagggugaacaaacucuuugaaaauggagaauacccagaggcuuugguauuuuaaacuguggguguugaaccccaguuugacuagauauuucuugaugaugaugagaauguuuugguuauauuuucagauauggaaccuccuagaaucaagugcccaagugugaaggaacgcauugcagaacccaacaaacugacaguccggguguccugggagacacccgaaggaagagacacagcagauggaauucuuacugaguaagugaaacuuggcagauaaaaugaugcugucucuuuuaugugagauguuuacuacccagaguaggggaguguauauaugcuggucuauuuaugcuuucagauguggucccccuggucacuaccuaacauacuauauaugucaccuauguauuuguugauugccugucucuauuauaauauguucacugcuauguccuuaaugcccagaacugugccuggcacauaguuagcacucaguaaauccuuacugaaggaaaaaggagaaauaagggguggugaaugaugugauuauuaugcauugcaugccuguaucaaaacaucuuggcugggugcgguggcucaugccuguaaucccagcacuuugugaggacgaggcaggcggaucacuugaggucagaaguuugagaccagccuggcuaacauggugaaaccccaucucuacuaaaaauacaaaaauuagccaggcaugguggcacacaccuguaaucccagcuacucaggaggcugaggcaugagaaucgcuugaaccugugaggcugagguugcagugagccaagauugcaccaccgugcuccagccugggugacagagugagacgccaucucaaaaaaauuaaaaaaaaaaaucucauguaccccauaaauauauauaccuaccauauacucacaaaaauuaaaaauaaaaaaaauguaaaagaagggguggugagaagaagggaaggaggaacagaaggggaaagaggaagccaguugguuaauuuaagaauagagccacccccauugccugcccaggcagacccuacucaugcccccaggccauuaccugcacugggaagccaucugugucucccagguggugccaaaggcugccgcucuugugcucugugaguacaguuuagugcaaaacuuuuucaccccuuguuuuuuggcuguauuuaucucuuucaaagcuuuuuaauuuauuuuuaaaacucccgaucauaucaaacacuuacagaugcuuauuuaaaaaaagagaagguaucuucugcuuucuuccccaccucuaccccauucuccuggaccaauuucauucauaguuugacauguaucugaguugcuuuuuguugguguguuuguuuuaccaaucacaaugagaagcacuguuaagaagcuuuuaaaaauggguggaucccuuugugaggguuagcuauguguuguucuaaucuagcauuugggccuguaccccugcaacuguuugguuggccuucauauucccuggagaccacuacuucauguuagcacauucauaucugugccuuaaaguuuaugggcauauuagaguuccccacugaguuuucaucuguagaugaaaggauaccucuaacuuaucuccuggugauccauaaagcaggaaaagacuuucuagaauccuaucaacccaggcugugcaugacaaaacauuuuuacacaaugauuagcaauaacaguacaguuucuagugagaggagacaggacauuuuguuccuacauuccaauaaucuucccccagugccucaucuagcuuaaguaguauuacuaguuaugcucucccauuguaacuucucaaagauaaaguuugaccauuaaaaaauuauuugcugucacauacacaucccacaaauuccuuuggagaaaauguaggcaaucagaauugaaaaguaaguugauguuaucagggauuggguuuuauuuaccuuugacucuucagggucuagcacaaugucuggcccagccccagcacguaguagguuuuuagauuuuugcagcucugacugcuguugaaaaaaccugugugauaaacacaaaacaucaagccaucagaugacucuauuugucuacaagcuuugugagaauauucaccuuguucuuuuuauggguaacuugcguaauaugguuaggaguguuacauuuuauuugauuuuuuuauuuuuugagacagauucucacucuguugcccaggcuggagugcaguggcacgaucuuggcucacagcaaccuccgccucccagguucaagugauucuccugacucagucuccugaguagcugggauuacaggugugcaccaccaugcccugcuaauuuuuguauuuuuaguagagauggguuuuugccauguuggccaggcuggucuugcacuccugaccucaggugaucugccugccucagccuccaaaagugcugggauuacauucaugagccacugcacccggcaggauuguuacauuuuaaaacagcaucucaguauucuccugucccuuuguucagagcagcugucugcuuccagaguucuacaacccagaggccagaaaggcuuagagcaggauguggugggaaugcacuccaacaggaugaggaguucagagaaggcugucuuguucccuuuucgcucucacuagggcuccuugcugcccuggcauuucuccuaugaccccuuccaccauuuccuauccaagcuacugcucuaucgcucccuugugagggagaagguucuagugucaagcucugagacaagugcuucuugugaguucccuuauuuacuccuucuguuauuugcaugucacaggugaaacaaagucucagaaagguuacauccacuuauauuugaaguaucacuccucucagguuuaucugaauuuaaacugugcuuucuaaagaccuuaaagcaucuaaagccaacagcagcaugucucaaaauagugggauuucugacauuuucccaagaccccucucucauaccugguaaacagccaccucacccaccuacauguaaggcuuuccucaauggugacaaugauaauuccacguguucauuauuagcaaauauucucaucauucccagaacuguagggagauggggaauuauauguauauugaaaaacagaacguggauuuugauccugcuauacuuauugguguccucauuaggcagccaagaaaaaagauaaacucacccuagcugugugaccuugggcaaguucuuuagccuuuuugugccucaguuuccucaucugugaaucagagauaauacuaccuaccuuauaggguuguuggauuaaauaaggaggauuaaguaaauauaugcaaaaugccuagaaccaugccuaacauguaagguuuauguaagugcaaagaacacuuuuugucauuauuauuauguuauuaggauaaccaaggaaucacagagaacuugccuuuaggucuccacugucccagacagaaagaacagagaaaguucuagcacccacccccgccccgcaggcccaaauugccagugacugcuuggacuauauucucuaaugauuuuccucacagaaaauucccucgucuucccaacagugaggcaauucagguccccccuggaacaagagugagauugaaggaggagacuugggcccuauauuuuucauccucccuccccccucuacccacuucccuaccauucuacccuucagcaagaaaaaagucuaagcuucccaguaguuugggucuuccauuuucuggucacaaacugcucuucuaaaacagacuaaagcuuaggagauucuauucuucaagaaauuuuuguuuuauuuaaacuggucuaaugguugccccucagucucuccauguccuguaaagaguaggggaucgucacuugcuugucagguccauaaugucaucuuuccuguuucugauuuuuuuucucuaagugucauucuaaaaggccuccccccaggcuccaacuuuccagaaggagaccacaagauccaguacacagucuaugacagagcugagaauaagggcacuugcaaauuucgaguuaaaguaagagguaagaguacugcuuauugguuuuguuucccccucucuuuagaagagcaaagggaaguagguccucaagccagaacucucucaagugccuacuguggugggagacuugccagcuuuagauuagucucuaauaaggcuuggggaagugcccuaucuuaaugccugaauuucacgauacacauccggaugggcgucaguguugccagauuauuuaaggaguucccaggacuagucuuacaggaucccauagcugacuguccuagaagaauauuauucaauaauuuuuccaucccugagcuuagguggccagcugaagccugugaguccaucuacaaccagggugaauaggagcccccuaauuugggccaccaggagaacauguuuuuaguguucuaguaccauugguaugaaagaaaauguuuuuaaggauuauuuuaugccugaugguuugggcaacuaauugcuaaccaucuuuacuccuuacucuucuggacuucacuuccucaucuauaacacuaggggcgaaaccaguugauaucaguggucucauugguauggauggugaccauugcaagacucacucacugaccaaauagucaucccuccucccucacucauuucacaggcugauguagaagccugauugcaaagcugaugccucugcauccucaccuuuucugcuuacucuguggaugggagcucagcacugagaccccucuggacuugugucccuacagucaaacgcuguggcaaacucaaugccccagagaaugguuacaugaagugcuccagcgacggugauaauuauggagccaccugugaguucuccugcaucggcggcuaugagcuccaggguagcccugcccgaguaugucaauccaaccuggcuuggucuggcacggagcccaccugugcagguagguaugccgccccuccagccugcagcagaaccuguaaaccccuugguucuugauuccagugcaagagagguuucccuucauauacuuugagaaguucauggccaucccucuuuaucugaguggaugaacauagucccuagaucccugcugcagcucaucucaucugccauccaucuugccccugccuauccucuaauuuccuuuucauguccucuaaggaagaagcucaagguaggaaccuagggccagccuuuggugacauuaugaaucagcaaaauuugcucuaguuuccuuuguucuagaaauguaaggaucuuauuuauaaagcuaguaaauugccauguagagacaauaucauaccugcuuugcaucacuggcaugaaaguuacauagacuuugggcauuuggaaucuuuccuccuauguaaaaugaagaaaauaauaccucaucuaccucuugaguuguaaggauuaaaugaggucaucuguggaacaguggaauagagcagugccugguacaggcaaagccuuaugccagcucuuauuccugaugaagaaaaauugggcuggguaaugagucugaaacuuggacuagccagaaaauuauguauguaucucuuguuuauagacuucucuuuuucucauuuccuggcacccuuucaucuuuaucacuuucuuuuaauugaagcccccauuuagaguuaagugacagagagacauauauaccaucagcuaaaugccugagauucuucaauuucauguauuaaaguagaaagaacacaccuauuauagacucccuaccuaaggacuucaugcccaccaccuaugaggcuauucugaauugagauaugcuauaaguguaaaauauauaccaauuucaaaaucuuagugugaaaaagaauauaaaguaucuuaauuuuuuauauugauuacauguugaaaugaaauauuuuggauauauuggguuagauaaaacauaaaaucauuucuaccuaucucuuuauauuuuuuauuuguuuguuuguuuguuuguuugagauguagucucucucugucacccaggcuagagugcaguggcgcgaucucgguucacugcaaccucugccucccggguuccagugauucuccugccccagccucccgagcagcugggacuacaggugccugccaccacgccuggcuaauuuuuuguauuuuuaguaaagacgggguuucaccauguuagccaggauggucuugaucuccugaccucgugaucugcacgccucggccucccaaagugcugggauuacagaugugagacacugcgcccggucucuuuacacuuuuuuaaugaggcaacuagaaaauuuaagauuaaauauaguggcuuacauuguauuucucuugaccagagcuauccuagacucugagucccuggggcagggaagagggcaggaaagagggcaggaacuguguaucacucagugugacauccuaguaccuagcauagagcuuggcacauggcaggcacucaguauauaauggcugaaugaaugaaugugugaaugaacaaauacuucaaugcaaaccuaaaaugugaaauaugaaaaccaagauuauaaaucauacauggcaucuacuaguuuuucucuuauuauuucuucucuggggcuaagccuuuugcuugccuaucuauacgacauccuucauugaccuugaacagcuggaauuaguugucauuuauuugcuuaaagggaagaccuauuauaaaaccgccuugucccauguccuguuugccuguguuguuugcucuguggccuuugugccccacauugcuuugucccuucugcaccaaggaggcagacuucagagauucugagccauuccaaagccagccuggccacugcccauucucuuacccuucugccucucugcaccccuuuccccagcagauacuauggugcuuggcccauaugccuuucacauucccaucuguguucaaaaggcuacuuacugcaauuaacugggucugucugucugagagcauuucuuuccuggcuaugaaagcauugucagcccaugcacagagccagcuggaagugauggagaguuagugccccagaagcagcccucagcaaugauggagcaauuguauaaauacuccaguucccuccaguggguuaauucuggagguauguuguauaucaucuccuagaguuccccagugggagugaguuccaaaugcccacagcaaaaacuugcuugauaaccaauugguauuguuuucuuuccuucacugucucacuuccugacauagacagaauaaugguccaccaaagauguccacauccuagucccuggaaccugagaauauguuaccuuacaugaaaaaagggacuuuacagauguaauaaguuaaggauuuugaaaugggaagaguauccugaauuacccagugggcccaauguaaucacaagccuucuuauauaaaggaggcagaacugaugucagagucauagaaagagacgauggaaggagaggucagagagaagagagauuugaagaugcuacacugcugucuuugaagauggaggaagggacuacuagccaaggaaugaauguggccucucgaugcugaaaaagacaagaaaucagauucuccccuagaaccuccaugggagcauagcccugccaacaccuugauuuuagcuccaugagaccaggaucuuuuagauccugaccugcaguaucuaaaagaauaaguuuguauuauguuaagucacuaaguuuauggugauuuguuacagcagcaagaggaagugaauauacuuccguacuccuccacaggcgcuucuugggacugccucccaaauaaacuguuuacacuugaauccuuaucucaggguuuacuucuuacacaaaugguucugugugucaucauaggcucuguugagccagaacaaguggaagguuucugacccauguggccauuucugauuacagccaugaacgucaaugugggugucagaacggcagcugcacuucuggaucaguuuuaugagaaaaggagacuccucauuguguccacacccacagcccgaaaccuccuuuaccggcuccagcuaggaaugcugcaggugaguccucgaggcagggccaaggugagagggagaccuuuaacaggaagggcccagccauuucacuaaaagcaaaggccagauucagugccuaaugcacuuacagugaguuucaggaaguggcacuuuagagcuaccaccauucauuucugguucugggccauaaccugauuaacauugacuccuuagaguuaacccaaucguuuuccaacuaaugagguuugucugucuucaccaauaagucuaauugacaugcuguccaggccuagccacagaacaauugucuuugccaaaccuguccaggauaugccuggcuggaagcaaucaauugguugccugcccacauuuuuccccagggaauuucuuugacucagagggugacagccauuuuuucuuagaaaagugguucucaacgugugauccauggaccggaccagaagcaucagcaucaccugggagcuugauagacaugccaauucucagggccccucccagaccuacugugucagaaucuacacuuuuaacaaaaucuccaggugauuccuaagcacucuaaaguuugagggucacuuuucugggaaauguguccuucucagcuauguaaauuuuguagcuacuaaaugaggcaaccaacaucuuggguguguggggaaggcugacuagaaacuguaaggaucaaacuagaaauugcuugcuuuuguccugaggcugguuugcaaaagaguggccaacuucacugaauacuaaagaggcaggauguaugcugugccauggauacagugcugcacauuuuuuugagacuauuuuauucauuuauuacaguggauagaacuaagugcuuagaacaguauugauuuaaucaaaggcuacaauuuacuucucauaucagcauuaauaaaauggauaauaauaagucucuuuucacucuucccacguacuugaagaauugccuaugaacucugaagagccauauaaaauuuuugugaguucccuugauaggaaccaaauucauugcaucuuuaccccugguccccaccagcuuaccuccccuuguaucuccuuguccaagccaggggcuugcucuucagaaaacacaagcuuauaccucugucuuuugugggaaacuggcauugcaggcuauauuccaugaucaugcauuuccucaucucuucuuauuccauaggaaaaugaauuaagccaaacaacuugcuuuuccucugugucagcaaacuauggugacccauggcuaguuucgguaaauuaacuuuuauuggacacagccacacuaauucauuugugcaugaucuacaacugcuuuugcacuacaaugaugggugaagugguuaggacagaggcaauccaaccuugccaagccugaaguacucucuggcccuuuacagagaaagauugccaucguugcucuagucugucccaucccuucagacacuugcuaacuuaacaacugguuggauaagauauuuuauaucaagauguuuuggugugcccuccuccuccaaauauacuuacauuugcauuuuaaccagagccuucaaagaaagguuugauugacuuaggcauuucagugagaguaauacaaaagucuauuucuaacuuuuuaaacuuuucaaccaguucuguaaccucauauagggacguuucaguggaauuuugguaaaacauauuugauguuuucgucuuucaagacuucaaaauuucuuuucccauuuagccaaauucaucauauuugucuuacauuacuuuuuuuuuuuuuauugccauugccauuccugaugagcccuccucgugguugacugggccacauucccaagguucuugccaagagccagcuuagaggcuuggaaccuuuuauccucuuuuccccugggauuggguguggagggcauagggcaggggaguguggagaguggaaacagggcagagaaguggacucuggaaauagucuucucuccuugcaaagaaaaauuagaauccucugggguggucuuggauacuuuuuaggaaauuugacucacucaaggucucacccugucuggaaauacauagacugcccuuuugcuuagguuuucaaaaucccacugucaagccauaucugaaugauuccucuagcaaagguauuuagguuuuauagccacuaucuuaaccccaauuucucaucuguuuucaggacaguucagagugagcaaauaaacuuccagagacaggccagugcugcuucugucgguuucuaguuugauaaggaugucuuuuuuagccaugcucauacuuccccuguuggguuuucuuuuucccagcaagcacaguguggccuugaucuucgacacaucaccgugguggagcugguggguguguucccgacucucauuggcaggauaggagcaaagauuaugccuccagcccuagcgcugcagcucagguagggggaaguucuguucuuaaaucuuauccccugugaaugcauuuuuaacugauuagguucccugguuucuuucuauucaggauugaguucaggcaaccuucaauguuuaauugcuuuuauucugggaguguuauaaccauacuaaucaguauguugcuguuuguucaaauaaauugugcaguggguaauuaccaguguucuuucuuacucccuccaaccaaccguuuuugcuucauguguguguaugugugugugugguugguggaggaaggaugguuaggagaggagcaccugaagaaaagacuuaagcaaucauggucuuauuagaagagcaugcauccaauuagacuucccaggcuuggucucuuuuuucuccaugcuuccagaacacuuguucauaccuuuauuuuaacaauuauauuuuaguuucauaacccuuacaaaguuggagccauggauuuuagucucugaauaaugauguauuaaagaagcagaauucaacaaccaaaagguaauuucagaauaacccaaauuucuacuugcaucucuugaccacugugaaaucgauaauuaggcuaaagcaaaacuccuuaaaaucuuccuuucucacccagccuuuucucucacacacugcaugggagaguacagaucucuguuuucagggucccaggcugcucccugucucucagggccucaggcaguuacaaacaucucgaacacguggcuuucaggcuucugcaaaaguggggaaagagaguaaaaacucacacugacuccuuuaugcuucacguuggaggugccacaccuugcucacucucuuaguucauuggccagaacuaguuacaugauugcaauucacuuuuaagggaggcugggaaaugcagucuuucuguauugccagaaagaagaaaaugaaaugggacuugguaaacccuaucacaccuguucagaaggcacagaaauuccuugagagguuauaugauagaaacauauccuuagcaaaugaugcuauagauagacacaauagcuucuuucucuaauuucccuguuuuccagcugccuuugacccaucccauguuugauuuguaccacuuuccacccaaaaagauucugccacauuccuaccaagguaaaaaaaaaaaaaaaaaaaaaaaaagaaagaaagaaagaaagaaaaaacucagagggccaggauggaagaaaaauaagaugauucaugaguucucuuuagucggcugaugaauggagaaggcuggguacacucauaugcuuuuguuuuuguuauauuuuacugcauuugcauguagcaccuccccauaccgacuucaguagcagagcuuucaaauauuggcuacucaguaccuagcacaguaccuggcaccauguuggcgcuaaguggaguaaaugacucaaaauuucauugaaacagccuuacuauuuccagaggugauaauagcuuuuaaaaguauauuguauaucuacaguuaguauacaaauacuucaaguugaaguguacaaaacuuaagacagagaguuguguugauaucuaaauauuuauggugaauauuuucaaaguagguuuuaugaagcuguugcuuauuuagaacuacuugcucauauccugugucaaugauuuuuuaaaacuuguugcagaauuuucugaauggucuuuggauugaauguguguguauguguguguguaugucaucuucauaaaaucuugaugugauuuuaaacuguuuaaucuacuugaagaacagaaaaaugugauuaaaaaauacuugucauucagauuguauauauuggggcuaccauagacuucuauaggcugaagauaauuuuuaaauacauuaugucgugguucucaaauuuuuaaccuccaucagaauccccuggagggcuuguuaaaauacguauugcuggagucuacacuguaggcucuaaacuguguuucugauucaguaggucucuggucguacccgagaauuugcauuucucgugagcucccaagagaccacauggugaggaccacuggccuaguuuuuuaccaaagccuuuacaguuugaaauagaauuuuugcccagcagccuucaaggaaagggucaaucacuauuuugcagcuggaugauaguccagguaaaugucauacagaaaugaucacucaggugcauuaccuaauggauucugugucaggccggcaugccuguguuaucaaacauaucagugagaaacaaagagcuuggcagaacuuuuucccuuugaauuggaaagguguuuuuuagacaccuuggagucuagugcagaggaaaaaagaugauuuaggcaaagaaugggaagcaaaagaggagaaggaaaagcauaaugccugcauaauguaaaaauucucuugucuggcuauuuucaaauagcaccaaggccgugauaaaacccuugaagggagucaacagaaagaagagacugggugccugggguugcagggucaccgccuaccuucuuucuuacccucauuucuuuuuuaucuggagguaugaucugauucaugcuuuccagaggaauuuuccagcaaucucaaggaagacagggaccaagaaagccauaguuucuauacccacauuauucuuugagucuacaguguucccuggaagacuuuccaggaagaacuccuuccaaucugacgacagacacauauguaacucaggcauacugucggcaucacaccucauccccgauuuugugugguguuugaucauucauccccaagauuucuguggucuuucggcccuagugggaugcauuccuguggcugcugcuagccugcugauccaaccacucagcucuucccaugacaguuuucccucuuuacauucugugucaaugaaggcacaagacuuacacaggaauguguaugguagcagaugguggcaccguggugguggugguggggguucccauccuagucucacaagcacuauaaaaaaaaugaaugcuccaauuucuuauuggucacccuuucccacaggcuucagccaccacauucccuauuccucuguuuccugagagcucccuguaccagaacuccuccacgcucccaaaagaaaacucaauauccuuccccuuaaagaugcagagcauuuuaucucuucauucacaccuuugcagccuacauucgcguguucagaacucauuaaugcacuuugcagucaucuacuucugagcuccccucuuagcacugcaggaaaccuggcagagguauugucauguccucuuuauuucauuucuagucacugggagugaacuggcaauuuagcuccccacugggauaaaauacaaauuauucccuucuuccucgaaacucccucuuaaaaggcagaaaaaaguaguuuguguucuauguaaugauuuuuuaaccuugaucuguuuguaugaggaaaacauauuuuacuuuaaauccagauggcaguguauauucugccucauacauaaucucaaaauaucuaaacugaaaaaaaaaucuggagaagagacugagugggcucauuuauucauugggcucagcuuaucuguuuguuugcuuucucuagcuauucccaucuaaauauguuuguguugauauaaaaaucauauuuuuuaguuuaaauucuagugugguagagcagaaagaacaccagacacuugaaaccacuucauauucuuuuuuggaauuauuugggguacaaauuaugauuaaucaagucagaauacaugggcuguagaccaagcucaaucccuuauaacucugcaguccugagcuggccacugaacaggccagaacuaucaugcugggaaauuauaucaaucagcuuuaccuagcccagaguuucucagccuuggcacuauugcuaugugggaacagauaauucuuuguuugguggggacaguuggcugugcauugcaagauguuuagcagcauuccuggccucuacccacuaaaugccggucacaucuucacucuccacugugacaaccaaaaauaucuccagacauggccaaauuuccccuggggguggggagcaaaaucaccccuguucauaaucacugacuuuguccuaguguguauguggucgugcaacacuagucagcaaacguggguuuuggguugauuccaaacuuggauugauuccaauuuaauaaaaaaaaucuguuagccuuguaugcaccuuguaccaaacguugguauguggcaccauuguacgccugaagucuuccugacuauaaucuaaaaccaaagcagugcuuuucaaccucucagguacauaccagucaucuggggaucuugauaguaaugcagacacuaauucaguagguuugggguugggcaugagagucuccauuucuagcaaguucucaugugaugcugcugguucaagggucacaguuggaguagacagggucuaaaggaugauucaguccuucauuguaucaaagcuuucucugcacacugucacaguaaggcucugguugauccaccaggacccuugggagucaugguuugacuuagucuccucuuuucuuugucugccacaggcuguugcugcgaaucccacucuacuccuucaguauggugcuaguggauaagcauggcauggacaaagagcgcuaugucucccuggugaugccuguggcccuguucaaccugauugacacuuuucccuugagaaaagaagagaugguccuacaagccgaaaugagccagaccuguaacaccugacaugaugguuccucucuuggcaauuccucuucauugucuacauagugacaugcacacgggaaagccuuaaaaauauccuugauguacagauuuuauuuguaauuuuaaaagucuauuuuauuaugagcuuucuuugcacuuaaaaauuagcaugcugcuuuuuguacuuggaaguguuucaaaaaauuauaugaccauauuuacucuuucuaacuuucuuuacuccaucauggcugcuugauuuuguagagaaauuagaacccauaaccauacacaggcuaucaacauguuauucaaugugacaccuaacucuuuucuauuuuguuuuuuaaguaagacuuuuauuaauaaaacaaaauguuuuggagcaaauuuaguagaacucacuuuguuugucaagcaccagccauacuuguucaguguggucagugguuuuaggauugugauucuuagugguguuuuaagaauggaaaaaauuuaauuagucuuuuuaggagcucugcugagcugggagagagcugagcugucagguguucaaguagccaauuaaagccacaagcugaaaaugaaagaguuaagccuucagucacagucuaaaaccagaggaagcaucaacuucacucuuccauuuuccccugugggacagcacgcuggucaagauucaaguggagcagcacagacguggggucaucuuuauauugagggagucccgaacaaaaggcucuggcaguuuuacggacccuggagucauguggugggguaggaguggaaaaguccugggcacugaggcagagugaaggaaaguaucuucaaauuuuuucccuuuuccuuaccccauaagaucucagcagaggaaccugaagaccucuugcccaaggccucagauaaagggccuagaaaugaaggcacagggcuaggaauguaaauaugugaaagagcaugauuggccagggggucugagucuuugacugcaacaccccacagagacugccauacgcuggcugugcaccaagucugguguguggagggcagcuuucccagugaagccugccagguaaagucuucgucaucgccuaugaucaggccugaaaaaucacacauugguuuuuaaccaguagccagacuccucaauucuccca

SEQ ID NO: 21569 - RNA, 16044 nt, Homo sapiens
ugcaguucaacuuuuuauuuuaauaaaaucagaauaugcacagcacaugcagugcuagcaucuaaacuaauacaauaagcaauuacuaaagcuacagugacuugagguucaaucuuuacauucagcaaguuuaaauccuuacaugauuuuugaaaccuuauuaacugaaaauauugcuugcugauaaaacuugcucaaaugcuauugcugaauguacaagucacugauuaugccaauacaacaaagauaaccacauguuugaggauugcaaugugccagacauucacugaaaaaaaaaaaaaaacacacaacuaaacaaaauccacacaacaaacaucugagaaucuggacacuucacaucaguguuuugaaguguuucauuaauaucuuaagacaaguguaucaaaaccuuggcaugauuuaauuucaagucgccaauuuuguuuuuacuaacaucagaaaguuauggcuacacugccaacgccgggucugcuuaauuugacuuaagaguuuaauaugacuuaaacauuaaaagcucacacuaccccgaaauauauaauuucacgcauacggugacauucaacauucaagugccaguguuuuuguacugucuuuuggucaaguuucuuuaaacuuucaaagaaucacuuuuaggcuuacaaaaauaaauauuugucaaaauguucaauaaauauuacauaaaacuagcagcaaaaaguaucuagaaaucugucgugugcaaauaguuuucuucccaacuaucauucccauggucccaaauaaauuuuagaaucuagucccauccccuuccuagacaagcugcguucaacaaucuccaagagacaaaguaagauuggaaguuuaaggacacgcacacaagacauauauauaaaauucucugaaugugcaauaaaagaaguacuuuguaaaaaguuaugggcaaaauguacaagggccuaaaccuagacuaauugaaauagcaccauaacaaaugaccucaauacugucaagugcaccuacuuaauaaaaguuuuagaacaaggcacaauacacuugaaaaucuauugcacuuuaggaaauuuuugccgucuuccuaugccacuguaaaaagauggagcguuuugaucaccgcauucuggccacaaaauuagcacagaauucaaaguggcagaggcauuuuagugguggacaaugcucaucuuuggccagauuuagcauaaacagacuauaaauacaauggaaaccuaugcaacuaaaacugacuaaaacugcacuguagagcagaauugacaccuugugcaguuauguacauauuuccaaccugugugaucucaaagauuucaguuuguuacucuucuggagccauuuuuacgaagucuauaguaagccaguuuaacaucucaacgcagcuugaacagaguaaugugaaucggcauuuaaaauaaagccugcugcauuuaauucuuccuguucauacccucuugaccaaaaaacaucaacacuagcaugcguuauuagaccaaaaaucauccagggcccuaaugagggcuggucauugcuguggucagccauucuaccauuucaauuucauuuauggcaggcauuuaaaaagucuaaguagaugaauucuccuaaaaaccuauuucaaguuaucagaccuuuaaacuuucccuguaauaguaugcccacauuuggcuagcucauaauuaaugaucugccuaaacguugaaagaggaauugcuguauuuacuugcauuaacuuugaaaacagugcuuugaauguaugcauguauucauacaucaccucaucaugacuggaauggcuuaaagacuaucagguucuaaauaccuauccaggauagagugagcaaaucagaacuuuaacuuaauacaguuugccacauuagaaacuaauuccauuaauaugcuucaagacauuuguuguuuucccccaaucugcaaguaucaaaaagcccuaaugcaggcuaccgcauaaguuuuuccuuauauuauuuauggaugaaucgaugauuccuguuaaguuguaucacaccugugugccaagguuugauuuuagcccaaguucaguaaauuuauuuugucaaaacaauugauaucuugagcauuacugagccaacaggacaucaaaauaaaaaguugucuaaaguuaaaggcacaguacauuaacaaacaaaugauccucagucacaaaauuauaaaugcaguuugggauggggguaggcgggaggggaguuaauccaaacuacagcaaugaagucuucaaaccaccuucugaacagggcugcugauuguuccuuucauuucuucuugugaccuugagcucccuuaaaaaaaaaauuucaguggagaaucacagcugguaauguacugcgaguucuugaagcuacacaagguauagucuggcuaaguuacaugugguuuccauauuagcuuguuuggcagggugaccuacugcaaagcaggcucaguuaccccaccagucaacccccugggaguuauaauuuccuccauauccaucacuguuguaaaagccuccauagccaccuaaugagagauuuaaaaagagagagaaauuaaugaaguuauccaucauuaaauacaauccuucccuuacguaauuugccaucaaguuucuauagugcugaacuuaaauuguuuaauuaggcuuugaaaaagaugacuaaaaggaaaaaaacccuucccaaagcuaugaaguuacagauuaacacuaccuccaccaaauccucugcugcuaccguggccaccuccgccacugcggcugcugcuugcgcggcugcugcugaagcuggaacugcuggcaccgcuacuuugucgguagucucuggcaccaaacccuccacuaaaucugcuacuauaagaaaaaaauuauguugguucacaugaagaugaaauuccacuaaaguaaccuaacucuuuccuaaugaccaauuucuaauuuuuccauucaaacaauuccccauccagccauauuuuccccaacagagugucacccauucuaauacaaccccuuaccaaagaaucuaggaagccuaagaugauuaagcuuuuuaaauacuguacaguuaaccuuggacguuaugcaugcagaggaaacacuaugaacuguaagugaacacccauuccccucauuauauacuauuuauaccucaccucuuagaacguccacgacugcuacccuuguagugguguucauaagccauguuuucuaaccaagacggcacuucuuguuuagcuucaacaagaagauccaacaaauccuuaguaauauuuauguuccucucguuaaagaaugagguugccaggccuaaaagaguucccaaaaaaguauauaaacaaaggucuuccauaaaguaacuugcuacuauucuuacuuuccuacguagaaauauuuaaaauauuaccacguaauauuuaaacaagugcuuugagcaaaaucuuugucacuuucauuguuaaaaauguauuuuagauccuagcaaguucuuuccugcacacaucacagcaaaaaacaaugaaaccaucaaguaaucaaauacuuaccaagguuuccuacacgucccguacgaccaauacgauguacauauucuucaauaucacuuggcaagucaaaauugauaacauguuucacauuugaaauguccaguccucuugcugcuaccuggaaaauaacuuuuaugagauauggcccacuuaaaagaaaacaaauacuugaacaugcucaauuugaauaaaagaaagauguuuauacauacugcuguagccacuaaaauugggcuuuuuccugagcggaacuggugaagggccucuucucuaucccucugagaacggucuccauggaugcugguacaugcguauccuucaugguauaagaaauccuccagagaaucugcacccuuuuuggucuccacaaacacuaaggucagugaauccuugccugucguugaaaaauuauagguuuuugucacuaacauggcuuaguucucuuugcacuuauguaugcacaauuuuaaugugucaauuaaaauacauauauaucuucuuaaaaacgggcuuucaacacagcauguuuugaauugaggaggaaaaguaauaaagguaauccaaauacauuuaagagaugggggucucacuaaauugcccaggcugagagugcacuggccauucgcaggugcaaucauggcauacuacagccucagccugccaaguagcugggacuacaugcacuguaccacugcacccagcccaaauggguuauuaccagagcaauuaaauuauucauaauuuuagcugggugcaguggugagugccuguagucccagcuacucuggagacugaggcaggaggauugucuaagucuaggaguucugggcuguaguguacuaugccuaucagguguccacacuaaguuuggcaucaacaugguaaccucccggaagcaagggagcaccagguugccuaaggaggggugaacaggcccaggucagaaacagagcaggucaaauacucccaugcugaucaguaaugagaucacaccugugaauaaccccugcacuccagccugggcaacaaagagaaacccccaugucuaauaaaauaaaaaauucauaauguuaccuguugcauuuaggaggucaagcagaaaugaccguuugucugauucuuccacccaaacuacuuucugugugauguuuucagagguagagccaacucuuccuacagccaagaagauauauucaucuaagaaaucacgagccagcaucugaaagaaaaaaaauuuuuauuauuaccugagauaaacaaauuucuaaauaaauaaaauuugcaacaucaaacaguaccuguauuuccuuaggaaaaguagcacuaaacaucauaguguggcggacacccuuuggaggcauaguaucuuguucgacuauucuacgaaucugaggcucaaaccccauauccaacauccgaucagcuucaucuaacaccaaguaucugucaugucaugaaaaaaaacaagccugaguuuagaauuugaggagaaaucaacaugguuuuaguauggcuguuaguauaauuacaaauacaauuguauagguuauuacaauuauauauucauuaagauggugccucacacugcauaauuuuacagacacagcacaggauucuugccacuacauaagucauucaagauuacacagucaaauuagcccauccuaguugacugucccacgagcugaucauuguuguaagucucaaccaagauguuacugauuuuucaacauuaaaauuaccaugaacaagcuuuuugugaaaguuagaugucugaaauacaucacuucucagccuuaacauuuagacaauguuaacaucaccacaaaacuaaugggcaguaacuuuaauacugcaucccauacauuuaaaaauuaacauacuuggccgggugcgauggcucacaccuguaaucccagcacuuugggaggccaaggcaggcggaucaccugaggucaggaguucgagaccagccugaccaacauggagaaaccccgccucuacuaaaaauacaaaaauuagcccagcgugguggcacaugccuguaaucccagcuaccugggaggcugaggcaggagaaucgcuugaacccgggaggcagagguuguggugagccgagaucgcgccauggcacuccagccugggcaacaagagcgcaacucugccaaaaacaaaagaacaaaacaaaacaaaacaaaaaaacaaaaacaaaauaaaacauacuugcaaaagucuaauccaaucuuuccucuuuccaucauauccacuagacguccuggaguggcuacuaacaaauggcauccacguuccaagucucgaaucugcugaccaauaucggcaccaccauaaaccacgcaaggacgaacucuagaucgguaugaaaacuauaagcaaaaaaaauguuaugaacuucaaggucaaaauuuuuacauguucauaaaacauuuaauuagaaucaaugaaaaagcuaauaaucacuggaacucauacuuacuuuucuggcuuccucguagaucuguacugccaacucucucguuggugcuaauaccaaggagauuggguauuguuugcggcgcccauaccuuccauuuuccuaagaaauaaguuaauuuuuaaguuaacucuaccuacccuguuugaaaaguucaucacaacauaauucccuuuuguaauuuauagauuacagauuacacuugaaaacugguuuucauucuacuuaagucuuagcaucauuuagaaagcccucucaauggccaccuacaaaguucuacaauuucccauuuuauaaagaaacaucuaccuucauggcccucaaagccucgccuggaccaucugaauaaaucugacucaagaugggcaacagaaaugcugcaguuuuuccagacccuguucaaaaacaaacaaacaaauccugcucauuacuuuuaaacagacauugguagaugacaguguuuuuuaacuacccuauuacuaauaauuaguacuuuuaguuuaugcuuaaguuuuccaaaaaguggcuucucugcuccaccucuaagaggagucagcaaacugagacuauuuuguaaauaaagccuguuauuuuuauaaauaaagcucuuacggaauacagccguaaccaauaauuuauguaucaucuauggcuucuuucacaguccaauagcagcgcagagcagcugcaaaacugcaugacccauaaaaaauaaaauauuuuauugucuaguccuuuacagaagaaauaugauguuuuacucuuaugaguugagcuuaccuguuugggcacaagccaucaagucucuuuucucuuugauaauaggaauagcaugcuuuugcacuggaguugggcgaguauaacgaguaagcucaauguuucccaugauaauuucucccaucucaacaucacugaacuguuaagaaauucaaugggguuaggaaugcuaucuagagcuauuucuguuuuauacuaauaauggaaacaaccaaccaacagcugauugguaacucaguuuauaguuuaaguaaaauuaucacauuauacuuugagaaaaaccaacccccaggcuuacugcacauuggagaagacuuuggguuguuccuauguuugacccauuuucuauuuuagguaauaaauuauucauaauggugacacugaacucaacuucuccuuuuccacaaaucuaugaagccucuggucuacaugacuuuaugaagcccaucucacauucuaauguaacaugaaaacauuuaaccucucugugucuuaaaaagucaagcaaaaauacucacacuuucaauauguggaggacaguuguugccuguugccucaacuggaaugucaucguauuucucaaaauuaaucccaguguugccuccagaaaagaguucccucaaaucaaaaaauggauaaguucauuuguuauacuagcuaguaaggcuucaucacaaguaacauacacuucaaaaacuuacuguuccaagcguucacuuggugggagugguuuugaccaaucaucuucaucugauuugucacaccagcgacuguuuccaccacguucaaauuugccaaagccacuucugucaccacggcugccaaugccaucguaaucacuccguccacgaucaucaaaccugaacagcacaagcaauuaaucagaaucauaucauuuaaccauuaucagauucuuaucccuacucuagaacuguaucuggagacuuaaguuauggcuaaccauaaggaugucaacaauccaauucugaguuacuugacaaauaaggcucucuaaccagcaucauuuacauaaccucguuuucuaaaaucaguaaucuuuacauuucuauaaaguuguauagccuaaaaggccucacagaugccaaaauuaagaauaaggauuuuauuugaaaucggcacacagcucacaaccuucauuuaaagugcucauccaaauauauuuaaugguagggaaaacaagaaaauagcacaccaaauaucaaucguccuaguuauacuaggaugucacuuaaaggacaauucaccugugugacagacuuuggauaaaagguagaaaauaauccuuaccugaacuaagauguuuuuaagaguuuuaggccuguuugcgaaaaaucaggacacaggacuaaccacagcuauuaggcacguggggucaguucaccacacuuguguaaucaaaaauacaagguguuuagaaauuguuauagaguccacaaaaaucccaaccaaauuaggccauucacuagaugaacuuacucuuuuaaguagaacauauaaaacucgagaaauagaauaacucauuucauuaugccaaugagcauauuccuauuuucaucuaauuucuaaguaacagguucaauuuaguaaaagccucuuacggcuaagaaaauacaaugaccaaacagacauaaugcuuaacauccaaacagguggucaggauaacgacuuauuaaacuguuauuauacauacacguaaggugauuaagaaaucacuuaccuuccccuugauccacuuccacgaucacugaagaagcuagacuucccucuugaaucacuacgagauccaaaacugcuauacgcauccuuaucuuugcuagaacuccacccugaacugucuuuaucguagaaaccuuugauuaaaaaagcacaaauacauuuuauuauuaauuagaaauaggaaccauguuaagguauuaucaaucuuucugaauuugaaagccuccacugacuaucccuaccauggcacuguaagagaaccaagauuuaaagcugguuuacacccggacaaaguuuuucuuuaauucuccccacuagaaaauacuguccacuggccaggcaugguggcucacgccuguaaucccagcacuuugggaggccaaggcgggcaggucaccugaggucaggaguucgagacuagccugaccaacauggagaaaccccgucucuacuacauauacaauauuagccaggcgugguggcccacgucuguaaucccagcuacucaggaggcugaggcaggagaaucacuugaacccgggaggcugagguugcagugagccaagauugcgccacugcacuccagcacgggaaacaagagugaaacacccuugucucaaaaaaaaaaaaauuacuuuacacuaaaucaagcaaucugacagucuaagaauguuucucaaugaauacuaccucuaaguggucaacagcuuugccuguaacgcauuaugacguugugugaccauaacaauuuaauuuccauucauuuuauaggugugaaugaguuuacuaggaaaaacaguuaccauuguuuccauguuucuuggaggugguauucauuuagaacauucauagacugucagauuacuugguuuaauacaguauuuuucaguuucaauaguauaaaguacaagaacacuaaugucaaauuguaguauuauuuuagugguucaucuacuauaagcuugaugacaaucaggaauaccugggaaaaagaaaaacccucaucacuauauauucucaguauagacaagguuccuggguacagcuauaaauauccagguaaggggaugacaaacauguaaauuaacccaaagacagguagaggguuuaaagacagguagaggguuuaacuagcuucagcaacaccuuauuaaacagaaacagcuucucaauucaguuacuuuccuucugccuucuaccuccuaccguuaggccagucaggugaccaacagccuuugcuagcaagaaagaguuaaguuagauugccagaucucuaccagcucuaaaaccucuaugauacugccauauacacgagggucaauucuagcuaguauacuaggaauauugagaacauccaugaugauaaagacaaauuccaaaguaaccuccccuaaaaagaauauaaugccagccaggcaugguggcucacgccuguaaucccagcacuuugggaggcugaggcggguggaucacuugaggucaggaguucgagaccagccuaggcaacaaggcaaaaccccgucucuacuaaauauacaaaaauuagccgggcaugguggcacaugccugugaucccagcuacuugggaggcugaggcaggagaaucacuugaacccaggaggcggagguugcagugagcccgcgcuacugcacuccagccuccgcagcagagcaaggcuccgucucaaaaaaaaaaaaaaaaaaaaaaagccaaagugaucuucugguagaaauaauacagauuuuauauccaugcauugccaggacagugaagguaauacagacuacauauggagauggaggaacagcagcaaaccaugugcuccccuguggacucuccacucuuccuaucugccuucuuuauacaguaucuucccuccuaaucuuugguuuuccugacuuucccuuuuccuccaaauuuuggauggucuauuuuacagaauauaaagcacccgaacagcugucucauaauaugaaacauauacuagcugucaucuaucacuacguuacaauuacaaugggaaaagacaccagauauuguaauacauuuuggacaaaaccuuucaaaagcagcaaggcaaggagaugaaaccagagaaucacuuccaacgcuguaacuuguuaacuguucuacaauaagcccaucuucauuucuagcaacuuugccaagacagaaauaaccagguuguuaucauuauacagcuugguuuacacaguagggcacccaccucuuccaaacuaaaaccaugcugugaaugauuacaaacagauucagcacaacacuagugaaacuguacaaaaccaugcccuuggcgucagaacaguuugacauaggaaugccgaauuucccacugcguaacauuagaugaguucuuccaaaauuauuaagcucuaguauuugaaccaaggcugacagaagcauagaaaaacaacaccauguuuagaccucccccaaaugccugguuuuccuuaggcuuuacuaacuucuaaaggaggcaaaaaauagaccuacgaaguuacuugugaggaccuaccuuuaguagcuucucgguuccuuaaaugaggaggaauauagcgcccuucuaaaaaaauauauauauauauaaaauuaauuaaaugccaaaaaaccuucccauuuaaauuucuguuacuaaaaaaugguucugggaaauuaaaaucuccagccuuccaaucugauuacuuaccuggacacugagaggggggaaaaauaagaaucuaauuuuaaauggguuacugcuucauaaggagaacucugaaaggaguuugauaaaaaaaagcugauuuggaaccuaauaguugaaauccacaaauugagcacauuuagccaccaguggucauuuaaugugauuuuuuuaaaggccugcuagauuuaagagaacugucaucaaaacugucaacaaaagcauuaaguauuacuguaacaauuuaagauuacucauguaacauaucucacaaucuuuuguuucuaugccaguaaguugcaaaacauacaauaaauaaacaaggaaaagcugcaaaggggaguuaauuucaaggaauugcagguuuuaauuuggggcuugcugaguuuaaggaaaguugacaguugcucuguaugcgagcaggaguacagccuagaauauggauaagcaaaaaaaacaacauaaagccaaauaaauuugcuuuauaacuaguaaacgugucauuuuucuuuuucacuucuagacugaauuaaauauuuuuaaaaaucucuacuaggacaaucaguuccuaaaagauucuuagcaugacaaauaaggugaaaguuaaagcaaacaccaaguuuuguucccagugaagcuguucuugccuaaaaaugaggacacaucauagcccauacucacuuuuguuuuaauaaguaggaagagaucugagcuaaaaauaagggucuauugcccuuauaauaaaccaccaagauccccuaucuuaacacuaaccucuaacaagucucuaaauaaccccccuuagaagaaaaaaagcaacuuuucuaaugccuuuuuaaaagaaaugacacauuugaaaaccuaaccuaaccaccaauccaaaauucaguauagucuucuguucuucaggagaaaggaguagcuauaaccaaugaaaugcauauucccuuaauucaauuuaauaaauauagucaguuaacagggacacauucccaucaccucuaaacugggcucaggauuuauaauggacaaaaacucuucuagagauaauuugauauaauaagguucuuuccaaugauuagcugcuuuuacucaagagagccagcuagucauugauguuuuauuaucagaaaggcacagcuauucgggaggcugaggcaggagaaucgcuugaacccggaggcagagacugcggugagccgagaucacaccauugcacuccaaccugggcaacaagagcaaagcuccaucucaaccaaaaaaaaaaaaaaaaggcaacgaugcuuuagauugaucacuaaguacuacauaauucuauaacacaaagacuacauaauucuuuaagcaguaaaaaauugaaaggcaaauuucuuaaauuuuacauaagcccaaugaaaucuuaagauguuaagcucuaauauucaauaaacccacaagauguuguacuuacugcuggcuguacuuccuccacucugauuaucugaagaguucaggucuaggccagcaaacuagaagagagugagaugguuagcaccccaugugcucaaauacuacauuaagagaaaacuaguccugcccucuagcauuugcuaguacugcauucaaguaguugcccaguccaccucacagggcuaauaccaacccuuaaugagaaugugacuaagaauguuuucaagucugcaaugcucuaagcaaaugcaauauuacuauuguauauacuacagaaggcggcacaccaagaugcuugugcuguucaguagaaacuguccaaauuuaauucaugcauucaaaauaaauuuucacuaacauguuccauagcacaggcucccuaaucaccaaacuaaagcuuacacugaaucucaaaauuauuccucaaugucaaauagauaaaggauucguuuuagugccgguuaugaaaguuuccaaugccaacuuuccguaauacuugauauuuuaaaccuaaaaugcacaccugaaaaaugucaggacaaauuucgaaguggccguucuuuuaguuagauacuucaucccuaaauauugcccaaguauuuuuagucggguaguacucuuaagaacaacaaaaaaauagcaauauaccuaccacuuacagaacacuauguuaagcacaacucuuaaguaguuugacuguuucguuuguuuuuauuuuuauuuuuuuugagacagagucucccucugucauccaggcuggaauucagucaugugaucucggcucacugcaaccuccaccuccccgaguagcugggauuacaggggugcgccaccacgcuaggcuacuuuuuguacuuuuaguagagaugggguuucgccauguugcccaggcuggucuccugaccucaggucaggugaaccaccugccuuggccucccaaagcacugggauuacaagcaugagcccggccugaaguaguuaccuguuuuuaccccauuuuaacauaaguucaaagaugacuuugaauaaauggcacaacuggcguucaaugcucuuaaagaguaggacaucuuagugccuuucaucucuauuucuaccuauccccuuacacugguagcucaaaagccucuucauucuagaaaaggguuaugugcuaccuucauaacguuuuauaaccaggaacuacucacaaguaguugggagaaaaaacuauacaugcaaaguguuucauuuuucucaaaaaagccacaaaagaccaagucacacaguaccgcugccaaccuguuugcaaaagaugcacuacauaccauguuuauaaaucuuguguuuaaagcucaguaugauacggccaaaccgcaugcaucaucaauggagucacugaaaacuggaagcagaugcuauacuuuuaaaaaaugaguguaagacuucaggcaccuaauuuccagaauuucuaugagcaaaaacaccacugcgcuuucucuugcuaccaucaauacuuuaaagcacgguaggaacacaaacuuuccuuuugcacuuguuauagcacaauuuugcuuuuuaaauaagguucacuguugccuagaauccuuaaaaggacacuauagcuaaauggaaaaugguaaaacugggaauacucugugcugcugguagguuguuaaagugucuguucaauucaacaugugucagcaauuagaggauuuaauauaauugguucauuaacggguagaaaaugcuuccaaaggaacagaucaauuccuaaaaaauauuacauaugacuacauuaaacuauguauucaauuaauuugugccacuaaacuucgucucaggauuauuccggaguuugugaaaucaacgcuccccuaaucacaguagacaguaguuuauuuaaaagcuccgcauaacccacacaagagcuuaucugaagccuggugccacuguugcggugggaugcagacuuccugccaccaaaguccauaaccuucuccucucaaaucacacaucuuucucuccucugccccuaaacccuuagaagaggggauucuggcuaagagaaaaaacccgggggccugggacccauugcaagauucuacuccacagauagcaacaagucaacaacaaaacuguuuacuuccccccuaagccggguguuuuuccaauggcggauuccuggaucacagucacuaacacgaagacacuaccacaacccgcgaugaccccuccaccccagaaaaacaacgcgggacucccggcuaacauaccacacagggacaaucuggggcaagcaaggaggagaaagggccucgcuggcucccuaaccuccccgccacguccaaccucuaucuccagggcccagcgcgcagcggccaauuccugccuccccuccccgcccccaccccucccccacuccuccccaaucuucugcgucacaaaacuuuccacuccggaaacgcagccuccccggcugcggcgcagggcccccggacccugcggaaccugggcugaagcgaaaaagccagcggaaggaacccgggaaaaaacaagaaacccauuccauccuccuuuccaggccuucgcccgcccgagacccgccgucucccggaggugagccacagcgccgcccagcaccacacaaaagaggccgccgccauuaccccgagcgaaggccgcccccucccacauuccugggccgcguucuaccccuugcucgcaggcacgcaaacaccgggugccgccagguccuccggacgggaauccaggcugcgccagccgugaaggccgaagcccuccaagccaaaagggccuccagucgcgucccgccgcgcugcgcacucccgcaaacccccccaggucacuaaucagucgggauucgcgcaugcgcguccccgcgagagcgcgcgcacuuccucccccuccgcccgccugcgcacgcacacacaaaagccgccauugugcucgucccggggacaauacagcgggccgagaccgggcccgggcgacagccccaaccaacauuccuaucccucuauagccccggggcacucacacccgccagcccggggcacccagaaaaugaaaaguaagggugccgguuagcgcugcgccauuagccagguuaggucaggggaggaauucacgcagcagccagcccggugggguucuugcggcucaccugcugguccagcccgagcgcauuuuccacugccacaugacucaucccugaagaguaccgagaacucggagucuuccgcugcuaagcgaguguuuguuccaccgcgaaggcccucucacgggagaacugcggcucug

SEQ ID NO: 21570 - RNA, 4230 nt, Homo sapiens
cuauuacgucccagcgucugagagaacgaguaagcacagaauucaaagcauucugcagccugaauuuugaagguaaguaugaacaauuuauauauaauuuacuuggaaaguagaacauacauuaaaugaaaauauuuuuuauggaugaacuucuguuuuuccuguguuuuaacacuguauuuugcaaaacuccugaauuauuuagcugcuguuucucuuacaggaguguguuuaggcacuaagcaagcugauuuaugauaacugcuuuaaacuucaacaaccaguaagucuucaaguggaauuuauuauugauucuuuuauguuaauuuguuaggucaaaagaaaaaucuuuagagcaaaauaaaaguuuugcucuuuauuaggagguucuuuagauauuacacuuuuaauuggguagcuuauuugcauguauuuugaaacuaucuaaaguaaauaguguuuccuuuguaugcuuaucuuuagcuaauguguuuuuuuuuuugguuuuaaaauaaugcuucuagugaaaaaaaucacaaaaaccucaacacuguaacguuugagagcaacggcuauucaguucgguuaaaccgaaaagagagaaaaagaaaaaugauaagacuauaucaugauuaaucauugauguucauuucucauuucacugagcaaucuaaacuacuucuacuugaaccuaacauagguuuggcuguuuuuuucuuuaucugauuuaauugaaaauggauuguuuagauauuaaauagaccaaaauuagauaucuauaucuaaaacuaauauucucuauuaaaaggagaagacuuagaaauauaaauauauuucauaacuucuucuuaacuauauuauuauugugaaaacaauagaaaaguaaaacuaaaggaauuauuuuuaauuauuaaagacaaaccaugauuccccaucacaauauguuccuuuggcauauucucuuuuaguuuuuuauauacuuauuuuuuccauugcuuauguuacuuauauuuuccacagcuguagugauuuguauguaauuaguuacuuaaauagagcauuucucuaugcaauagcaagcagcagugugguuucuagaaaguauacaaacagagauauaugcucaaguguuuuuugaaagauuaacuuuucuuaccucuggguuucuuauuuguuucacacauuuccugcccugacuaaucuuuugaaauauuaauuuucuuuaaaucuuucaaaaacaucauagaaaagaugggcaaaagguaguuuuauucagaacuuugaaucucugaaaugucuuuuuucuacuaucaggaaaauuauuucuccuuuuucaagagguaaaaugaauucuuguuuuacaagccauggcucuguuucuuaauguuuucuauaaucacucacuuuuuuuuugcuuuugacaaacauucaaaaugcuaaugauucaaggauguccucagcucuguauguguucuaagaguucuauguuuuuucuccacagaaggcauaagaacuaggagcugcugacauuucaauaugaagggcaacuccacccuugccacuacuagcaaaaacauuaccagcggucuucacuucgggcuugugaacaucucuggcaacaaugagucuaccuugaacuguucacagaaaccaucagauaagcauuuagaugcaauuccuauucuuuacuacauuauauuuguaauuggauuucuggucaauauugucgugguuacacuguuuuguugucaaaaggguccuaaaaagguuucuagcauauacaucuucaaccucgcuguggcugauuuacuccuuuuggcuacucuuccucuaugggcaaccuauuauucuuauagauaugacuggcucuuuggaccugugaugugcaaaguuuuugguucuuuucuuacccugaacauguuugcaagcauuuuuuuuaucaccugcaugaguguugauagguaccaaucugucaucuaccccuuucugucucaaagaagaaaucccuggcaagcaucuuauauaguuccccuuguuugguguauggccuguuuguccucauugccaacauuuuauuuucgagacgucagaaccauugaauacuuaggagugaaugcuugcauuauggcuuucccaccugagaaauaugcccaauggucagcugggauugccuuaaugaaaaauauccuugguuuuauuaucccuuuaauauucauagcaacaugcuauuuuggaauuagaaaacacuuacugaagacgaauagcuaugggaagaacaggauaacccgugaccaaguccugaagauggcagcugcuguuguucuggccuucaucauuugcuggcuucccuuccauguucugaccuuccuggaugcucuggccuggaugggugucauuaauagcugcgaaguuauagcagucauugaccuggcacuuccuuuugccauccucuugggauucaccaacagcugcguuaauccguuucuguauuguuuuguuggaaaccgguuccaacagaagcuccgcaguguguuuaggguuccaauuacuuggcuccaagggaaaagagagaguaugucuugccggaaaagcaguucucuuagagaaauggagaccuuugugucuuaaacgugagagcaaaaugcauguaaucaacauggcuacuugcuuugaggcucaccagaauuauuuuuaagugguuuuaauaaaauaauaaaauuuccccuaaucuuuucugaaucuucugaaaccaaauguaacuauguuuuaucguccagugacuuucaggaauugcccauuguuuuucugauauguuuguacaagauugucauuagugagacauauuuacaaccuagaaguaacuggugauauaucucaaauuguaauuaauaauagauugugaauaaugauuuggggauucagauuucucuuugaaacaugcuuguguuucuuagugggguuuuauauccauuuuuaucaggauuuccucuugaaccagaaccagucuuucaacucauugcaucauuuacaagacaacauuguaagagagaugagcacuucuaaguugaguauauuauaauagauuaguacuggauuauucaggcuuuaggcauaugcuucuuuaaaaaagcuauaaauuauauuccucuugcauuucacuugaguggagguuuauaguuaaucuauaacuacauauugaauagggcuaggaauauagauuaaaucauacuccuaugcuuuagcuuauuuuuacaguuauagaaagcaagauguacuauaacauagaauugcaaucuauaauauuuguguguucacuaaacucugaauaagcacuuuuuaaaaaacuuucuacucauuuuaaugauuguuuaaagguuucuauuuucucugauacuuuuuugaaaucaguaaacacuguguauuguuguaaaauguaaaggucacuuuucacauccuugacuuuuuagaugugcugcuuugauauauaggacauugauuugauuuuuauuauuaaugcuuugguucuggguuguuuccuaaaauaucuggguggcuuaaaaaaaacucuuuaacuuguaauaaacccuuaacuggcauaggaaaugguauccagaauggaauuuugcuacauggggucugggugggggcaaagagacccagucaauuacauguuugguaccaagaaaggaaccugucagggcaguacaaugugacuuugaaaauauauaccguggggguaguuuuacccuauaucuauaaacacuguuuguuccagaaucuguaugauucuauggagcuauuuuaaaccaauugcaggucuagauaccuccuucucagcacuauuaaagcuccuaaguuagaggagugccuaaaacugaguuaccuaaaguuuacuuacauuaaaguaugaauauuaauuuuagaaauuugagacuuuauucuguaccagcccuguauaauaacagguuaucuaggaccuuccucugagguaggucuaaauacugaucucugaggcggaacuaacguuuuggggacucagcaucucugccagguuccaggauuauagacagaagaguccugucauaccacuuucuggaaaaguccuaauuucauguaauccuuuuauuuucaauaaaaacaaauagcuaaauguauaaccaacuaugauguuauguuuucaauaauuuuguaaaacagcucauauaaauaaaauuuuuaauuggaagaaca

SEQ ID NO: 21571 - RNA, 449802 nt, Homo sapiens
cuggguagcagcacgucucuugcuccucagggccacugccaggcuugccgaguccugggacugcucucgcuccggcugccacucucccgcgcucuccuagcucccugcgaagcaggauggccgggaccgugcgcaccgcgugcuuggugguggcgaugcugcucagcuuggacuucccgggacaggcgcagcccccgccgccgccgccggacgccaccugucaccaaguccgcuccuucuuccagagacugcagcccggacucaagugggugccagaaacucccgugccaggugaggaggggucccuugagcgugccuagcgcccagcggggagcaaggcgcgcgugguggcuguacccugagcgcgcuagccccgccgggcuguagucgugcgcccugcagcugggcacuugggaguggucggugugccuggggccuggcugggucuacugagggagggagagaggguguguguggacggagcccacaucccccagucucacgcugcugucagggaaggugugagcgggaggaaccguggggaucgccuucucgugagcgcccguuuuuuggaagggcgagaaggugggagcuauuuucccgggucucugcgaacuggcgccccacagccgagcuggugccucaugaauuugccauccuugcucgcacauacgugucagaauuucagccuuagcuggaccacagcuccagccaucccuuccccaacguacccccaccccccgccgccuuuacccagccuggguuuccuaagcucacgggcccaagugcaagcaaaguugaggacagauuucugagucugcaguggcgggugaagacacacugaggcaaacuuuugaguaagaggguccccaaaaugaggagacugaaccuuuuccuucaaaacagcaucccuuauauagguuagcgaaaucgcuuuaaaaccggugcugcuggcccagggagcaggaguccaaagauauuuaacuccucccccucccaaauucaucugccuucuugacaggcuggauccuaaaggggagaugauuucagguggaggaaaguuucugaacgccugccuuuuguucugcacaaucagaucgugccguaacgacguauuuuaacaucagccgagggcugccgcugucaacagaugaauauuaauggcccugcgugauugacuguccagcgguugggcuccuaacgcccgccuuagaauccaauuagaccaaauugcuacacugacaaugcggacaagaagagucgguuucaaacagguuaauuugucaggggugcacugagaagaaacggccaguuguauuccguaaccgugagacguuuguggccuccagggucucuucucaacucaggcauccagugaggcgcgcgucccgcgcuuccgagggaucggggagcagcccuagccaaaacuuggcugguggcucucaacaagucauggaggcgggcccgaugguuggaccaaguugugaaugcggaugcgcaccccgugggcgcugccagccaggguucacugguaggagguuaccuaggcagccagcgcgcccucagccuuuucuuuagguugaugaaaagagccgagugagccugcuguuuaguugcaaagguaauuggucacccuuuuuggugacugaaaugcauuugcgcauauguuaaauauugcuuugcaggauuucgcucuaagggagggucgaacuaccucauccccuguuaaguguuaauaauguaccacgugggcaugugcaggagcuguaaggggcaaccuaugaaucaguuccacagaacugaaacaacuggccaaucucucuccccuggaagugccaugguaauuagauuguuaaggcuagagaacaugcuuuuguugguaauguaaaaauugguccucacaggcugagcacccacaagaugaauggguccaggguugggguuggggccacauuuggcugauucgaagccaggagguaaagguggugcccaaaagaagaaaaaggccagaagaaagcacagauagucauuuagcaaccccccucuacacacacacuccugcaggcacucgcccucccuugcucucccccagcucucuggcugccugccucuuugcagcaucuguauaaaaguauugggagggcccacacgcuguguguaugagauuuggccugggcuccuucccucccuugaggccuagggauggccauacacuuauagagaagagggacuuguaauaaagauuuuucauuuuccucuacuauuucacaaacucuauaggagaaaucacuuuucaaggguuuucaucauauaaacccaacguucccugcuuuaguucuauuuaacaaacacaaacacuguugagcaucuucuacauggcaggcacuguccugacuugcacuggagccaagccaaacuucaaauauggugauccccauacagcuaccauuauauauccuggauuuuccgggggcagugcagguuucuaauacucuguccuggcaugaaacugcguguccugaauuuuagugggacaaauauggucacuguagauauggaaaacaugaaaauccuaauguucguguguggaaagagcucaucaguauuuuagggaagagacaauaauggcagacuaaauacaaugguaaguguauaauuucaaagugaauaaauguauaauuugcugcugucguucagugguuggaaauugaaagagagcugaaaauuauuugguaguuaugaaccaucaugaugaccgcuugacuuuccccccucugcauccauauuuuaagccauguucaguuugccugcugcacuauauuaacugcauuaaagcuuucuuugucccagaucaaaugagauucagucacaguaaggagaaauccucaagaauguccuguuucacuuagggggagcauuugggauugacugcuaacuucagccauuagcagaauuggguuagccugaauaagguacauuucuuaugcuaauauggaugagacuaaauggcauuugagaucagccagccuaaaaaauaaaucacuggugcugaaggacuacacuagacuuccacaaagcugaucuaaagccuuacaaucucauguucccauuucuuuuggaguguucaagucacaggauagcaguucuaaauagcauguccccaaaauccauagaucucuucauaccccacuuauuuuuuuaaggauuuguaacuuggaaagcaccacagauggaaaccaggcgcacagaguuagcauuuggcagaaaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaaggaaagugagcuaguaaucagacaaugauguuuccaauugucucaagggaauguuacagaagucuggaaaaaaauuccucuaaacaaaaaucaaguguaauucacuuuaugaaugccauacaccacuuuugucgggggagggggguaguguaagggauggauggaaaugagaaaaucaaacaaaccgugguaguguugcaacucccaaaagauugagggaucuugccuuggaaggccuuggaaagugcgagaaccaauccagaaggccaaaugccuguauggguaaaaggcagucuugaacagccaaaauugacuuggaguuucuugaaauagaugaaacaacauaaaaauaaaaagcaaugugcuugaaacaaagagauaguuugguauuuguuuuuguuguuuuuacugugagaacuagccuccguaucuggguugccagcugcgguuccccaauuaguuugaagcaguuagcgguccuaauguccagagagagaauaauaagugagguguggaaggguuuuuucucuucugagauugcacgagacauuugggugaccaggugauuuguuaaaacuuugaaacuuugaacaauacaaaaaacucuguauugugugcuacuuggaacaguuagagaauucuuucaaauguggucugaauaguacacgaauccugauacugauaccaagcugugcuuagagggagccaucaaucugauggaggacauggcugaugauugguggggcaccuugggcugaaaggagucuaacacugccaacuccuuggcagccucuguaauaggugcugggguugcagagaggagugagacacaaucccuuuugucaaggagcucacagucuaguggggaagcauacaaguaaacaggcuucccaggaaacuuguaggauuaaaaagggugaaaagggcuagaaaauaccuccaggaaauuggcugaaauggucacaauagccagccugggcaagggaaaagaacugaagagaugaagugggagauagggagaagucucuuaauagggccgccaucuuaaaaagaguuucuuaauucuuggagcaaauuccauuuuggaagcauuaggaaauacagacauaagaagaauuuuaaugguugcuaaaugacgcagauggcgucaguuuugcaauguguuuuuuucuuaugggcugguagguuguauccaauauuuugaugcaauauuuuugagcauucugcuacuuccaucuuuagaguugcaauguuugcuguucacuguagccuagaaaaaggcggcuuauuacugaucugggggaaaagaguccuggauuugucugguaugagacaagacagaaaauauguuuucucccuaaaugacagcuaucaaugaccacgccaacuucaguguuugaugcauauacaaaagcaugggucuuaagaguuaucuuauuacucauuucuaagaaaauugaagauaaucacuuauaacuugugcacacgauacaucauuuggaaagaauuucacuggggaucauguugcucaacugaaaaguucuggcaugcugaauuuguacauuuuuuugugaaugcuuccuuuuacucugaucucuagcuuuuuuucugcauaugguuauuuguauguuuuagauuauaagccucuuaaagggaaaacacugcauuugagcaguguugagcacaaggccauacagcauuuaguaaauaauuuacaaaaacagaauuucuagaucauuauguguucccuaugaacucucacauacuuucuuaagccauaugucaucuuacauauuuuaaaagccuaaguccaaauuguuacgauacauuauuggggcauguagacaaacuuuucagccuacauauauuuuggcuggagacagaugcaggcuuaccucaguuagcuggcaacucuuaccaucaguagggcuuauuaaauuuugaguacccaaauaacaaauugaaauuagcagcauuguuaugacuggcuuaguaucauuaacgaucaacaauuauuacagcacauaaauuguaggacaucucuuaaaucaagcccucuuugauuuauugucagcuagaccuuucuugcuaagguugauauuaccauauuugggaguugagcuauauaacacaugcauggaccuguugaaguaccucacagguuuuuguaaccugggaucagaacucguguacagacucaauucaagagccuauuccaggagccaaugucuauucaguccuagccaaucuuguaaauggguuagauguuuuugguaaucugcgaucuaagggacagugugggcagaaaaaucucccacucaucugcccauauuuagcaaauugucuggcuugaaacaggaucccuggcacuccauuaggaaaugagcaucagaaaauagaauccaaguuacaggccccagacuggcuuuagagacagcauaaaguaaugggaauuuaccuucugagacauaaugacagggagaaugcuguucaaaaaucaaggugaagguggguauaucagcagagaaaaugcguguuuugaaaugcuacguguaucagggggugguggugagaaugcucauuggaacauuguagccuuacuugaauaucuuguugaauauacaaaguaaagaagauuuaguucuguacuucuaauuagggcaauucaagaucaauuagacaaguguuaauuauuagaaauacuuguuugcaauuuaaaaaaaugaaucaagauugauuacuaagagauucauuuuucacuuuucccucuuuuuguguguagcuggacaaagccuaauuugagaguuuguauuuuuccucaugaauaaaaggaagucaauguuaugaccaaagugcauugcuaguguuccgaacaguuaauuacuucuaguagcugaaauuguauuuauaugcuagauuaguaaaucuacuaagcucuuugaagcguacuuaauaggcuuauguugauaaauaauugauaggaaggagauaaaauacaaguggaaguggcaauaagaagggaagucaaaagcuguuauaaaagaaacuuccaccguccagccaucugaaagcugaaaaauguacaugucucaguagaagugauguuuuugaaaauauucuguauuuuucaaaauuuccacagugaagcauauauuuauuccuuauaaauccaggagaagguacaauuuuagaguaaaauuuuacauggccuuuuugucugccuuuugcaacuaaguuuauuacuggaaaauuagaaguccccauuauggcaacuuugaaguucauguuucuaaugauaucuucccuacuagacugugaucaucuugagguuagcggcuauauuuuauucaucuuuguaucccagugucuagcacaguacaggguacaaauaauagguacucaauauguauuuauagacugaaugaaugaacggaguuagaaauguauuacaaacauaaaauuuccauaaagucaauauuuaaguaguugauuuauuuuuaccaauauacuaagguuuuuaaaaaaguaaccaguuuuuuuuuaggucaaaaauccauuuguuuucuauagguaagugauaaaggauauuaguuuaauucauuuggcuauacuauaacucucuggaagaaguagacuaguuaaaucuuauaagagguaaguauuuugugcuuguuuauaaggauauuauaaguaauuucaagacaaauugaagauauauuauacauguauguauaaaugcauaugcuuaucuucaccuuacagaucugugguauuuagguuugugaaaauaaugcaacuuggugccaguuacggaaacauacacugaauguauguaaguuuuuccucaguguucggcauuucuuaccuaaggcaucaagcuucauaaauguacauuuaaaaggacauaauccaggcugggcauggugucucacaccuguaaucccaacacuuugguaggccgaggcagggggauugcuugaggccaagaguuccagaucagccuggccaacauggggaaaccccaucucuacuaaaaauacaaaaauuagcuggacauagugguacauaccuguaaucccagcuacucaggaggcugaggcaggagaaucgcuugaaccugggaggcagagguugcagugagcugagaucauaccacugcacuccagccugggcgacagaggaagacucugucucaaaaauaaauaaauaaaauuuaaaaaaggacauaauccaaagugaauuuuccgccauggaaauuucauuuggguaggauaaagggccucaugagaguucucuuaauuucugucugcauuaggccaaacuuucaauuaguugccuagguaaacuaauugaaaguugaugggaaguucuuucaaauauucaaauagaggcccaaguaggaaaaaggauaaaaaacgaagggaugauguucauuugaaaacaaaaaucagaauucuauuugcauacucuucuccuuaauuauggcucugcucccucucucccaaacccugcauaucaguacuuacaguguguaucaugucacccugggauucuucauugcucuuugucaaacuuugguuugaaugauugaagcugauggaaacauggugaagggagaaagaguuagagugacagauauagggaggaguuuaaaagccuucacuugguauauauuagaaaguuagcuggcauacgacagauggaaaggauuggaaaauauuugaguauggaaauuugcaugugugcagagagaauacagaaggaugucccaauugcauuugguucagagaaauacuuuaucuguacuucucacuuauuauccauguuuuuugaaauauguagcuuauucauggccucuuccagacccuaugcuuauugaaugcagggaccauguuugauucaucaugauauccucuagaguggugaguagagugccuuguacagaguuuuuaauggauugauuaauuaguuggaaugaauguaagaauaaacaccuaaagacauagucuagagagcuugaccacuguccagugagauccugggguggcauauaacuauagaacauugauucucugaauguaucauugucuaaacuaauuugcagcagagacagaagggguggugaauuugaagcauauuuauuuauucucauuggcccugggagccuuguugccccucauuuauuuauuuauuuauuuauuuauuuauuuauuuauuaucauuuuuugagacagagucuugcacuguugccugagcuggagugugguggcacaaucucggcucagugcaaccucugcuucccagguucaagagauucuacugccucagcuacccgaguagcugggauuacaggugcccaccaccacacuuggcuaauuuuuguauuuuuaguagagauggcguuucaccacguuggccaggcuggucucgaacuccugaccucaggugauccgccugccucagccucccaaagugcugggauuucaggugugagucaauuuugcucccuggcgaguugccccucuuuaaaacuuacgauugaagaggagaugacaaguaaagaaauauuuuuuaacuauagcuuuaccuaagugugguguuuggauauguuuuauguauuuauauucauagauuuuauguauguauagaacgauuucuauuauuuagacagcaauaauuaauaaauauuucuguuauuuaaacuguuugaaaguuaauuguuacucuaagcaguaggugguauuucacagucauaccuuacauuugucucaugaaagccuugcuuucauauaucucauguacacacaaggcaaccacucauaaagugucugucacuucugacuuccagcaaccugccugguuccagcacacauacacacacauauuuguacacucauauacacauauauaauaucccuacaucuuuaugccuuuaauaaucuagagacuaagccuaauuuuucugggggagagcuaguggguacagcuuucagagauugaguaaaccauuuucaguuggauuggccugaaauuguagcagagcuaaucgucacugauaucauagagcuaccacucuuaaaaucaaguuccaucauuuccccaaguacacagauguuauccuuguuaaguagugacagucaccaauaaugcuaauuuggcccacuuuggagaacuacuucuagcacuggcagcuuugcauguugagugccauagaaaugagaaugugacccaagaagcaguuuccagguuagguuucauggagugauugcacugaggaccacaguuaucuguuuuggaaaacagauggaaauuugcagaaaaggaacucacuaauaaugaacuuuauaugccauuucugcauaaauauuuaaaaguuuuuaaaauuuauucuuacuucaaccaacauuuauugagcacugauacuaugccagguacugagcuaggagcugaugaacaagauaaaaucacugccagcaaggagcucccugccuagagagggauccaggcaaggaaaaacauagaugccaaggcagcaugacuguggccugcuauagagcugggcaccauguggaggccugagggcucuugagcuauggaggaauuugccuaguugucuuaagagggcugaguucaaggcugcagugagcuaccaucauaccaccacacuccagccugggugacagagagagacccugucucaaaaaaaaaagagggggcuuucauguaaagcauguacaaagguacagaauuaagaggcaaaaugacacaugacacauuuguuggacuggaauaguugggauuucuuggagcacagauguggaaguggagugaagaugaauuagaaaaauaggaaaugcugaggaguuuggguuauacccaaggaugaugaggagccuugaaaacauuuuaagaagggaaacauuauucaguuggaggaugacuggagagugagcgguggcagggaguuuuaguaacacaggugauagggcaggggaccauaaauaggagaauaaaagcuaaacuugagagaauagagggaguagaauagacaugacuuagugacuggauaugaggacagaagggagaaucuagaacuuuugguuuuucugggugguggugcuguggcacauaauaggugcuugguaaauauuuguugaacaaaugagugugcuugaaauauaggaggaacauguuuuuaagggcugaaauaaucaguuugguuucaaacagauugaguuugaaagguccuuugaugauggagguagaaaaugucugcuagguaguucaaguugcguuuuggauuacaaaagagggagaaaucagggauggagauauauacuuggaaauuaucagcauauagaugguaauugaagcccugggaacagaugaguucacugggaaagaguguauauauucuucuggaguuaaggagaagcacauaguugggacucaucagcauauaggcuuaaguuggaagucgugaguguggaugauauuuuccaggcuuuugcauguggcauguauuaaaauguauuuugccaacaucugaugauuuaaaaaaaaaaccugccaaagacuucaagaacccucuugauuaagagaaaguaugaguauauguugucaugauccaagacucugcaaauaagauaauguacuaccaaacacacacacgugcaugugcacacgugcauacacacacaucucuauguagaggaauauauuagaaucaaagaaucagacuucuauuauucuugauaguaauaaugaauaauuaugcauguuauuuaaauggaaaggcuggacaugguggcucacaccuguaaucccagcacuuuugaaggcuaaggugggaggacugauugagcccaagaguucaagaccagccugggcaacauagugaaacccugccucuucaaaaaauagaaaaauuagcugggcauaguggcauguaccugcaguuucugugacucaggaggcugagguuggaggauugccugagcccagaggcagagguugcagugagcugagaucacggcacugcacuccagccugggugacagagugagacuuugucucaaaaacaaaacaaaacaaaacaaaacaaaaaaaacgcugaaaguuauuagcuguuacucuuagcaguaggugaucuuucacaaucacacauuacauuugucuugugaaagccuugcccucauauagcucacguacacacagugcaaccacucguaaagugucuguagcuucugaguuccagcaacuuuagugguuccaacaugguggcuccucugucccucccccagggcaguacuuucccaauguaaagaaugaaaacuguaacaauauguagcuuuuggagcucuggucuguauucugcuucagacuuggcccugauggcuggucucugaaacaugugguuccaaguaaacgcuaggaauacuuguguaauugggcugaucuuucauaagugucuauggagauguauuauuuuuugguuuagggguuggggaggguuguauaauuuucuguuucucuggcauaaaugguuucuuucauuucucuguuguuuaagagauugccuucaucaguguuucuuucaacauaagcuugaaacuccuuguauuccaguugauuuuuugacaccacuuucagguugguggaauaguuuagaaggaccacgagggaagauuauggaaauuaaucuuuacugagugccuacuauaugucaauuacuuuauauuuaaccucucauuuaaucaacacaggaaaccugaaagguagguggugucagcuccauuuuacagaugaagaaacugaggcucagaaagguuuacuuacccaaagguuguguaaguggcggagccggaauuuucacccagguuugucuuacuccauagcucaugcuguuuccagaauaccuacuggaguaugagaggaagggauauagucuggauauaaaguauuugacuuaaauucccauacucugucaacuucugugacacuguguacucuggguucccuuccuacucgcuucagucuuugcuuguuugcccucuuccuccuacacuuuggauguaagugucccaguaguguuugucuuuugcccuuuccguucucucuuugcuuauucccacauccauucccaugacuucauuaucuuugcucuuugaaugauucaaccugaccucuuccuugcucuucagcucaguauuucccaguugucugcuggacauguccaucuggaaguccugccagugcuucauuuucaacagagccaaaaauuaguccauuauuuucuuuucccauccacacaaaccugccucuccuuaacguucuauauuucuggugaugguaucucugucuggcaccaacucgaaaccuugaaauugucuuugauuucuccuuuuacccaucccacacccaaauuaagugacuaaaucuugcaagucuaccucugucuauuaugucucucacucuuauggccuuggcgugcaugcccucuauuuaaguauaacagacugagccaaugaaugagaaugugauauugaaugggcuagggagagccaguaggaucucugcucaguggcuaauaauuuguaacuaguuggaaaguacugccuuugcugccuuagauggguagaaccucuagucuuggccuuggcuuaauuuaaugugaccagaggcagcuaucuccugagaucauuuggcucuucccauagggaacuaaugguuucccacuuuuucuuuugcuggcauucugggguauaucuuacuuggccaucuccagaagucagaguggaacuauugaagaguuucaaagagcuguggaagaacugugcucaguguuucaaauaguccuuucuguuuucagaaacagguuuucugcuuuguuuucaaacuucaaaguuuauuucugaaauaaaggauuauuuuccccaugguauucugaagguuuuauacaaguguuaauuucuaaaaccuaagucauuucuuggcuuuaaaacuucagugcugugggucaauuuaauaacguugccugaaggguuuuuuggccuucaaaagcugucagauugcuuuuucuuuguucuuugagaguguaagguugccucauuuaugaagcuugaaggagauguuggaaccagcauuuauucaaucauucagagucuuuucccaacaauauccaguuuuagcuucaaauuagauccuagugguaaugaaauuuacuaccaacuaauaauucgggguaaaauggguaagauucuugaaaagcuccucaacauuucauagaguagugauaagaaguagccuagguuacucuaacacccacaguuaaggggaacaacggauguucugugcacucucaucacagcccuccuggggcucaauauaccucugaagcuacugagggcccuccuucugucuguuggacuguucuccgcaucuuccuuucuccccuuccuccuacccucacacccucucucaacugauuauaauuuagaacagaaggugcuuuaugguuuuuuauauuuauuaaaugguuuuguuucuuguucucucuuaaaaaaaagaugaguggaauguuuuauauuuuccucugcauuuuaguuuuaagcuguguuuccuuuccccguagcuucugauuuccaucucuccucucucuuccuccauuuuccucugccuucuccacuucugucuguccucaauggagagaaaacaggcuuucaauuucugcccacauauuuuauuuggguaccugguuuacuuaucuugagauauuguaaaauacuauucuuuaguuugaaaaugaagagcccuaaaauauacaccaaugaauuuacauuccauuuucuaagaacugaguauuuaaaaagcuuucuauacagauagaacaaggcuagaugaccugacuuguguaccucagaucauugcuauguaguuuacauucugucucaccuugucauaacucucaauaaaugaaaauugcaucuuuguucuuagaaaucucuuuucuuacauugaaugcuuuccuuuuuucugaagauaagggagccccuuugaaacagcgcuaguguggguuaaaacugacaccuaccuuguaagcuaaccaaauuauaaccugcuuuucccugaugaaguuaucacacuucagggacauuguuuugcuugugggguuuuauugucccaguuucaauuuugacugcagguuagagauuguauuccaauuggacuauuccuugguauuuuuucucuuugucuuuauacuuauggggcucuguuguuuguccuguaucuauuaucucuuccaagcuuggccaagguuguuagguuaugcacuuauguauaaauauuuaacaagauaaguuagacaaaaugugcuugaagacauuuaagcccuguuccccaccuucccaccaccccaccccccagcucauuuuuuugcauagagucgcagauaguugcuuuaucucagauguuuagauuuggaggacauuccuuugcacuuugcuugauggacacaauuaaauggaagccuuuuagucaaucuugacuaccaaaauaguagcaccaaguaacagauaacauuagguucuucuuccuauuuuuuuuuuuuucuaacugguuauccaaacucccuuaagccagagaguuuuagguaugagauuguguguuuuuuaagaaaauauuacggauaaagacuaauguucucaagucaggaauaacaauuaguaccauucauuaaucaggaggcauguuuugacucuggguccuggcuaggaaauauaaacugugaaagucacacauauauaugaaccucaagcaaauuuaugacuugucagccuuuuaagguuaaauucuuaaccccagaucggagcuggcuuuauauguggagcccggcacauuccucugggccacugagcacgccccuccccagcccuuugcuuaacagcagcuaguggccuaaugagcaagaaggauuucugucucuuaucagcugccuaaacagcaacaggaaggcugauauacggaguacaggucaaaaccugaguucuugaaccaaaaagcuacaaggucaguuuaaaacucuagauaugugguaccgcuauagucaucaauaccugucaguaaaggaguuagacacuugaguucaaacaaauaguaauaguugucaaaaguaugaaucgucuaauuaauuuugcuaauaguucuuuccuucuuuguuuaguucuuuuagaaauagccuucauauacucuuuaaugagcuuuuaguuugugccuggagguuguuauggucguguaggaguguuugauugucaucuagugaugaugauggaggcgaggauauuuauauuuuggcccagauuuuggaaggggcugccaaauaaagguaaauagauaucuacuacuauuuuuauuucuuuuuaaacugggguuuuuuugcauaugcauucaacuugccauggagucagagaaaccuuugugccuccucauauugcacucagauguuuuuuuuuaaaggagaaauccucauugccuguuucuuagaugcacuuggaauccaggcucagauucacguagaauaaauauuuuaggguauucagugcccaucauagugaaagccccuugacuuucaucuucugcauuugcauguuuucagagacaauaaugaaaacuuuuuuucagauucuguuguguuauugaaaauccuauuuacauaaacaggcauuguuguggcuuagggaagaauguggggucccauucuuuagcuccuuguauaucuuugcuaaggcucgucuaaauagaaguaaugacgcuuuagucuaagcagcuuuucucauuuagguaagcagggugguuugaaauuucaguuuacuggauaauugagucucuucuucuuaauuauuucaggcaugcagguugcucucuuuauaguaaagacccuaaaaaucuaguaaucuccucaggcauccauuugguaauaaaguccugugcauuuucagggguuaauuuucaugacaauuguguguugccgcuccacccccaccccugaagaaauucugcuguuuuagagccuuggucuccucacaguugcaaaaacacacuuaaaaauauauuaggauguugcuggaauuacuggaucuagaggacauuuaaauguauucagauucaugcucauuauacaaauuuaauuuaggguuuuuaauagccuuguuauauuucuuggaaaaucaugugccugacuuugccagacuugguuuucugcccugaaugaaaaauggguaucagugcaaaagugcagccuaaguauccccuauucuauccuuuuucucuucuuaaaaaacaaaaacaaacagaaaaaacauucacagaggucaucuggugcagugaggugggaaaaacuaaaaaggaaaaaaaaaaaaaaagccuagguugccuucacaucugcuagucauucccacuagugugacuucaauucagcaaguuuuuauugagcaccugugaugggggcggugcuaauaaucguuaacauuuauugagccaggcacugugcuaagcucuuuaugggcaacauccuacuuaauccucacaacagcacuaccagguggauagcauuguuucccccauuuuacagaugaggaaacugaggcuuagagagguuuaaugacuuguucaagaucaaauagcuaugaaauuaaucaaacccaguuagucugguuccagagccauguuccuaaugauuacucuugugauggguucagcauuuguaggaauuacuccucaauucaguuuugagaacccaguaugugugagaugcuagggauucaaauucaaauacuccccucucccugcucuugguaggagaagcagacauguagacagacgacggccauguauggagugguccccacguugauugagggggaaagaggaagaaaugggaagaccaguggcuugaaccugugggaaugcuacgucacgaaggcagcccagcagccugggguuauagguauuucuuuuccuguuuggugaaggucauccuuugaguugaacugccucaaugauuguaucaaccuguuuccaucauugccucaacccaguguagcaucagcuaccuugaacccagcacuccuaagacaugcauggucagcacaguuugggccaacuggccucauagugucaccauuucccuuucaguuuucccuuaaaaaguaaaaagcaggcuggacacgguggcucaugccacccagcacuuugggaggcugaggugggcagaugacuugagcucaggauuucaagaccagccugggcaacauggcaaaaccccccaucucuacaaaaauaaaaaauaaauuagcugggcagggugcugugcaccuguaaucccaguuacuugggaagcugaggugggaggaucgcuugagcuugagagguggagguugcagugagccaagauugcaccauugcacuccagccugggcaacgggaguaaaaucuugucucaaaaaaacaaaacaaaacaaaacaaacaaacaaaaaaacuaaaaaauaaaugaggcagauauuccugaaccaaacugcuguccucucaagagcuggugguuuucugaagacaaguuauauaagacuggcaagccacagggagacucuggauccaggcuugguucauuccgcuugaucuagagcccuccuggugcuaccucuuggagcccacacugggaucuggagaucucugugucugaaucacccacgauuugaugggagaaugaaguuacucuuaacuguuuuugaguuuuucacuaaaaucauaggaauggaagggaaaucuccaaaucaccuguuuggauaauuuauuuguguuuuucauagcuccugaagaaagcaaggaguaaaaaaguuauuacugagcaucauugaaaaaucuuuuauguguugcauucauaaccuaauauuucccucaauuuuaggaaacauuugguucagagaaaagugaauucacuaauguacguguggguguuuuggaaacaauguccucuagcuuccagugucagcuuaccaagaacucuugugucuccaaguuucuuauaguugcucugcagugcuuugcuugccaacucuacuccugugcacuuucuccuccauuaaaucucuuccacagcaaaggguugccaccaagucuagacuuuaguaacaugcagaaggagggugaauuagugaggauucugauuugcauuacaugaggguaggagaaggaggaaaaucuauccuucccaguccuucagauacucaaguucuaacacaacacuauguugaagauguauaaaauuacuggagcauuuacacagcuauuccccaagauggcauaaaugccacagcacuagagcacguuaguauagacacucggauaagcugaagaaugggaaaaaggaaaagaucaauaacagcgcuucucacucggggaucaagagugaguguuugauuuucuuuugguugcauuuugcucaggugcaguguguauguuguacuaacaaggcaacugauuccuuuuuccacagguuccuaucauagggaaaggggaaagauauaauagagggcacggauuauuuacaguggccgagaauguaauuacaaggcgcaauggcuugaaacugaaauuuaaguuagcuauuagagcugggagaagcaucuuaacaguaagggcaguugggcauuggaaagauuugccugggagcuuguuaaacaacaucuccaggaaugcugaagaccaggaugggggaaugugaagaaaagcucauaucaaauucagaguugugcuggaggcccagacugaucugcaucuuucauuauugccuagcucccuuuaugauuauucaauugcuaauagcuugaaacaauuuuuuucauguauucaaaauaugccuaauuugguaagcauaacaaaagaaaugccuuugagcagugagaaugaggcuuuuagacuggucugagcauucuucuaacagacuuucuggaauaugggccaacaacggagacaauauuauuaguauuuuuugcuucugcaagacuuuuuccuucuuauuauaugggacuauugcuguuaaaguaguauucggccucuauuaauauuacuucuucaaagcugaccuuacagaaaauuugguuuuagucccuguuuaucuuuuucuugaucuuuccccccuuuuuaacacuucuccaguacuauccagguguucuggguugccucucuccccccuacuccuucuauccugugcuagaggaagauuccuaguaaagucuuuagcccugagguaugagggcauuacucacagagugcuauacaugaagacaacacgugaugaaauggcuuaaccaaaguaguaacucaccaaugaugaaacauuuagauauuauuaggcagaaacauuuagguuggguagaggaggaaagagaguguauuaguuuccuagggcugccauaucaaauuaccucaaauuggguggcuuaaaacaacugaaauuuauucucucacagcccucauggucagaaguccaaaaucaaugggucagcagggcugugcucucuucauagauucucagagagaaucauuccucgccucuuccggcuucugguggcuccaggcauuuuucgguuugugguuguaucauuccaaucucugccuccauccucacauggccuuuuacucuucuugugucucuccucugugugucucuuauaagggcacuugucuuuggauuuaggauccaccuagauaauccaggaggauugacaccucuccaguccaguccuauccagguguucuggguugccucccuccccacuacuccuucuguccugugcuggaggaagaucucuagccugauccuuaauuacaucugcaaagacccguuuuuccaaauaaggucacauuuacagguuccaggguuuaggacauggacauauauugggggugggggggggugacaccauucaacccaccauauagaggagagcuuucuggggccuucugaaucauaccaguuuaccagaacucucuacuguaaggaggaacuuguuugaagaaaucuuaaaguuaguuguaaagugucagaaaugucagugcgcuuccugagagggauguggguggcaacuacuguuaacucauuuuuuaaaugguuaaauugaggaccugggaaauaaaaugacuuaaaguuaguuguaaagugucaaaaaugucagugugcuuccugagggggauguggguggcaacuacuguuaacucauuuuucaaaugguuaaauuaaggaccugggaaauaaaaugacuuacccaagucacuggaucagaagaagaguucugaacaagaucagaaaaagaggucugaaacaaugagucuuacccaagucacuggaucagaagaagaggccugaaacaagacagaucuacuucuggccaccagagcugugagagaauaaauuucaguuguuuuaagccacccaauuugagguaauuugauauggaagcccuaggaaacuaauacacucuuucccccuuuaccugaccuaaauguuucugcccaauaaugucuacaugugucaucauuggugaguuacuacuuugguuaagccauuucaccaugggcuuuaggucuuaccucaucauucuuguugaacuuuuuuccugaaaaaauauaauauuuuuucuaagcauuuuugccacgggaaggcaauuguugcuuauuaugcaccugaaaaaccuuuuugcaggaucuguaggaucaaggcaguggugcacuugcaaucuacugcagcuuuccaccuggucuuugugguuugcugaaagaucagcuacagggaauuuuagaagccagaacaucugugaagcaaaagccuuccuuuuuagauucaggcauacugaguuuuagguacaacuugcgugcaaagugguaaauauaugguuuucacagaugagauauucucugaagaaaugcugucacacuuguuuaugacaaaaagaccaguucuaacauuuauggcuguggggcaucucuccucugaugcauuaucagagcauaccagugacaacuguggugugucaagagauuagugaguuagaguguggccuucauggaaacagagagaaaggaacccugggggucaccagauucagccucccuccuaccuaguguaggaguccauucugugguauaugacauugcuacccaaauuaugccugaaugccucaagagacagggagauuacuauguauaggaaguaggcugucauuguugacuaauauuuguucauuaauucagcaaccauuuauugaguguguacuauguacuggacacuaggccaugucagggaauacagagauggccaaaauauagcucuugcccacagaaaccuauaacuuaauaguagggauaagaaagguauaccaaugacuacaaaaccuagauugcaaaacacauuguuagagaaguacaaaaugaacagaaaauucugagagauaacagcucaaagaguucauuuggagaggaggggagaaacaugaaagacaccugagagagaccuuauggaugagaauauuuuaauagcugaagcuagggaaagagugcuucagagacaggaaaagcaugagcgaaacagggaagcaggaaauggaggcauguguuuggaaaacauuaaauaagaguuuaauuuaauucucacaacgaccuugagaguagguguuauugucuccauuuuauagguaaggaaacugaggcucagagauuaaguaacuugccuaagaucacacagcuaaguggauggccaaguugagguucacauucuggucugucugauuucagaguuuuucccuuugccacugcaugccauccaucaggaggauaucugccauuaguuggcuucuggagauacaggggcauauauguaaaaggacaugugguuauuacuugggauacaaugcuauaaaggccaacuuguuggucuuugccuuagccccauauccguauucauguaucuucaagugauauugacaaagcguuccuaaaagggcgaaagcaaguccuuugcuucuuuuguguccucccaaugcccgguugagaaugggcucagugaauauugauuacccuacaauugggaaacuuagauuugcuaguccaaucccuuugaggaaaacaggcccagauuugggaacacacuugauaaagucacacagcugauuugguagcagagcagauaauaacauuuuagcuuugauagggaagagcucuuuucccucugaugugauuucauacauguuggggagggaccuagcacuuagauugggccuaggguguugaaauucucagcucugccucaggucugcguauuuaaagauuguaucugaaaaauaaaaauuaaacaucuucugaaagacagggucucagcuacuuaucugaguagaauaacaauuagugaagaagugacuaggggaggcaggaaaauuaccucaguuuagucccucuggcagaauucuaaacuagaagauucugcaucccaacuccagcauagcuggcauuguucuccaacccaguuuucuuuuuauuaggguguuuccccucaucuaaauaaucaaugaugugcguguaugugugugaauacuuucgcuuuucuaaaaguugcucuaguagcaucaauuaaucugacccaguuccuuuaaaacugaacucucuugaaauucugacauuaccuccaagugaaaggggagaacaucaagcccaaacuacaaugggccccuugagacacaaagaugaaucacucaaggguccuucccucaaggaacuuaaaucuaguggaaauaaggcaugcauauauaacuuuguugcaauauggagagugugagaagugucuuuauaaagacuggagaguuccgugggaauucaauggauagaaagcuuuuggaguucaucuccuucugcucccauaaacauucuuucccaugggaauccaguccaaagauaacgaguagucaucuuauagcaggguucacauagcuccuugucaucuggcuucugccacucuccaccacuucaauuuucccuuuagccuugccagguuccuuggcagugccugaagaugccacccacuuucacaccccugugcccuuacuccauuuucuuggagguuuuuaaagaaguagaaugacauaaucagauauguacuuuagaaauauuucucugggacuuggguggagaaggguauagaggcaggaaggccaguuuggaggcuguuguuaguuguccaagugaaagaaggugaggugaugagggagcaauggaaaggaggggaaugauuacauuuagaaagcaaaaucaguagcauuuggugacauuuggcuauagcagaugagggugugagugaaguauccagaaugagugaaagguuucuaguuaauuugagaguccauuuucuauaccaauucaugaacucuggugcagggaccauguccuguucauuauuauauuccuugggcugggcauaguccuuggcauaaaguaggcauucaguaaauguuggaugaaugaauuguucaccacuuuggcaagguggauauaauccgugaauuuguauucucagagcacauguugaccacugguugguaaagugguccaggaagaaccucuuuaugggagaguguagugaucuggggauucaaccuuuacugggcaugaaaugauaggcaguuaauugacaguuggcaguagagauaaagguaauucuuucuuuaauuuucgggcuuagagaauggcuuaucuccacgguugcuuuaaacucccaguacuccagugugguagugacauuuuggccugccuuuuacagaggcagaguccaugguggccccaggcacggucuuugauuuaaagucugagcuccugauacccaggugcgcccucugcaaagucauguucuuucaggcuaaauaacagaaggguaaccuucagcuggguucccuaagaugauuucuuucgccagcaaucaucacuuuccccaccgguuuuuaaugcagccauuucuuucaucuguauuccuaucuugauuugugagaaauuaaaugagcauguaagaugugguuuagauaaugauuaauuaggggaaaaggcgucauuccaauagcaagucacuauuauaugcuaaggaaauuaguucauauuuuuggauggcaaauugacuuguccugcauuuaaaaagauaccuuuuaaaaaaugccuguuauggcuuuuuuugguucauuaguagagcaaccugcacuuaauccuuuggaugauuuuaauaggcaucuauuauuuucccuacaagucaugaagcaaccaguuugggauaucauuaauucuuuuguuuaauauuaauuuaaugauaaugcauuauuauuuucagcacaaaguacuuuuguuagcaaaaaaaaaaauaaucugccauucauaaagcagaccuuggcaaugaaaugugucaaaucaucauauauauauauagaaaagauuucaauuuucauuguuacugagcccugaugauucauucucuucuguugcuguuugaauaugcuuuaucugcucuuagaaaaguguaaggaucaaggucuacauuaauauuuuuucuguucuuuaaugugauuuuugacaauuuguaguuauuaacuaaaauugcagucuaguaaaauaaccaacauauagaacaugauaaagguaauuagagaaucagagaccuggaagugaccuugagggauuauuuaguccauuucccaauuucaagguguauggcuaaucuuccuaaacagcacucuucaucauauuaugucucugcuugagaagcuccagugguccauuacugccuaggagucaagcccacaggucucugccugcauucaaggcccuucaaauuugggucugucuuaccugauaagcuauuacgccccagggucuagccagucugcaguuauguuagcuuugccccguuauuccacuguuuccaaacacauuucacccauuggccucuccacaucuuuuccauucuguauggucuaccucaagccucaccuucuccuggaagucuucuuugacuccuagagccucuggugagcauucccuuauccagcaaauguugucuauaucacauauuuuaaaagucaacuuuauugagauauaauuuacaaacaauaagaugcacucauuuuaagugaagaguuugaugaguuuugacaaauguguacacccauguaaccaguaaccuaauuagaauguagacuauuucuuccaccucagaaaauacacugcauauuuugucacguaaccguauaccaacuuucacuguucucuagcuauuauuuugugugaaagucuagucucucagcaugaauuuaucuuugguuuacuuuuaauuaaugcauauugaauauuuacuuuguaucaaaaagacuaagagcuucacaugcauaaucucacuuaauuuuuguaauaacuaaguacuauugaugaucccauguuauagauaagggcaaaaaguuagguagagguugaauaaccuacccuugcuugugcagcuagcaagugauagggcuaggauuaaauuguaaacaacuugaccugaggaaucauaaguguuuuguuauuugcugcccacuagugccugugaugauacugaccucgaagccauuaaugcugauuuggaauaaaaauccaauagaacugacacauugaaacagcccuauacacacuguuggcuuuccucuuccaaguauggacagggauuaggccuggaauggggucuccaagugaaugugguaagcauaggacuucauagcaaagagaagcugaagucccacuccugggggaggugacuaaagaaaaccaggagcagucuaaaaggucagauauuuaaauggagcuaacaaagagcgagaagugggcccaaaggaaagagucugugauggaggucaagaaggccaagccacagguagccaggccugaaaagaucuccugucacaagaguaugccucagaagaaagccuucuguggaccaucugugguuagccucuaggaguggaguaaucccccagaagaaaagcuuccauagcucaaauauccccuuuuacuuguaugacuggacccaaugugcgagaaguugucuuaaaauaauuaguaauaaauuacuucauaguucauucaacugaaacaucuauuuauuguaucuucaagauguuuggaauuuuuuuuuuuuuuuuuucgagacgaagucucacucugucucccaggcuggagugcaguggcacgaucucagcucacugcaaccuccgccuccuggguucaagcgauucucgugccucaaccuccggaguagcugggauuacaggugugugccaucauugccuggcuguuuuuuuuuuuuguuuuuuuuuuuuuucaguagagaugggguuucgccauguuggccaggcguugguaguuuacuuuuuugguauuuuaaaauauuuuuccaagauccaaguuaaguguacagauguaacguuuucagggucaucugccuccccuugaucuuuuuucuuuuuuaucuuuuuuuuuuuuuuuugagacugggucucacucuguuguccaggcuggagugcaguggugccaucauggcucacuauagccucgaccucugagcccaagugauccucccuccucagccucccaaauagcugcaaccacaggcaugcacuaccaugccuaguuacauuaaaaaaaaauuuuuuuauagagacggggucucacuauguugcccaggcuggucucaaacuccugggcucaagggaugcucccaccucagccucccaaagugcugggauuacaggugugagccaccaugcccagacuccacuugcucuucuuagauauagacagacacaaaguucuuuguuaguauucucaaucugcagcccucauuaauucaacacuacguguacagggcugaaugggagugaaggaguaucccaaaggagaugggagucauucucugcucuucaggaacuuacaguuuaggagaggagauuauaguaugaagguacuuuuuaauccuucaauauaaaugggaacuagcagcccuguaaugacuucaguuaauuuuuuuagcgucugggaaugcaaguuauuaagcccuaaagagcugaaccuuucuggcucauuugaauagucaauugcuaagucuucuccuuaucuccaucccaggcuauauugcuugucuccauuccuuuuucccagcugaauuccauuuuuacaaaaaaaaaauaauaauaauaaagugagaacuccucuuugauagcugggcuucacgauuacuugucccuuauaucuaauaaagggguuauuuucuuuuaauuuuccuuugucccucauauauuuaaagagugcuuuuguauuuaguaugucuuuuguagguggcaucuuauuucuugaauuuacauuucugcuuuuauucaugcaaguacguaccaguucuuggcuuaucuccuuagucaucugcuuuugguuuuaguuuuucuucauuccauuugggauucaguucccagguuaauucuuuguuuacuugaugagaauucccucuaaauucuuuuucuguuucuuucuguuuucuguguucuuucuguuuuauuuauuucaugcacauguccauacauugaaauaguuauauuucauuauugucauuucauuuaggcaugccuagcucaccuaggcuucuuccucaugcugucuugugauggggcuuuucuuaaaagcuggucugugaaauuuacugaaauuuauaugaaauuuacuuaauacaaaauaucuuuuccuuuggcauguauuucucuccuuccugguuuggaaauucugaauucuuaaucaguuuauggguguuuuauuuccuuaaaucuauagcuaacuuuuagcccauagaucaauuauaccaguucacucauuaaccaagcaguaauaacugggagggaggguaaauauugcaacauauccacuuauauuuggauaucauauauaccuuucuucaggacaucugacauguuuucccaaaaguucucauuugaaauuuuauucuuuuaaagauuuuuggcuuaccugauucuucagguggugggaguuuauaaaaugaugagacuuggccaacucagggaagggacauacuguaugcaagcucuaaauuacuauaugaauuaucauaucaaaggcaaaucaaacuggugucaugguaguucaaagagucauucccggacccauguagguacaucaagcaacaauuuguuaccaucuaagaucugaaccacucauagcacuucacugagaaaagaucugagcccuuuuauuugauaacucccacuaccuagagcuggugggaauaggaccaguacuaacagucacccugccaaauaaacucaaccauuccugaaaacuggaagugauugucaaugcaaauuuagaaacacaaaggauuuuaucuauaaugauuaauuuuaugaacuuauuuaaauaugauauuuugaacauguacuacuuaggcaucaguuuaucaagaaaguaaauaaagccuugcuagaugaacaggaacuuuguaugugaaaguaccugccacauaggauuuuucaugucuacauaugugucccaaccagcauuguuuaaauuuagauuagcuacucuuacccaaggagacucuuucccuucuugguccaguaaacugcaucaguuccuauuccuagaauagcauuacauuuuguaacuucauguaguaagaacacagugagcuagaacuagcuguuucuuuacuuuuucugaagauaaucauaaagcuuuaagcuuagaccauauugaaaaucagucuaaggcuuguauaugagauugaaauuuauaggagauaaaucugaacucuaugucugcagaccccaaaugguauuuugacauuaaauaucaccuuuccaucuaguacuauaaauuacagugcuggguucaguuuggugauauguauuaucuguguucuccuuuacugcuuuugucagcagcucccuugagaagggugaaguggagagcuuggagucaauacccuggaccccagcagugaugucaugugaggcaaaacuugaugaauuucauuccuaaauuaagaaaaucuggacacauaaguuaaggacaugaucaacugaaauuccuagggaaauaagauguuguaauaaaaauaaauuuucuggugacuuagggcuaacuagucuccccucauuuuuuaaaaaaauaaaacauccaauuauugaaaaacugucuaaaaugucugaauaugcuuucuaguaugacuucaguaagauuucuugaaacuugcuuuucugaggaccuuguaaaacuuuaggggagucauccuuauaucccauauacacauuuuuuuuucauucuaccuucuuaguuugcuuuauugcacucauuuacuaugcaguagcuauuuaucucugcuagucccuuuagacggugaacuucuuuggagaagggauuaaauuucucuuguucaaagucguaccuccagcauguagcacagugccuggcauauagaagguauguuagacuggguucucugagaagcagaugccaguuggauucauaucuaauccaauauggaauagaugugcaagggauuuauugggggaaaacacuuaugaaggaaaaugaggagggagcugaaggaggccggaaaagccaucagaccauggugcaggucugacccuuguggaagagagaggaaaggaaggaagguugaguaggaggaaucuuagacugcagugccguuuuaagaaaguuuggcaaggucaauggggaguccucaagccaaaguccccugugagcaaaguccuggguuacaggacuuaguaucuuugccaugcucagucauuggcugggagcagcccccagggaauguggcuuaggaacaaugugguggugaauucaaagggcagcagcugggaccauuagucaauuacauuccccacaguagaagaucugagaugcccauauucacagccaccacagaaggagaucaacaaaugcuaauuggagaaagagucuggcaguggcucaugccuguaaucccagcacuuugggaggccgagguggauggaucaccugagggcaggaguucgagaccagccugcccaacauggcgaaaccccaucucuacuaacaauacaaaaaauuagccaggcgugguggcagaugccuguaaucccagcuacuugggaggcugaggcaggagaaucccuugaacccgggagguggagguugcugugagcagagauagcaccacugcacuccagccugggcgacaagagcgaaacuccaucucaaaaaaaaaaaaaaaaaaaaaaaaaagagaaaguuugaguaagacagaaguugaagagaggaaggagauuggucuuaauauucacugagcccuaauauuuguuaguauugguggaggauauaaaaucaucagauucacacucaccuuccucaucucuccucaaacguuaccuuauggaagaugccuucucugacuaccauaugcaaaacagaauagucuccacaaucaucacauucuguaucucccuuacuuuacuuuuuaaaaauuaaaaacaagcugggagaaucgcuugaacccaggagguggagguugcagugagcugagaucgcgccacugcacuccagccugggcaaugagagugagacuccgucucaagaaaaauaaaaaauaaaaauaaauaaauaaaacaauugacaccuuuauugaggcauaauugauauauaauaaacuacauauuuuaagggugcaaguugauaauuuugacaugcauauacacccgugaaaccauuaccacaauaaaaauaaugaacauauccaucacuccccagaguuucuccacuacucuuuauaaacccuuccuccuaccccuccugcccaccaucucccuuaacaacgacugaacugcuuucugucacucuagauuaguuucuguuuuuuagacuuuuguauaaacggaaccauagaguaugugcuucuuuuugaucuggcuucuuucacauagcauaauguuuuugaguuuugucccuccaguaguaugcauuaaugguucauuccuuuuuauggcuaaauagaauuccauuuuauagauauaccacaguuuguuuuccuuuccuuacuuuguuuuacuuucucuauaguauuuaucaccuuuugacauuauguuuauauuuuuguuuguuuguuaucucccagaauguaagcuccaugagggcggggacuuugcuuuguauacuguuacaaccacagugcuuggcauauaguaggcaccuaauaaauauuuguugaaugacuuguaucuugcuucagaccuuuaguuaaaacaacaacacagcuuugauaugauauugauguuuugaucauuuauccugaaaagcaguauuggguuggccagacauacauuucauuuggaaaucauaacuggaauuuugaaaauuguuucuugguugucuucucauucauacauuauaaucaggaaaaauaaauuauaggagugaagauugaucuuuuaaaagacaaacuaaauaucgguguucagugauguguuuuuggugcuauaaauuaguuuaugcagaauuuaugagucaaaccuaggcaauuaauucugaugguuauucaaaaagagucagccauaaggacaauugggagaaagcagggauuaguuaagaugaaacguaauuuugaauaaucaaaauuuuacuguaucucaaaagaaaugcauuguuugcccuguuugccaugugugaguguguguguaggggguggggguggugugggugugggugugugagagagagauccugcuuacugaaacaugaaaaccuuguuuguuucaggaucagauuugcaaguaugucucccuaagggcccaacaugcugcucaagaaagauggaagaaaaauaccaacuaacagcacgauugaacauggaacagcugcuucagucugcaaguauggagcucaaguucuuaauuauucagaaugcugcgguuuuccaaggugaguucuggggauuauuuuagaugugcugcuuaguggcaucauuauuugggcacugggcuuucaaauacuaaguauaauuuauaaauuaccauuccagcauuaaugcuugcuauuaaaaaccucccagugagaaauucugguuuaaaaaaacacauuuucagagaagcuucauuucaaucuuuggaaaggugaguauugucaaaaaaucauuguccaaggacauucuauuuaccuguauauaaagguuauaaaucucuacagaaagaauaaauaauauuuucucucagcuugauucaaaaacaaaaaaguucccuuaaauacugagcccaguuuucuccaggaaugaguuagaugcuugugggauacauguggacuccuucugaccacuaggaccauuuccauuuaagaggcagacacuggcuuguuggcccaggauuuucccauuggugugaguggugaccucuccucucuuugugacucucacuucuuaccaugccugugaaugauugcaagagaagcuguuguggcauugccagaacggguaggaaaugacacuucuccuugcuaacuuaguaggacuaucauagcaggauggggaguaccuccuucaauucuaacacccagcuaggaagaugaugaugaugauggaggugguggugguggugaugauagcagacacuuauauggcaccaugugcuaggugcucuuuuaagugguuuacauguauuaauucauuuaauccucacaauauaauuaugaguagauguuaguauccuuauuuugucgauggaaaucuaaggcacagaaugauuaaguaacuugcucaaggccacaaaauuaauaaauaaauggugaaggcaggauuugaacccagauggcauggcucuuagagucuauucuuuuaacuauccccauaggcugccuccuguaacugggaaaauuaauuauggguauucacaauuaauuaguaauuaauuaauuaucagucuuucuucuauccuuccucaagcagagggaaucagccaccuuuuucuugccucaccaagagaggaucgaggucagauagaaaaauaacacuucugacugcuugacauugcaaagcuugagauuuauggcacuguuacaagaauuaaccucugaauuguaagguguguugauuauagcuuauuuuguguauuauaaugaaaucuuuagaauuagcuaagaaaauuguucagauuaguuaauaaagccuacauucacaacaguuucuugggucaaagccucaggggguauuagguugauuauaugaaguauaauauauaagcuugaaguauuuguuaaacuauuuaugcagucagacucuugugaagaguuuguugagacuaacaauuuggugauagaaugaauaauuuagacagauuuuaaaaauacauguagcauucaugaacuucuuagauugguuuuggaguugaucuguuggaugaaaguggggugagaagaaaugaugugacaugagaauuggguugaagcagagagcugaaucuuacucuuuggggcaucaaggucccuuuuuagaacagaguauuagugauuuguuuaauucccagaauauccaagcucacagauguuaccuuacaauccuugucugguuggaggggagugguagagugaucauacuggcauuuuaacauuuacaguagcugacauggcuauguaucugagggcccgggucgucagcauuuacaccucuguccaguucugcacuuugcccacuguguuuucuagaucugcaaaaaugugagacuaggagagaaaaaaaguucugacaagauuuugguuggauuagcuuccagauaagccugcuauagcuuggaggcugaauacuagucaugugaacagaggguagaaaaugggggcagcaucuacuaauuguaucucucucucccuuucucucugucucucuuucacuucacacacacacacacacacacacacacacacacacacacacacacacuuucuugaauuguggggauagacagaaggacaacccuagcaaaggaacauggagacaaugaaauuaugucugagcuaauuauugcuagugcccuuuaccuugucaccaucgguacucauucuuuaucuuguuucacucccucuucucauucuuuuccugccucacuuuuagaaaaaauaaacccaacaaggaaaaauaaaccaugaucccagaccucaaggcacuuguacaauguuucagaagacauugccccuaaauccuuuuguaacaaacauuuggagagacaagacuucaaacuggggaccacuacaagauaauguauuauuaauugcuaagaaaaagagagcauccacuuuuuuucuuucuuaugaccguuuauuauuccauugaauugaaauuaggagacacaauuguuuuuccccuaaaauacauccccuccccaauauucugguagaccaaauuagugagaaaaccaucccaguacuucacucaugugaaauuugaugugacggcuuuugcuagcuauuuucuccaucacaugaaguugaagaaagcucaucuugaucuuggccuagauccacaaucucuuugguauuccuucacuaguccacauuggggguauuuaagcagugagugcuuucugcaaauaugugcacaguuccacgagcaauccuuacugccucgauuuggauuuuaugucuucauuugcaggaagccuuugcccucauaaaugagccuggggcccuuugcuacagugguuggagugcucuauugcuaauguuguuuugauaaugauugaagcauuuaaaaaaguuguucuuuauucucagucuuugcauugccucguuuccuaaauuuaauuuacuuagaugugcuuaguaaaauggggcagcacaauugcuuuuuguuucugcuuaauuaauucuuucugaaaaacuccacuaaaaguagacuuuccuuucucuuuuucuuuuucuucuccccuaccuuauaauaguuaugaugauaacaauagugaagauuuauuaagugccuacuauaugaugcugacuuuuacauaauuaucucauuuaauuuucccaacagcccuaugaggucuguacuguaauuaucuccauuuuacagaugaggaaacucauugaugccacagcuucuucugagccaucacgugacauggcuuuccuuguucuuaauguccuugagguaaaacaaaauugagaaguuggauuugugguucuugugaagaaaaauggaauagaauucugaauuuuucgucaucucacuaccaccucuauaccuuuaaaccuugaguucuauuuucuuuguagaauuuuauuaugauuuucagccuuguacuaucaagaaauauuugggguacauccaggucuuuucuagauguuggauaauucuagauuuccccaagauaccacugacuuugagugauaauagacucuuuuauaugcagcaauaccuuguuuuuucuggaaguugccuauuccacaacuugaacucucuucaucagaaaggaaaaauaguggucgagcaggaaaucaucucaucugaaagguuuuugaguccuugcuuagagccuacuacuguuccauguuuaugcguagucuuggcacacuugauuuucuggcuuucuagggggggauccaagaacucacuaaauguggcacuuggggacauuuaauagaggacuauacuccuacaggccacaguggcuccuguauuacguuagguccaagugauguucacaaugugguuacaaguaaauaaggaaaguccaacuuacauucacuguccuuuucuuaauauuuccauuuuaaauggcuaaaaugaauuuccucagugcuuaagaucagcgaaagaaacacuggacuuggagucagaaaauccaaguucaaauucuagaucugcauuuaugagcuuuauauuuuggggcaguuauuuagacuccaguagccucaguuuucuuaucugcaaaaugggcauaaaaauugcaguccugcuuacuuuuguaaaguagaaauaaugaaugugaaaguaucuugaaaacuguaaaacaccauaugcaugcauuaucuagacagcucauuuauguggaccacuuuaccccagguggugccaaauaaaugaugcauuaucauuacagacauuaaccucgacaaggcuggaguucaugauguauuucaacaacuuuugccacuuauugaugauauauaugcaaacagcuccaguguacagacaaaagaguacuuaggcaaaagacucuuugggaaagggguuuauuuuaugcacucuuggaugugaggcuguacuguuugaagugucaauacugccaggagcaauccuuuuuucagcuuccugaagcuucucuucuggcuaguaucugguguauuucauauaugaauaagcagcuagaucaggagagguuugucgguucaggccauauuuuaauugcauuuuuugguccacacuauuauggcagagaggagaaaaagguugguauaagucuagagaucuucaguugauccucacucaguauuggcaagcuugcuuucuucuaccugcuuucuguggagaugaaaaagacaucucugaaugggggggagggcagcguuucugugcuucuucuguuguuucucucccuuauuuucuguuuucaucagcucuuggcaguuuuuagacucucuucugucagauuccugucucucccacucccccuaaauaaaauugaccuugguuagaauacccuuuucugucagcucacagcaauuucuccagucauuucugcuugaaauaacuguuuagggacauuauucaagcaaagcuuuuuuccuucacaguuaauaugugacucaauaauugcuugaauguugauaaacauguuuuugagauucaaucauuugcuaauuuaguuuuuauuauguaguggggguuuuaagugaguacugagccauuuuucuccauuucacaauucuuucccccugacuagccugacaguucugcccgcacuccagcucugugcaggcugagccccauugcauccccaacucuaacuguccgccagucugucacaaccccuuucuugguuaaaaauaauguaugggagagaauaauuacacugaugucuaaucaaaacuuaauucauuugccgaggcuaaauacaauagcauuaaacugaauaggauaauuuuaggaacucaaaccauggccaugagugaaguuauauauccucaaaaauguaaauuauuaaucaaaccgcucaucuguacagcaaagcucuaguaaucccauuauaaaagggugaauuucucauuagagcccagaagaugcuggcauuaauuaguggacuuucauggcaccaacucaaaggcauauuuugguuacaaaguuuuuaaaaaugcaauucuuuaauuauuagggcaauuggaaaaccaacuggaaacugaguguuuaaagccauuucaguuuuaaaguaaaacuuuuggauucaaucgggucucaaaauucuguggcuuuaguagagccagaggcugggggaguuauaaaccuuuccugggcccuuuauugauuuagaagucagucauuaggcugaaaacuguuuaaugaaaagagcuuagaaaaacgacucaauaugcagccagagaccauucuggggccaaccaugaggugaggagauuaugcagaugaacucuuuuaccccaggccaucgcccuugauugaacaagguccugaacucaugcccuugauuuaacagggcucugaacucaccuccucuugcugucaucaucacugcccaccuuucucacuagugggcucaacaaagcacauuaaaggacauugucccugcccucuagaagcuuccaggaaaaacaccacuuuugccuagagugcuuacucuccaccuccccaccagcccccaaacuggaauuuguuuacuuucugaaaacauauguuccuccucuucuuucugucucacugaguugcaguaccugauauuggaguaaugaagcauauguuugagagauuugaauucucuugucaguagaguggagguagaaacaauuucccucuaagcuggaaaugguaacauagaaauuaaaagccccuucccuucuauugacugugagauacuuccagggacugaggcaccuguauugcuccuuuuccuucauugcacuuuucagucaccaggucucauuucuuccugcauccuucuucacaucauuuuccuacauuccaacugagaccccaucggucucaguugucucauuuaucauaugcagauggcuuuugauuuuaguuccucucugauuucaguuccaggcuccaucagcuaacaucuagacuaccagcaaaugcaccccuggguuucaugccuuuagccucccuugcuucccaguucagcaauggaguguaaugauuaagagugcaggcucuagggggcauucugacagggugugaaugagucugggugggguaggcaggcugguauggagagaagaaaguugagggcuugggugaggauuagagaccuccuuucugaaaguguacuguauuggagagagaugaauaaaaaauuuccucuucucaaguguuuuacuuaucucauuuaaaccucauaacaacccuaggagguggguacuuucauuagccucauuuuaucacugacaaaauggaggcuuaaagagauuaggugacuuguuuaaaguagcacccaauagauggcagagacaagaauugaacgcaggaaguacagcuccauagccugugcccuuaaaacagugcuauaugugugauacagccucuguguauuucaucucauggucauaagcagucuccucaauucuaacuuuccuccuugcaagggaacucuauuguauuuaauuaaaaaagcauuggcugagcaacuggauagcaugucuaaaggcagguacugugggggauucaaagagaaaaacuaccucauggcuaccuucaaguagaucaaaauucagaaaccaggacauuuguauacaaauaacuugggugcaaggcauccuaagaaaaauguaagaaaaaaccuuugcaguuuuccaaggggaguagagguggauccagguuuuguagugcucaaaacuuauauaauugggggaccuucuuuaagaaaaagaagacaaaauaaaaaauacaaaaugccuauggcucuucugugagagggugugcaagugcagggucccuguagcuuaaguuucauuguuuaacagaaaaauaacuuuucuuuucuuuucuuuucuuuuuuuuuuuuugagacggagucucucucugucacccaggcuggaguacaauggccugaucuuggcucacugcaacauccgccuccuggguucaagcgauucuccugcuucagacuccugaguagcuuggauuacaggcgccugccaucaugccuggcuaauuuuuguauuaaaauucacuucuuuaugguagugugggguuggaagagauuaacuccaaccagaggguagagguuccuggaggagacuggcuguaugaaaucuccagauagacaugcuguugaucaaagagaagaacacaugagggaguuggguaaaucagugcacaucuuuuucucaauuaaacucaaacucaaauuauuauuauuauuauuugagacagauucucgcucuguugcccaggcuggagugcaguggcacuaucucagcucgcugcaaccuccgccucccgggcucaagggauccucccaccucagccuccugaauagcugggacuacaggaaugugccaccacacagggcuaauuuuugcauuuuuuguagagauggaguuucgccauguugcccuggcuggucucaaacuccugggcucaagcuaucugcccgccucggccucccaaaguguuaaaauuacaggugugagccaccaugccuggccaaauucaaauuauuaauugccuauuagauacuagccuuucuggacuccuugucuauaccuguagucucucacuuagacuucccucuuggaaggggcaaacaccuaggaggcagcaaagggcauagugugauggcuauguggucuggcuucaggcagacuggugucuaagucccaauuuugcccuuuccucucuuugugaccaagggcaggccacuucucucugagccauucauuaaacaaaauuaaaucagaugagugcugugaagaacucagcucuaugcuggcccauaggaauaaaaugcaugguagccauuguuuuuauuauucccucuugugcauuuauaagcauauauauguaugaaauauaauaucuuugcuuugcaguaaugaaugucacauaucuggcacauauacauuuuuaaauaauuuuuuauguuuuaauauaauuaaugucaaaaugcacuaaauacccacucauaauccucucauucagagauaaccacuuguaacauuuuuguguguuuucuuccuuucccuuucuguguguauguguauauuuaaaaccguacaauauacaguuucuaaauggucccguaguggucugaaugaguuaaaguagccucuagaucuacucagcaaagggagacugauuccacuggauuacauuaagaaaagaaggagaacaaaaauguugaaaggaaauuggaaugcuuaugacacuccucuccuuuggucagaguucuuuagcauauaguucugaacccaauuaacugaaaugucauuauuggauugcauuucuucccucuccugggaaccugugcuuuuccuuucuagcacucaucagguugcagugguuacaggaguauguaugguuauuugauuaacauggguauccuuuacuaaagaaugagcuuucuguggauagggcuugugucuauucuaccauaucccucuguccccaggugagacaguaaacuuucaguaaauguuugaaugaacacacacacauauauauauauauacauacacucucacacaaaauuagaauaaguaguauugauagaaauagauuucuaacuguuccccuuccccugcaacaguaugaccaaacagaaaagaaaagauagauccuguugccugcagcauuuacuucuagguuuuaaaagcugcuuagauauaagaucuuaaaagucuggauaaugggguuuugcucgcccauugagauggaacaucuguuucucuaagccucugccucagcuucuggccccauaacucugaggcuggcugguugucuuuucuuccagcaugaccuaggcucuucccagaacacugugaacaagauucagugccacagauuugcaccuugugaacaagaaccaugagaauggugacaccugucagcuuguccaaauacauucuuguguguccuaccacccuuucacaaggaccugaagggaagagaagcucccuuuucuugaaagccuuguagcaggcagacauacuuguauuuauuuggaccuugccagcuucccuucaaaaaggugguauuaaucccauaaggagacuaaaacuaggagaguuugguaauguaggcaaguuaacccaaugcuaaauaauugaguugcuagacccaagacugcugaauuuaaauugugcuauucucuuauaaugcuauguguucucucucaauauuguugcuagugcaucaaauuuggagacuauucacauaaccuuaccuuuccuuagaguuuuauauuugauauuuuaguggaaggcacaaugucagaauagauagucuuuuaagucaaauaguccuguauucaaauacucuuguuacucacuaguuacguaacccccuuuuacaaaaugaggguaauaauuacaaccuuacagcacugcugugaaagugagccauaaauuauguaaaacauguauaccauauugcuugguauagaauaggugcuuaauaaauggcaacuauugauacucuucaaaguuaaagauuaagguucucauucuuucuuauaucuguuuauaguuguucuuccuuuaucaacucuaauaaauugggauuugacguggguguaggaauuugaucagacacaggugggacuaagguugacucaaguuuaaaaaaggacuugucaaauaaaugaauaguuuaaacgaauuguagagaggaaucauuaacugauuuaaaagaauaauuuuuaaaauaaaaauuuuagugugcauuaaaaaaucaauaaucauagguucauuagaaagaauuguuaucuauuuguuaaggcagguuucuagagaccaauggauuauuuauuuauuccugauuaugugagaccuugaaaguaauacagcaguauuuauuucaggauaaucuuuuuuuaaaacaaguuuuugcuacacaaauaaguauuucuuuuuuaauuagagaaaaugaaaaaaccacaaagaaauaaaaaaguggaaaauaaaacgacccugauucuacccacuagaggauagcuacuguuaacauuuugacauaucgucuugcauacuuuuuauucauacauagguguauguauaguuuuucaaaaauugacuauacugcuuuuucauauagccaucuuuccaugucaauaauguacuucuguaacacaauauaaauauaguaucuaggggcuacccuuuacuuacuacuguggauauuucacauguuauuaauccaacccucucuauuguuggaaaugaagguugcuuucaguaagccacagugaacuaaauaauguccguguaauuaaauauuuaugcacauccuuaaugauuuccucaggauaaauuccuggaaguggaauugcugggucagagacuaugcaguuuuuaagauuucucacauuuauugccuauuugauuuccauaaaguuuguaugugcuuucacuuuacuucuuuuuaaauacuuuaacuuuuaauuuuuguggguacauaguagguguauauauuuaugggguauauuagauguuuugauacaggcauacaaugugaaauaagcacaccauggagauuagcaauguaagaauguccauuuuccugucugccccuugccauuuuaucauaaucccagcgugggugaaaaaaauaguacucuuugguugccagugagauuuguugaucauuuguaccuuuuauuuugugauuuuucucacuaauauucuuucaucauuuggaaaaauuuaaguauaacuugucccuuacuaguuguccuuuucuuauugauuuguaacaagcagcucuuuguauauucagaaugcuagcccauuuuguauaaguugcuuuaacugauuuguuaauucaaguuuucuuuuuuuguggggguuuaaacauacuuucagucaaaugugucaauaucuuaauuugguuuccaauauauucuuugauucuuuacuaauugauauuggccuuagcaugaaucaaagauguguucuauuuccuguucugacaccagcuguguggaaauagguagguaauucaaagucucuaaguuuguuuucuuauaugcaagaugguaacaccugaccugccaaccugcuggagcucuugaggaucaaaagagguaauauauaugaaaauguuuugaaaguuuaagugacuaguguaguuguuauucacuugucccuuggcacuuaucagucuguacuauaucagaauugccuuucuuccucuggaucugaaaccuuucuggccuuuuaauaggaaguaauuuuggucuagaaaugcacuggagccugugcccugguagcuggaaaggugcucuagagaguggugaaauguagccugccaccaggcucugccuggaguguggauucuggacauccuucccaguuggggaaaugggcccuggaacuauucuuugauguaguauguguguuuacuccuacaugccccaguccuugaaggguagcuuaagaaacccagccagugaggccaaagugcuuguucuaccaacagaguaguaggugggggaaaaccccaaagauugcuauccacacuccucuucuuuggugccuggaaaaacaguacucuuucuagcaauuaacauuugaaacagauauacuggccugucagauaaaucaguggcuuagcauuguuuugugguacaaauucuggaaagaguuguuuauuaggaaaaccuucuuaaaaaauugugagaugaccauaguucucccucucuaaaugccagauuaaaaaagaaaaaacagagagacaggaaaaacaaaguaucucaugcaucaaaguaaucauuaguggaaaacaaaguauguucuuucuggcaaucucugccagaugguugagauggcuuacaguggaagaagaggcuuaaaugaugcacauauuauuucaaauauaaccuugagguuuuuuguuuuuguuuugaugggaggggaagauaguguaaacuugcaaaaaauuaagccuucuugaaggucagagaccucuggaagguuggugagguuagacauuugaacuuaccgggauuacuuaagugaaggagaaauaaaguuaacuaaucuuacuaaaaguguacuaugugcuagacuugaguaaucuucauaaugguaauaacaccauuagguauuauuauccccauuuuacagauguggaaacugggauuaagagcuauuaaccaauuuguccaaggccauguaaccagcaaguggcagcauuaaguugcuaacuucaaagucauugcccuuuucauugagccacacggucucccuuggagcuagaagauaaaaauaagcuuuaaaacuuauugaaaugaucauagaugguuuugaaaaauagaaagugcuguuaggaaucuguacaguaauggagaaauaaacaaaacaccccaagaaugaccccaaacuuuuauuuggcagaaggcuucaaauuccauugauaugaaacaauucucuguagggacauacuagggugaguuaauuguacccugaguauucuauggcaggguggcagccuuuccuauugccucauaaagaaucgcacacacacucuucagaguucauuuuaguacuuuucagccugacaucuaaaggggcugcuacccugacaaacacaaucuggccagauguuauuauuuugcacuacauuuaauuucuuccugccaaagauuuaggcuucuuuucccugauaaagaucaggggaaauugucugguauuuacaaaaucccauccaggcauaucuguuacaauguucacuuagcaaaguuuauuagauuauuagggcuuuaaacccuugggcucuuucauuauugaaauuaaaaaaagaaaaacccaaacaucuucaacaaauuuaagugguauaauuagacccuggacuugucuuacaggcauuuuagaauuaugaaaaugauuuaaauaguauuugcuuccugagaaacuugcugcauucgacagggaugaaaggaaagcaguuaagcuccuuuggucuccugaguuaauggggaaagugauaucuggaacugaaauaaauuugcuauaguuguauggugaaauuacucccauaaguaguuagccauaccacacagggccucucuuucuuggccuaguuaaaauguagccacuguaguguuagaggaacaugugggucugucauuuccuugcucaugaagucuucuuagaguaaacacugaacuagacuccugaagcucuaauuuuugcuuauauacacuauacuagacauguaaagaagacaguaauagaaauauuuucaagguauaaucaacuaugauuuauauacacugcaguuuuccuuaaaggauuucaaugugacuugcaugcaguaauuguauuuucaaucaucuccaguugaaaguugguggcacgauuguuauuuucucuacugucugaauguagacauggaagaauuuagacagugucuugacuucaucaacauaaggagccaguagcuggucuggaacuugagcuaguaggauguacaugagagaggcaaucuaguagaaagcaauguaauuaugcuuauuuguuuuggggagugaggugggguagcuacuaauucaggcacccaaauccuguaacauuaaacuuugcuuaagaaagaaggagaauuauuuaagaaaauugaauggaaguuuuugcuacaugugccaacuugaguauuuucuucuauuguacauuuacuuggugccagaugagguuuucaacaaauugugaaagcccagaucuuuagagacuauguuagaaaugucucacaauuaagcaggaccauaguuggacuuuuucuucuuauuuugaaggcggucagaagucuuuuaugugaaaacuguaacagugcaaacauauguuuguacauuaacuauacaggcaauaaaugcugaaauggcagaagugaacucaaggcagaagguaaauauuuuguaaaaauuaaugaucuagagugaacucucauuaacuugggcucuguuaauuugaauauugugauaguuugacuugggcugaaguuuacuuucaucccauuuaugaagaaagaaucugcuaacaaauuaauaguguauauaagauugcaggaagucauguuuaacuugcuugaaggacuugagcaagcccauuaauugaggcugcuaauuacaaugagcuuugccuauuaaagcaaaccugauagaaccucuacuuggaaacacuuuauuagcagugaguuuaaguuacucuagguauggaaaaauaauaaaaggcaguguaguguuuaagagaacggauucuggaauaaauugacuuggguuugaaucuuguuaccugggggagucuaccaaaccucucuaacucccaauuucuucaucucuaaaacaauaauaggaccuaaccuuacaugguuuuugugaggaauaaaugauaugaugcauauaaaacuuaauuuaggguggugccuaguauauagugagugcucaaugaauguuagcuuguguuuguuaauuuuggaaaguaguuauaaaucacacuucaccauccuuccccuucaucaauuuggcuuagugaagauccaggaaaacauccuauuuguugagcuaguuguuccugaauuugaaugagcagccaucuggggacaguaacuucauaaaauggccuaccuguucuaugggccaaauaugcacauggaaagagaugaucauuggaucuauaagucuuuucaguuucccaggagggaaauucgaauugaacauguuuuauguuauaagcuuaguugaccaugaguugauauugugaaguuauuauggagccugaaaaauaucaagaguuuauaugucugaauauuuuauuacaacauuucuaauauuguuccucuucugcuguccugcugauaaggacacuuuacuacauaaauaauagguguucguuuuagaagagaaguuacuaaguucugauaaauauaaaauagaacauaaaaaucacccagaauccuaacauccagagaucacuguggugagcauaggcuuucucauuuuuuuccugcauauuucacacguguagguuuuuuuuuuuacaaaaauaaaauuguacuguacacauucaaagcaaugcuggugauaaaccaaagagugugcaugcucucuacaguuauguucagaugugguuuaaaauagggguauuaauuuguaaucacaagauggacuugaaguugaaaagcugcauacaauuuuauaucucagagucugccucaaaucuauuucuauugacaccaauagaaauuuagcccagagaauauagcuucaauuaucuuuguagguuuauuauaauuaagaauggaugcguaugugugugucuuugugugugcacaugugcugcgugugucagguggagacuuuucccuguuguggagucuggugacaagaacauuagacuaggaguaacaggacauggauuguggccccgaugccaucaugacucacuggaugaccuugggcaaucaauuucauuucucugagcuuuaguuuucccauauauaagauguaggguuagaccagauaauuucuacugccccuugcagcucaaagagucugaguguuaaaaaaaaaaaaucaaaccugucugucugucugucugccuggaagaacccgaggcucuguggauaucuuccuaaggagaggaggggugaugaauuuaaacaguuucuuuggcgccagauagaccaaaggcuguaauuuuuagccuaucaggcguuugacuuuugcaagugcuaaauucuccauuaggaauaaauguggaagcuccagguuauuuauuguuauuuacacuuuccauucauaacugucagugucagaggcucugucaacauaacugcgucaaucagguuagcuuuaaucaguuuagugguggcuaagucacaaauauaucaaauagccaaucaaaaugcaggagcccucuaaagccugacugaauuauuuauuuuguuaugaugaaaaugucugggcuuuauuggguuuucuuugaagaacuugauucagcuugaagucuagaagauaaaagaucagugauugucucucagauuuuuauucugccuuccuucaaggcuuuucauuuuucacaagccguuguuagcacuucuaagucaaggugagagagcugugauauguuuuauccuagggguuuaggcacguguggaaaacuuuuaccuuugauuucuuguccuguuuaugucauguggaaggugugugaccuugagcuaaccacuuaaccugucugagccucauuuucuucaucuauauaauggggauaauucuaaucuuaccuaaaucucaaauuguuaugagacucaggccgggcaagguggcucacuccuguaaucccagcauuuucuuucuuuuuuuuuucacuuuauuauuauuauuauuauuauuauuauacuuuaaguuuaaucccagcauuuucugaggcugagguagguggauugcuugagcucagaaguucgagaacagccugggcaauauggcgaaacaccaucucuaucaaaauaaugauaauaauaauaauaauaagcugagcacaguggcauauuccuguagucccagcuacuugggagacugaggugggaggaucgcuucagccugggagguagagguugcagugagucgagaucacgccccugcacuccagccugggugacagagcgagaccccgucucaagaaaagauuguuaugaaacucaaauaagauaaugccuuaguugucauauaagcaugagguuuuauuauuaucauuagcacuguuauuuaggccuuauguagguaggucugacauaguauaacauauauaguccugaaaaguuaguuggaagucaguuuuguaaaucaaaacucuucugugccuuacaugauacucucauauauuaucacagaaaauuauauccucuagacgucaugaaaaauuaaagcauucaacaaacuuuaaaaaaucauauucaacugaaaaacgaaugauuuucaaauauaacgugagcacugcaaaucauuaaauacaaugcuuaagaaaauagcucuagagacucugaaaagggaaauaauucaucuugcuuccaaaaugcucagggccuuuuggggguagaauggaugggggagugggcggcuggcagugggaggucagagagagaagaagacagaagaaaaagacauuuaaaauauagcuguccugcacaauucuuucugugucaguccaaguagcuguuuccaacccccgccacacacuuauuauuccuuucccagacaucuuuaauacagacggugaaacuguaguagaaaugugccuuuguacuuacaagaaaguuguauggccccucuaagaaucacuuuuguuuucuuuauucugccgagccauucagaggcccugauuaccagcauagcaggaaagaaaagagauaaauaccuagcuccaaagcaaaacacaaaggaagcaagauuagaaaauuaaguguggagggggaacauuugaguauaguaacauggucacuaguaggaaggaaguguuucggauuuaccuacugaauuaucucauguuuaaguugagucauggcuaauuaacuuucaugugcuaaagcaaauuuguauguacugagcauguucugagagugacuuuuauugaaaauggaagagcuagacauuuucuauaauauuccugaugugauugaagcugugucuccaggagugauuuuucagccccgucuaguugcgaggcuguauuaggucauucuugcauuacuauaaagaaauaccugagacuggauaauuuauaaagaaguccaggcaugauggcucacgccuguaaucccagcacuuugggaggcugaggaggaggaccacuugaacccaggaguucgaagaccagccugagcaaugaggcgaaaccccgucucuauaaaaaaaaaaauacaaaaaaaaaaauuagcugagugugguggcacaugccuauagucccagcuacuggagaggcugagguaggggauccccugagccugggaggucaagacugcagugagcugugaucaccccacugcacucuagccugggcaacaaagugagauccugucuuaaaaaauauauauguauauauauauaaauaaaguuuggcuggucuugguggcucacaccuguaaucccagcacuuugggaggccaagacggguggaucaucugaggccaggaguuugagaccagccugaccagcaugaugaaaccccaucucuacuaaaaauacaaaauuagccaggcgugguggugcgugccuguaaucccagcuacuugggaggcugaggcaggagaaucgcuugaacccaggagguggagguugcagugagccaagauugcaccaugcacuccagccuuggcaacaagagcgaaacuccaucugaaaaaggaauaagaauaauaaauaaaaauaaaauuuauaaaggagguuuaggcugggcucaguggcucacaccuguaaucucagcacuuugggaggcugagguggguggaucaggaguucaagaccagccuggccaagguggugaaaccccaucucuacugaaaaaaaaaaauacaaaaaauuuagccgggcaugguggcacacgccuguaaucccagcuacucgggaggcugaggcaggagaacugcuugaacccaggaggcugagguugcagugagcugagaucgugucacugcacuccagccggggcaacagagugagauuccaucucaaaaaaaaaaaaaacaaaaaaaaaaagaaaagagguuuaauuggcccacaguuaugcagacuguacaggaagcauaguacugacaucaguuucuggggaggccucaggaagcuuuuacucaugguggaaggugaagcaggagcuugcaacaucacgugccgaaagcaggagcaggagagagagagugagggggagaagggccacacacuuuuaaaugaucagaucuccaaagaacucgcuauugugaagacagcaccaagccaugagggaucugcccucacaauccaaaugccucccaccaggccccaccuccagcauuggggauuacaauucaacaugagauuugguccgguacaaauauccaaacuauagcaaaggccuuugggaagcucagcccauagggaagucuuagaauacuuagauugcaguuccuaguuggucauuuucaggcucuggauccugcaacaagcugucugaacaccuuagggauccuuuucuaaaccugcaggugaggcuaggucuccuugcaauccucccuaguccccaucccaccugccccacaccauguucccuugcucauuguuggcaucucuagguuucuaguaaccuagaaaugaugugcucuggauaggguggagaaugucuguccccuugacaggacugaaagcaacucaaggguccguuuugaguucaucucuguaucucugcccccuuacucaguguugguagguagauauauaugguagauuuucuaaauguuuguugagcuuuaauuucccaaaaccuuggauuucuaaccuauaaaauggagcuauuacaugucuaguccauauucuuauauuaguuauaagaauaagaagauguauauguaaaauugcauauuaaaccaaauagcgcuauaugcacacuuauauaaggggcucuuauuaauuaggguuauuauguguaauucacauuuuaaauauaaggcuguuuuccaacaggaaaucaggcaaauuaauuuucuuugucuguccaaagagaugaagagacuggcacauugguucuuaacugggguccauuaauagguuacagugguuccuugaagccccugaaauuuuauguaaaauuuuuuuguauaugugacuuuuuuucugaagagaaagcacagaguuuaagucagauacguaaaggggucuaugccucccaaacaguuaaggaccacagggcuagcuaaucucuaaaacuccauuccacucuaauuugguuuuaugaaaaaucccagucugaacaaauagauucaaauuauuauuauuuaauggacucaaauaagcagucucaguuauuuuaacagcaguaaacucaggauucuuagauuuaauaauauccauuuggguacugauugcuggcauauucugcuaccauucagauuucuaccuggcuugagggaagaacuauuauuuuacauguugccucccauguccuuucucaaacauaguuauuuugaucucaccuauguugcuuuuaagagggacuaguuuggggccugcagaauuagaagcuuuacccuuaugguuuucaacugaguauaauaaacaucuuuuaaagaaaccaaacaacaauagcaaagcuauagcccaguggaggcauuaagggaguugcaccauuuagaaauccagcuguguuuguucugauuauaaucaggcuacugucuaccauuuaguucucuugggaggugauacaguuaaaaucccagcaucuguagaaauagcaaguuuauccacucaguuauauacacugagcuuucuguuuuaauaaagagaggugggguacaaugaucagauuaaggaguaugggcaauuuuuaccuugagcagaaggaagcaguccuccaguguguuuuagaauccuauucauugcugacacugggagaagacugcugacaauauggguaagcucaccuugaucuuuuggaggggagccuccuccaaccauuuagaacaguacagugggaggaaaacaaaacaaaacaaaaaaaacauaccacagaguaggagguggaauauagaguuuauauucauggcucugcuaugaagccaauaguguaacaccaggcaugucuuuuccugaugcugagccuugugggcuagcugucauuuagggcuuaguccuuaguccuuccagggcuauuguaauuguuguuaauaauaaucaggaauaauagugagaguuuccauuuauugucuacuaugugccacuaugcuagaggguuuuaauacauuuauuuaaucccugcaguaauccuguuaaauagguagcauugucuucauuugauguaugagggaaauggaagcucagagaggguaagcaacuuguucauguccuaucuucugcccccuccuuccuggguccuucuuuccccauagccaguggucaccaaguccuguugguuaucacugcccugguuucagcccucagcucuauccugaggauuuaaucgcuuucuaaccagccucccugccucaaguuuuauaccuuuccuuuaacaucugucagguuuuaagauguaacugaaguaccacguucuccaggacaccuucccugacuacccccuccacuggauuagguuacccuccuuugugucucauaauaccuuguauaucucuagugugcuucauuaaaaauaacaauagcaaauauuuaaugaguauguacuauguaccgaguaucguuagaagcucauuauauacauuaacacauugaauccucacagcaacccuauaaaguagauacuguuaguaccauguuuuacagauguucaguaccuugccaugacuugaacuccagacacucuuauuugagugccuggucucucagucucugcucgauacuaucuguugccucaaguacuauuuucaccaggaagaugucuauggcucauuucuaaauuacuuuaaaaaauaauuuguggccgggcacgguggcucaugccuguaaucccagcacuuugggaggcugaggcggguggaucaugaggucaggagauugagaccauccuggccaacauagugaaaccccgucucuacuaaaaauacacaaaaauuagccaggcguggugacacgcgccuguagucccagcuacucaggaggcugaggcaggagaaucgcuugaacccaugaggcagagguugcagugagccaagaucgcaccacugcacuccagccuggugacagagugagacuccgucucaaaaaagaaaaaaaauaaaauuguauuuguaaaacuccacauuaaaguuugaagcugaaaaugaucaguucucaggcauuucuuauagacuugaaguacuaaaaaauaaugguaagaucagauaaucccacacuuacauuaaacuaaauacuuuaaaacauuucugcuuccaugagacacauagucccuauuuuccaaguaggaaaaccaaggauagagagaugagaagugauuugucuaaagcaggguuuuucaauauuggcauuaugaacauuugaacauuugggacaagguaauucuuugucauggagguuguccugugcauuguagaauguuuagcagcaucccuggccucuacccacuagacgcaggaguaccucucuccaguugugacaaccaaaaauguugucaaaugucccugggccuggggcaguuggggggagcucaaauucaucuuccauugagaaccacuggcaugaagucuuguguuggcaagucacaguuugaaaacuggccuucuagcucuaaaucuaguucucuuuaauuuuucugaguuggcucacauucucauucugauggggaaaacugguccaugaggcauguuuguacaugaaccuuuuuuucauggaaugcucuuuguauagugugggaauuauuuggugacuaaccaaagaggaguucacaagugguuuacaggaguauuuuguugauugaaucuaguuauucaauguugcccgauuuuguuuuccuaaacaacuuuugugugugcaugguaucugaauggauuugauagaaaagaacaugugugccaagguuuuuauugucuuuaggcuuaugugaaucagcacuuuuacuuuacuaaguuucuguuugccucaaaugccauguuuucuccaucagaaguauuuggcacauagauuguauaguuuuacuagugggcacugcugcuguuucuuaugagaaggcuuugaaaagauuguugcuucucccaggguuuugaacuucugagagaauugcuuguuaauaaauuaucucuccauuuagggcaauguacuacccuaagaacuagucuccuugcaaccugugaccaccugccaccaaaaagaaagaguaaaaaugucuuguauggagcaaggaaagcagggaagcuaagcaggccuggcuggacuacuucaccuagucacucuguggauucccaggaggcugggugaaaggguagggguuucuuccuuuuccauuuuugauauuuuuuucaaauuacaaagguaauuuucuaagauggagaaaugcauacaguauuuagacaugcuuaaugaaaaaacaaaaagaaagaaacaauacagaacuauauggaaaaccaguggaacagaaucaagaacccaaaaaugaacccaaacauauguggucaacuaauuuuccacaagggcaccaaaaaggacacaauggagaaagaauagucuuuucaauaaauggugcugagagaacaggauuuccacaugcaaaagaauuaaauuggacccuuaucuuauacuguacauaaaaaucaacuuaaaauggaugaagaccuaaaaguaagaccugaaaccauaaaccuuuuagaagaaaacauaggggaaaagcuccuuggcauugaccuuggcaaugauuuuauggauaucacaccaaaagcucaggcuacaaaagcaaaaauaaguaaaugggacuacaucaaacuaaaaagcuucugcacagcaaaggaaacaaucagcaaaaugaaaaggcaaccuacagauugggaaaaugguugcaaauauuuacaaaccuuauaucugauaagggguuaauauccaagauuuauaaagaacucauacaacucaauaggaagaaaacauauaacuugauuuaaaaaugggcaaaggacuugaauagauauuucuccaaagaugacauaaaaauagccaacagguaccugaaaaaaugcuaaacaucacuaaucaucaggaauugcaaaugaaagccaccaugagguaccaccucacaccuguuaagauagcuguuaucaaaaagacaagagauaacaaguguugacaaggguguagggaaaagggaacccuugcacacugcugauggaaauguagauuggugcaaccauuauggaaaacaguauggagguuccuaaggaaauuaaaauuaggacuaccaugugacccauaugacccagcaaucccagcaauuuuuagcacguauauaccccucaaaaugaaaucagucugucuaagagauaucugcacucccaauguucauugcugcauuauucacaauagccaagauauggaaacaaccugguuguccaaauggaugaauugauaaagaaacuguuucaugaauagaaacaugaauagaaaauguuucaugcaacauuauucagccuuuaagaaaaggagaccuuccuuuugccacaacauggauggaccuggaggacauuaaaggggaaaaaggucaaauauacagagauauacagagauagagaauaaaacaguggcuaccaagauuggggcaggggaaaggaaauggggagauguaggucagaugauacaaaguagcagauauuuaggaugaacaagucgaaagaucuaauauauaauacaugaggacuauaguugauaauagcauauuguaugcaggauuuuuacuaaaugaguagauuacagcuguucuugccacaaggaaaguggggaauguguaugugagaugauggaguuguuaauuuguuccacuauaguaaauauauauauauaauauauauauauguauauuuauuacaucacauuguauaccuuaaauauacacuguaaaauuuauuuuauaaaagaaauauagagaguaaaaagugaaaguagccaggcaugguggcucacaccuguaauucugacacuuugggaggcuguggcagauggauugcuugaggucagaaguucgagaccagccugggcaacauggcgagacccugucucuacaaaaaauacaaaaauuagccauguuugguggugcacaccuguagucccagcuacuugggaggcugaagcaggaggauuaccugagcccagggaggaugaggcugcagugaaccaugauugcaucaaggcacuccagccugggugacagagggagacugucuagaaaagaaaaaaaaaaagugaaaguccccccuuuaucccucacucuaucuuauuuauauugucagcugcauacacuguaaagaguuugauguguguauccuucugaacuuuuccccauguauuucuguauaaauaugcacacacucacuacucauacaguuuuuuuuccuacauaaauggggucauaccauauauacuauuugguaacauaccuuuucacuuuauacaucucuggcaucguucaaaacaaguacuuaaauacuuuguacuuuaaaaaaaaaacagcugcauaauauucccacccaucugcuucccuauuggcaaacauuuagguauguucuuuauuuuuucuuuucucuuacagugccaaagggaauauuuuaauuccuguguuucauguacuggagcggaaccccuuaggguuuccagggacaacaggccagaauugcacucucugcugccucccaaugugcagaaagagccaguccuuuccguaguucacuagggaagugaguguaauuggugguuccagaggagugacccugagcagucugccuaggaaauuguguucucccuuucagcguuccagaggucaaggaacaccaagcuccaggcccagucugguuaagcuaccucaaacaaaagaccugaauccugcugucauauugcaggcuugaauuugccgauuugccggggcgguggcaggggggcggaggggggacgguauuuuugguuagaugccucaaacacuuuaauuuuucuguuacugucagccagcuauuuagugagcacuuacugugugucaggcacugcuggguaguuucagacaugcacaugguagucuauucagcuaaauuccucaaacauugacgucagucugucuauggacaugaucuccguguuauuuuuauuucucaauuaagggcucauggaagaaaugcuuugcuuuagauuguguuucaauuauauuucacaaauaauccacauuuggagugugguuuaguucauuguuuuguuuuugucccuauccauauaaaucacucuauagaaaaacaucagauucuguuuucacagaagucagggaaauaaguuguuuacacaucaccauuugacucccuucaccccuguccucauuacaaacaucucagccacccaaugaaguuuauuuaaacucccaagccauccaugcaaauaagaccccuacagcuacggaguuuggaggaagaaaggacuaggauugucugccacuuccuuauucucucuacuggguucagaacauuucuuuucaugaguuaauuuacuacccagaggcuuggcuuuaguuguguguccuuuuucaguuuuguaaauuagggaggugguuccauagaaucacagcauaucagaguugucagggagcuuuagaaacaccaucaaaugcaacccucauaccucugugugacuccucuguacaacauauuuugggugaguggucauuugguuuuggagugaaaaccucuucugaucaagaacucccuccccuaagaggcagccguuuaauuuuugguuagcuuuaguugcuaguucuuauguuuguuggcccacaauccaucuccauguaacucuuuuaccauaccaguugcuuucauguggcuucuacucaaguagguuucuacuugguuguuauccuucuaaauugugguacucggaauugcccagugugaugcacaggguagcaauuaccuccuauuaucuacauaguauuacuuuuauugaggcaaccaauuuaacagccacucaugguugaguuagcaaguguuguauuuauaaucaagcaaaauucuccaaacuuuuaucacuggccuucauuucaccuuuggggauuugguccuguauugauaugacaucuuacuaaauuugagcccagauuuuaggguuucaaaauuaguuaacgguucuuccagcuuuaguaauuuguaaauaugaucagugcaucauuuaugccaucacaccagucauugauuaaaaauauugagcagagaagauaccuuaaaauccugauuagagacuuccuuuucaguugacauuaaucuauuaacuagcaccuuuaguacugccauuaaaucagugagggaaccagccagugguguucuuugcaguccagagcagucucucuuggacauuacucuucacuuuguccaaggcccucuugaaauccagaaucaguauauccacuggauuucucugguuuucagcccaguaccccuaucauaaaagggaaugagguuacucugccaugacuuguucuuauaaaacugugccaguuucuuuugaaugccucuuccuuuuugaaaugcucacacaucuucugcuugaugacauguucuaaaauccuguuggggauugauguuagacuggugugauuauuauuugugacagccaccuucuuuuccuuugagacagggucucacucugucgccaggcuggagugcaguggugugaucuuggcucauugcaaccucugccuccuaggcucaaaugaugacaggcacauucuuuuccucuuuaaggaauauggaaacuagaugggcuuuguuuucacucaccuuacccaccucuucuacaccucuguuuccacgaauacuuuucucuuugucaccuuucccagaaauggacugacucucuccuucccauucauucagaacacugcccucaguuuuccuaggugagagcuacuucgugugguaauagguccuaaugggcuaacauguuuuugacaaugaguuucuuuuuccuauucacuuuuugagcagggccuaagucccaaugugugauuagaauggugguaauuugggacaccauggcagguuauuaauguaguguggauggugaaaaccuuucucucaaauagguggcugcccauuucgacuucauauauggcuuucugccaauuguguugggggcgauuucaagucagauugauuggcuaauugcuuguggucaucuggcuuuuuagcugcuuguauagcauccguggagguaauuagcacuuccagaauugggggugaauuggaguuauucauggucauggcuuuuggagugggagcaggggcugcacucgcuucuaguuaugagugaaucauuuuuacuuuaaaaugauuacugaggauugaugaguuucuuuaacaauuaaaaaaauccauuauggaggaguuugauauacaauugccuucuagagccauuuaaaguggccaguuggguucuauauauugugcgauaaacucauugguaggaaauagcuucaaaaguguugagcauuuucuaaaagcgacuggaauuucaauugcagcccuguaccagcacacauaguggaauauuuuucagccaaguguuaauguuaaagaauauauaauacauuuuucauuuaaaaauuucuucauauguaaaugucauguaaaagccacugguaucugacagugauucccaaauuuagaaucaucagaaugucaaggugauuucucccuuuuaaaaacaauguuccugggcgauuuauaggacggagaacaaccaagcagaacaucucaggacugccauuuccucacguaccuggcauuugucagugucaaucaguacugaaauucaaccuguggcaguaaagcaaagccgagagucaucugcuuauuuugacuguuccuuuuucauaauuaaaugggagcugauguuaucaucuuuggaagauccagcuugagggugacuugcuuuugcaaugcaaauaaacaguaggccugggccacugccgagccuagggcugagaagccuuggcccaaccagcuguuguaauccaguuguucccaugcuguucagggugguccuccaauccuuugaccugcuggcuggguuguacagcccucaucuuagagguucuuccaguuuucccucuuucuguguuagauucucagccuugacuaauggcuggaauuuauggaaggcuagaagggaaaggcaauaauuucucuccucugucuucccagugaucaggaagaccuaccgucuauuucaggaugggggugggguggggauuuagggaggacauguuuuagauuauucucucuugaauucuugcuuuagggcuucucauaaaggagggagcagugucugagaccuaccauguccuaucucucugaucagagcuuccagccugccuccuccacuuccuguguuuagcaaguuugauuuuuacuuucacuugcuuuucucuucucagccugucuccucucccugacuaaauggguccgauuuuguuuccuaaaaggagauuaaauugcucuuugcuggaaaagagaaacaaacagucgcuugggaugcuguguguguguguguguguguacacgcguguauguguugguaaagggugcucagauggggaauguaaggcuucuuguuggaagucuguuuucaauccuaauggcucuuuucauccuaaaacuguuuggguucaaauccuggcucugccucuaugugaccuugggcaagagccuuauccucuuagaccuucauguuccccgucuuuaaaauggggcuaauagaagacucuaccucacauagcuguagucaggaucaaguaaauaagcugggaaaaggugggauggaggugguggcagugguaccuuuauugucaccccugucauccuuaccagcagacagaacugagggaaguuguuuuuguuuuuguuuuuguuuuuccugaggauccaguauuugauccagaggaaguugcacaaccuaucuaagcccaaacuguuucugucccuggagaccaagcuagaucuucugggggcggggggcaagggggcgguugguggugaaucaaucaaagagcugucuucaggagugggaagugucaugagaauaaacagcugcuccuuccacccugcacccacuccugcugcuaaauuacucuagggaagaggaaaccagucaucaaaggcuucugccaccugugcacagcugguaguuccugaggucacccuuauaguggcuagaggaguuuagaaaguauccacugggucaagacacugauauauccauuucccaaaggcccaaggacuugcugcccccuccauccuccauucucagagcuggaaagcuccuuuguaaggugggaccacaacuaguacaaacacacuuuguaaguuggacacacaaggucuuccacagugccauuuugggaacaguaucccuugagagauucucagugggaaaggcguaggaccagucuuucuuccuccuuucccucuagccuucucuuaaaaaggaagaagagaaagucauucuucuugagcuacuugcugccaagugucauucucccagggaauccaggcuguuucagccagacuucccuuuuccuggcuuuaagguuaccaagccaaguggaaguauacaaggcccaaagguaaaguuccuguuccagauggggcagaguagccggcgacugcuagagggcagcagagggccaggagcaggucuagaacugcuuaauggccagauggcaaccagacuacugccagagcaaaagacgucagaggucccucauuguugcggggagaaagaaguaggauggucccuaaccaggagagacaggcacauccaggaaauguuaacauaacauggcggagacacaucacagagcaggcaacuggguugguauacagugcaacauaucaggguaggcagggccaacguuuuaguaaaagaagaaagaaagcauauuugccauaaagaucaagucagaaccagugcuacggucaaaguucaagucaagguugaaaaaaucaaggcucaaaagcuagaauuggacugauucagcucaguuauuuauugaguaucuuucaagaaaggcacaauaauggaauaguuaagaucauagacuuuggaaucacauaggaacugggguuugaaucacugcucugccaucuauuagcuaaaugacuuuuugucaaguuacucagccugucugcaccacuuugaaaucauauguacagaugcuaaagaaauguuugcugagcaaaucacuuuuauccagagguguuucuagaaggauugggguuacugauuguagcuccccaccucaaaguucuauuccauuugguuuaguacuuguuuuugucccuuguuuaagaugaguggaguggcuaccggugcugccuugguucccagccagcaaggaccugauugguaguggggcaugaauagagcuaagaggggcccggagaccagaggagagaaacaauaccaaaguuucugggaagaauucugagaucaguuaauucaugugcaaaucaggaagacagaauauucugacuuauucuaaaaugguauuuucucuauauuuucauaaccuuguaauagaaauagcuaagcuaaaagaaaaucugauuaaaugaaauggcauuuuaugagucuugagugaggcaaaaauuuggauuaucuuguuaaacuuaagugagcaaguaaaugcaaugugguauugugaauuagagccugggacagauaaaggacauuagugggaaaucuggggaaauccaaauaaaggugguaguucaguuaaucauguuauacccauguuuauuuuuaaauuuugacaaauaauccaugguuauguaagguguuaauauuagggggagcuggaugaaacuaauuuugcaacucuuauguaaauuuaaaauuauuuuaaaauaaaaaguuuuaaaaauuaaguagccgaaucucuuaccaucaacagugauuagcucuguuuugguuuuuauuuaauugcacugugucugaagacguuuugaaaauacauaggauugggauagggauuagcauauuucuacuauauacucaguuuugaacucugcccuuuuuccucuuaacaauauacauguguauuuucauauuccaauaaaagcucaccuaaaugugauuguuaauauguauaauguauuuaaccagccccuuauugauauacauguagguuguccccaauuuuaugcuaguguaaauaaugccacaguuaucaccuguguacacauauuuuuaugcucauuucuaauguuuccuugaggguaaagaccuaaaaguaaaauaauugaggaauaugaacuuuuaaaaagaucuugaugcuuaauguuaaaucauccuccagaagaauuugaucaauuuauauaccuaugagcaguguguggugucugugccacuaccuccuuuuuccuaauugagucuauuaggaaaaagcaucuuucugcuucauguacuugcuuuuaacuuagcuccuuucuaggaauuucaguuucuuucuuuuucuuuuuuuuuuuugacaggaucuuacucuguugcccagacugggguguaguggugugaucaagcucacugcagccucgaucuccugagcucaagugauucuccugcuucaguuuccuaaguagcugggacuacaggcaugugccaccaugccuggcuaauuuuuuuuuuuaauuuuuaguagagaugaggucuugcuguguugcucaggcuggucuugaacucccgagcucaagcaguccuccuaccucagcuuccaaaagugcugagauuacaggugugagccacuguacccggcagaaucucaguuucaacucagauuuuuuuuuuuuuuugagacaggaucuugcucugucacauaggcuggagugcaguggcaugaacacacacaucgaggucgaggcucacugcagccuugaccucuugagcucaagcaguccuccugcaucagccuccugaguaggugggaccacaggggcaagccaccuaugcuuggcuaauauuuuuuuuaaauuuucacagagaugggaucucccuguguuacccaggcugaucucgaacuccuuggcucaggcaauccucccaccuuaaccucccaaagugcugggauuacaggugugaaccaccaugucuggccaacccagacuuagcccucucuuccuuuacccuuuuaccauuuuuauauguaauuccuuaacgugguagcuaugugggauauuaucuuuuuaaagaauauaucuuacugacauguaacaggagauucucuuugucuuuuacauuauuucugguaauauuaugaaauucacagacaauguuuuuauauuuacauauacacacuuuaaugucaccgaagggaagggguugugaaaacaagugaaaguugaaguuuagggaaucacuaccuacuggaguuggagagcaccaacuuggcaugacuuggauuuacuaaauguaccauugccuagcacuguacuccucacagguaguaaguaccuucucaauaaacaggacgaacagcugaaaucugcaguggugcaauggaggcaaaagggucuagaauguucuugguggugggaaugccauuucugcuccuaguucacuguguugggucucauuugaauucagggaccuugcuuagcaccugugcuucuggaggagaguauccuagcuggguugcuggccucuucugcagcagggacugcucugucagaaaaugagcugccacugcaguggaggugguucuuuccgcuucugucgcccuucacagucucagcuccucucguauuuauaagacugcuuuaauagucuugucuuguaauuacaucuggagacaggagacagcaucuuuugauaguucaaguccuaacgcauuuaaauugcccuccuaaugcuauaaaagagucaaauuauauauucugguuuguacuagauagcaauaaaugucaaggugccauccacucugguauuuaacuccuugcugccaucuguuuuggugcucuucacauggaccauacacuaguguuuuccuaucuccuggcacgaaaggaucaaguugggagauaaaucucacuauucaaaauauauuaaaaggcagaggcaguuuguaaacauugcuuuggaaagcuaggcguagcaauaaagucaaggacaggaaccugauuuaguaaaggaaacauuucacuagauugucauccacuuuauuuuuaaagcugcaauaagauguaacgauaaaaaggccaaugaugcauuucagccaagugauaugaacucuugcuaaaccaauuaaacugucaguauacuaugguuucaguuucuauaacauacuaggucaccuuagaauacuuagucacguaugacuuuuuaccacugaugcaaaaucaauuuggcaauuuauaaucuuacauuucauuaugaaaguauauuauucuacaagaaagcugcuggaaaaaugagauauuucugaagcccauucacuccucuccugcuuaaguagucauaaaagaauaaaaccaaucauguuaucugauguuuugagaauucuagguaguuuuuuauuuauaugauuuuuuuaaaaagauauacgaaguauacaguuucuaacccuggauacaauuuugaauguuggauaaaauuguggacauuaaaaaguaaaaauuuugauuaaagagcucacuuuuucaccuacguuuuucaauuuuguaguguguggacagaaagaaaacuuugcuuaaguaugccagagggugggcuuuuuuaguguccuauauuugagguuuugagcuccagcucuccucaaagggauagagcagcugguuauucauauuuaauaccaucacauuuuucaauuuugguguuuggaaauucugaguuauagaaugaugaaccagcaguauuugagaggugguggggaaacagaaaaaggaagaguuggagacuuuuauuguuauuacuguaauuuuuuaaaaaaauaucuucccuuuuucucucuaggacaaauguaacacugcuuuuugaaaaaccaaugacagucauaaaacacacaugacagauccuuaguuuuaggugcucauuaguacaguaggggacagaucuguucuuauacucucauauagcaaacaagaacauaauuaacauugacuguauagcccuuuacuucugcuaugagcucagugaggauuuucuuuaacugcauuaacacuggaccauuuaaacuugagguuuucaucuuuuucaguuuaagucaugguuacagaguuggcagggguaucuacuauauuaauuuagauucaguugggaucaaguaugucuaauuuacauaugauacaaggacugugggccacucaggcauuugccugccuccauuguuucagguaauuccacugucauugguguaucuccuauuuguauauucuuucucagacuccagucugaacacauggaacacauugaacaaaaagagaaacacagagcaggaauugacuaauugaaaugagacucauuucacacuuucuuucuugcugagaaagguauuagaacgacuuucuguguguuaaguauggagauaggcauuugcaccugcacugucucauuuaaacucacaacaacucuuuagcguagguaauauuauucucuacuuuagagaugaggacugaggcucagggagauuaaggaauuugccauggacauaaugcuaggaaaugguagaguuuaguuuccaauucaggacuuucacucuaauuucaguguucuuuuggcuccauugggguuauuuauuauuauuauuaucaucaucaucauugagacaggaucucacuuugucacccagguuggagugcaguggugugaccauggcuuauugcagcuuugauuuccugggcucaagugauccuccuaccucagccuccugaguagcugggacuacaggcaugugccaucacacuuggcuaaauauuuuauuauuuguagaaauugggucuuccuguguuacccaggcuggucuugaacuucugggcuccagugaucucccugcuuuugccucccaaaguccucggauuacggaugugagccaccaugcccagucuauuuauuauuguugauacaaugaagucuugauaagccagacuacuuagggaaugguaauauacccuauggggggguuagacagugggaaaauuaacaauuuuggcuguuuuuaaaaaauuaauaauguauugguauaauaccuguuaacuuuagaaaauugaaaaacacagauaagaaaauuauucacccauaauacuaagaccuagagauaacuacucauaacagcuuaguuaacagacuuuuuaauagaaaaaaguguauauauacuuuuuaaaaagucuuguaguauacauaccauuuuauacccugcuuuguaaacaaccuaacaauauauugugaacauuuuuuccguauuauuauguggaugccaaugccauuuuaauggcuaugcaauauuguuugaguguacugucauauauuuaaacaauccuuuuuuuuuuuuuuuuuuuugagacagagucucacuuugccacccaggcuggggugcaguggugugaucucggcuuacugcaaccuucgccucccagguucaaucgauucuccugccucagccucccaaguagcugggauuacaggugugugcuaccacgcuggcaauuuuuuuguauuuuuaguagagacgggguuuuaccauguuggcuaggcuggucuugaacuccuggccucaagugauccacccaccucccaaggugcugggauuacaggcuugagccacaaugccuggucaaccaauccauuguaacuaucuuaaugagaaucagucugcugguuugagaguaucugucugaugucacaaugucugguaaaguaguggcuucuuaaaauguucagaauaugcauuucauuauuagguagcuaugauugaauguacauaauguugcagacuucuuuuucaagaugcugguuuccuaggacauggcccaaaagccuaacuuuugaaacuuuugcuuagacauccacagguaacacuaagccagaaaccccugauggggaguuaaaugcaugaugaccaaacauaauguauguauuaggggaaacagaaacacuuuuuucucuugaauuuucauuggaaguguccucuggguugaaguacuaaagauucagguuaaaagacaauuaugaccaggcaccguggcucacgccuguaaucccagcacuuugggaggcugaggcagguggaucaccugaggucaggaguucaagaacagccuggccaacauagugaaacccugucucuacuaagaauacaaaaaauuagccaggcgugguggugggugccuguaauccuagcugcuugggagggugaggcaggagaauugcuugaacccaggaggcggagguugcagugagcugagauugcgccauugcucuccagccugggcaacaagagcgaaccuccaucucaaaaauaaauaaauaaauaaaaagacaauuauuuuuguuaaauugguguugugacuguuaaucaaucaugguacauccauacaauggaauauuaugaugcuguuaacaauuaugcuuucaaagaauauuuuaugguaagaaaaaaugaucuuuuaugagccagaugaugauacuuguuaaaauuuuauaaagaaaagaauauaaaacuuuauauauauauauauauauauauauauauauauauauuuccaguuugaugaaaaaauacauaagcaucuaugcugcauuaucugguuguuuuuuuuuuuggcauggugggcuaagaguuaauuuuuguuucucuuuuuauuuucugaauuuuucaaaaaauuauagugauauauaucuuuugcuacaaaaaagaaauaaucauauuugagugagggaaauaugaaaccauuacuuaaugcuaaaacuuuuaaaaaguaacauuuuugauuguuaacuaagugcuaacuauacuguacuagcauauuagucuuuacagcaccucgaggaagguaccauuauuguccauuugaggaagucauuugcucaagaccacacagauuggauggggcagagucaggauuucaacuugggucuguuuauuuccaaagacugugugagauaaaauauaauggggucaagagacaggaggcuuauuuuuucuuaaccaguugcaaaccgagcagucuaagcaguacugggacgagaaaguacaaauugagagccaggguauagguauagggcauuuaugcuggugaaaccugggagguccuugggugccagagguuagcccaggggcucugaaucccuggggcugauaauaucuagccucauagcucuauugugaggauuaaaugagacaauucauguaaagggcacaugauacaggcuugcucaauaaauaguagcuaguauuauuauuucucuuauuuaggaccuugcuuguuauagggauuagagacucccagaagccugaggcaagacauguuuacccuagugaauccugucacaucuuaauaguccucaaacauuccucaccauugaaaugccuuuuauuugaaccuuucaaauaaacaagccuuaaucagcuuugugggcccuaccagcuuuuuuagaaaaccucucugcuuuugggguggggcgguauuuauuuacucacugaaaauagggacuuuguguaauacaagggaagcaggaggugauugguuuggaguuaauaggcaagcuuuuuuuuuuuuucucuuuaacuugaggaggcuugauuggguuaugcucccuaaagacucuuggagagucugggaauuuugagaacaaaagcucugcagggaggccaccaaagagagcaggcucuccaccaaucuuuguauguucuuaaauuuuucauucuauuucuuuccucucuucagucccuagaauagaguggcuuuaucuugaagccauggagauuuacgaaacaaccaagguuggccucccuuuguugagcuuaugaaagccauauuuagauugaggaggaauguguuuuucccuugggaggccccucuauaccugcagccaucagaaauuccauauuaaaaucccacguuuaagucuuuacagcuaaagucuguucuugcaugucuggaccagguccagcugucagacugagauauuauugacuuuuucuucucaagugagugguuuacaucuguuggcuccauuucuuuaccacuaauucugaaacaccuuguaaucugacuucugccacugccucucugcuaaaauuuugcccuugcagguuaccagcaacugacuuuuugcuaaauucauuggcacuuauuuuuccucaucccuuucuucuccauggauguuucucuucccuugguuccagacacuacaugaauuuaacucuccuccuaccuuucugaguauuccuucucuccuuugugauggaaagucuucuuccucugccucuccuaugcaaaugugauuguuccccaaaggggugcagugcucccuugucucucuacucuucauucauucucagagcuucaacugcuuccucaaugcaguuaacuucuccaguucugacuucuuacccaugccuaguccuauuuuuuuuuuuuuuuuuuuugagacggagucucccucuguugcccaggcuggagugcaguggcacgaucucggcucacugcaaccucuaccucccggguucaagcaauucuccugccucagacucccgaguagcugggacuacaggcgugcaccaccacgcccggccuaguccuauauuucuuacugccuaauaguaauuaaaacuaucuuuuaugagccagacauugugauaugugcuuuauauacaucaucuguaauccucacaacacucuucaaagcagauagucuuaagcccauguuauagacaaggcagccaguucaaauaaguuauaaaaguuuuuauuuuuccauuucaaucucuuaacauuaauugaaacucagcaaguccaaaagagaauuccucccucucuggguccuaacuagcuguccuucucacuuuaaggcagugucauucucccaccuucuguuauaucacucacaggcugagaggauugaaaaucagucaggcaauugcuuuggaauaacacgcaccccccuucccccaccaaaaaaaaaaaaaaacccaauuccuucaaaaucucccaagcccaauucauugcaaccccaaaucuugaaaauuaaaguuuaagcuaucauacagugagcaauccucaaccauuaugagagcuaaaucugauagcuuucacauacugcgugcucugggcugccuaggguuaagcauaauucucaggauuuagcugugcuuucuucaauccuuaggacuugcucuucccaaacgggaccuucccauaggcggggcugcccuagguucuguguaguucgccuugcacaggcaguaaucccaccccuccuguguagaagcuagaaagccuauugaaaugugagugauuuagcaaugguauuucuauauaaaggugugacuuucaauucacuuuuuuuuguaaagaaaauuacuuacaaaugaugguaguuaguauucauaacagcugaugcagaacacuuauucacagcugaucuggacauaccaauguguugagacaaugauuuugaaaaccacuuccacagauuauuagggaaggcccaaaugcccaucagugagggucagcuuucauuucuguguggcauauuugccuaaugcuacaaaauuuuaaacuugauacuacucaagaaucagagaauugagaaacugagcauuuuuugaaggcugugacaggaucaccaggugacaacaucucauugagauguugcacaugccaaaccaaaugcuuuacuugggcuguuuuuacuccacuagcaucucugugacuccuucauuuuuuaaagcggaaaucuaccauagcugccaucauuuucaaugggaggaguacagaaggucaaaaguucaguuauauacuguucuugugaagucaagcuacaaggaaguauagccccauugggaaauuucgguuaucuauuugguaugucaguuucuucuauuaguaagguaucugugccccaaauuguagugacacuacuauuuaaucagacuugacuaggauggcagcauagaguugaaagagaaacucagauuagccuuuggugacuugucuucuuaauaaggaaauuagaacauaccuuuuaaaaaaaaucugagcgccuggauauuuaaucacugucaugaaaggaagauaaaaggcugauguguuuuccaggauguuaaccuguaucgaguugaacaaauguguaaauuaguccuauauguacugcauauagacgugaucuguucacaacuagcacaguaccuagcauguauuugaggcucaaugaaaauuuguagaauguuaauuuguuacuuuagcaaaacaaagauuaaaaaguacugaauuauuaagaaaugucucccauaguaguuagcauaaauaaaaguuugaucagagcaaaaucuaauuugcaaagaaggucacagaaaugcuuauguuuuaaggaaagcuuuaugcuaaaauguaaaauauuaacaguaucuuacagggcacuuuuuuucuuccugaacauaguacagagaguguuuucacauuuagcacauaccaauuggaugaaagacaguggggaggaggugagguugaacacagggucgcuuggaagcaucacuccaucuggacacagaucauggaggaccuugcaucagauucauuuggggacucaauauucucuugggcuguuccugaaauucuuguccuucaaacaaagaguuaggccugaugcuaguuagaaucugaucagcaacuaggguuacaugugauguucuaugcuccucagagaaaaguaauugaauagaagccuacuaacaacuagcuuuccccauaaauugguagucaaugcaauugacagaugguuguaagugccuucuuugugcuuagauugugugaugccuucugugaaaguuugagaugugguccuugucgcagagaugcuuaaaggcaagauacucacaaaugaaauaguuaaauaacaguacaagguaguuugagaaucauaguuugagaaggaacuaugaagaucauuuaguccaaaauuuccauuuucaaaaaaguuaagcucagauuaggaaguagaauuucccagggucuggaagacaauugguaaaagcuggaacuagcacucaagucugccuuuuuuuuuccauucuguuauauacaugguuauaugauguuuugacaugcuuauauugaucugccauuuugaugcugggaacuuucugaugagacuguuuugauaugggggugcuucuacaacagcugcaaaacaaaccaauaaaacauuccacuacuuuuuuuuaauuuuuuauuaccaaguaaugugcaaaacagacagacaugccccagcccucaguuucaccucaucccccagccaugaggauggagaucagggauaaggugggaguaggggucaaaaauggaaugggugucauggauggggugaaucucagagaagagaugaaggauggaguagggggucaggcaccaucuggcaagcaaagcacacaucuccaggagccauauguuucccacacuugcucaucuuugaaaggccauuaaucauuuugggcauaguaucugcucauucucugagaauucucuuauuucuugaauagucugugucuuaaaauuucugauuccaaaccuucaagagacaagauucuagaguagaggaguauguuugcgucauaguauggucucauauacucagauccaggcuucacugggaguccuugagucaaugucugucaguucugucauuaauauucccuguaaaaccccaugaaaaaauaauaugcaucuguuauuuuuaaaaucguaaaacuucgauauucugaugguuugagggaauagguuuauuaggcucuuuagagguuuaucuuuuuuuuaauaccaaacaaacuuaaaaauacaucuguuuccugauuauacauauaugaauuuuucacuuccucaaggcaguuuuucauaugaaauuauucuuuaaaauuuacuucugaaauauggagaaucuaaaggcaaaaaggaaugcguaaucuaaaacauucauauugaagaaaguagaaagugagaguucccuguaauuuggauaaggguugaggaaaaaguaucagacagguaaaugauaaacagcuccuaguagucuguuuuuaucauggcugcaucaugauggcugaaucagaacaaccaugccagaaugucaaauauaaauaugucuugauuuuagcagaacauuugagagucuucuguaauauccuugugcauagauugugaaauuugacugcauaacuaguaauuaggcagauucacagcugguugaucagcggauucaaugucaaccuggaagaaaauguuuuuagugaagggccacaggaacuguuuuuuggcucugcccaaauauucguuuauuuaacaaauaacagacacuuacuauauagagggcacccuacuaagcacugugaggaauacacagcuguccagaucagggccccugcccuaaagaagcagauuguugaucauaauugaucacaaagacaggcuuuuugcauugcagauaucgcaaagcuggguggcguaguucaauauauaggaugacagacuccagauuuaaaaugaucucaacuuguaggaacucuaggucaaaacuuacaagacgaaaguuaacagugauagauguaaagucuugaauuuagguuaagaaaauugcauauguacaggauaugagagaugugacuuggcagcaguuuauguaaaaaguucuuggggauuuaguugaucacaaguuuaauaugagccaacaaugugguguagcuuauuuuuuuuuuuaagcaaaaacaauuuuaggcuguauuagaagcaugugugcugcucagaccacaucuggaguauuauguucaaguauagucaccacauuuuaugaacauugacaaaguugaauguauccagaagauagugaccaggaugggucugaaaaucaugucauaugagaaaugguugaaagaaagaacuggggauaauuagcuuuuacuuuaagccucgguuuagacccuucaagucuugguuagguucccuugcuaugugcuccacaguccucugaacaagccucaugccuuccccacuagaccaaggacuuuguuagggcaggguaggggcucugugaggacuuuguuagggcaggguaggggcucuguguucacuaugauauccacaagaccuagcaugggacaggauguguccucagcaauggucagagaaugagugagugaaauuuccaauugugagggccuuacguaaaaaugauaaagaacuguagugccuggcaucuauagucauuaaauuaaaaaacgaacaaggaacuuagaagagguccuaaaaguuuuugaauggugcuuuuuguuuuuuggccucucugacuuucuuuugaccuuugauaguacuugauacuagacuugcaugucugguuuaacaggaaucuuaaaaagucaucucuccgaaaggagcauuuuuuuaaaauaggagaaaguucuggcacuaguaucaaggagaugcaaaaacaaugggauaccauuuuuuacucgaaaauuagcaaaggaauauauauauauauguaacauauauaaauauauaaauaucugcuaucaguaaggauuuagucaaauggacacauuuguacauuucugguacaacccuuuuggaacagcaauuuggcaaucuguauuaucaagggccuaaaaauauucauuguuugauccaagaauuuuacuucugggaacuucuccuaagaaaagucauccugaauacaggggggagaaaagcuuuaugaacggagguguuuuaggaaaacaaaaaauuggaaacaaucaaaauguuccauaguagaggagugaaugguuauauaaacuaugauauguccauuugauagaauguuauaaagcuuuguaguuuguaguuucagaagcauauaaagcuguguauauaguaugauauaacugugugaaaacaaacaaacugaaaucuguacauagauaaaauucuaugaagucuuauaccacaaugugaacaguagcuauuuuucaguggugagaugaucaauuauuuuugcuuuuuuuuuccuauuuucuaaauuuuucauuuaaaagauuuuauauugaagacaaauuuuguagugugcccuauugugucuagaaauaaaccuuguaugguuuugaauuucuaguucaggucuucaacauuccuguauauuuccaguuuauaugaagggacuuaugaaauugugaggaaaaaacaaacccaaacaucuucagggcaaaauugauuuuaauucuaaaguuaauugaaauuaauuuuaauucacuuuaauuuaaaacauauauguaaacguaugucaugaacacuuuuaggucagggguauguuaaggaaucucacgaauaaaagacuacaacuuuuuuuuuuuuuuugagauggagucucacucugucgcccaggcuggagugcaguggugcgaucucggcucacugcaagcuccgccucccggguucaagcgauucuccuuccucggccucccgaguagcugggacuacaggcgcccgccaccacgcccagcuaauuuuuuuguauuuuuaguagagaugggguuucaccguuuguuagccaggauggucucguguuagccaggauggucucgaucuccugaccuggugaucugcccgccucggccucccaaagugcugggauuacaggcgugagccaccgugcccggccaacuuuuaaaaauaaaaaaguaaucauaccagauucuagagagccaggcaccuuuugcagacggaaaugaaaacgugccuugcagguagcaggcacuuaauacaguuuugaauggcuagcuccuagaggugaguagggaagaaugagagcuugacuguaaauggauacaacugaguggcuguauguauacuggaagaaucuggaaaucagguguuaccuuauuacaucaaaucuguuuuaauggauauuuauauauugcucagauauaucaaaguucuagcugucagaccucuguugacugugaaaaugcaucuauuacaaguaauuugcacuaaccugugacucuggacauuuaaucgaguucaauuuaccucuuuuaucaaaauuacaaguugccuuuuuaauaucuauauuuuaauuuaauacacaguuuaccuccuacauguagaaggcauguucacaggcacauuugaugcaaacuuaauuucuuauguuuugaagucaauuuugggcugcauauuaaugcagccuauccucccuucuuucccuaauaauggcagagauaucuugauucuugucacuugcauuuuuuuucuucuuuaccacuuagaaaaagaacacugcagacuuuaggaaauagaaugguuuugaguuuuguccgugauguuguggguaucagcauucuaguagggguacagccagaauagaucugguuucauuaagaauguguggagacaaucuagguuugaagaaaguagaguuuuuauacauguucacguugcaugucccuggucuuugugaguugcaguucugcuuagcauguagaucuaucucuaugaaauuaauuuucuccucuguuuucauguuuaugacauauuaagguuauugcagacaguacuauuaagaggaugaauuuaauaagaacgauuucuguuucuuaccuacuuuuugccuuuuuucucuccuuguccacccuccauuuuguuuuaaauauauucauucaucuuuucuuguaucaccuuguuucugucucaacaggaagcaaaccauucuucagaacuggucaaauccuuuuuuuuuuaaccccaaauccccacuaaaugaaaaguuucauacgguauuagauugacauuucuacaaagccaaagaaaggagaaucucugggaacagauuugacauccauuuucuuuuaagaugucuuagacuaguguucugcagauucaguugacugagagauuuuuccacaugauaaccugaaggugugaucucccggggauggguauucuuaaacgggggaucuggacaacuugaaagaaagcugugaacuucaaagcuccuuacaccuccaccacaguuaacuuuauagugucacugcucuggcaaauguuaauagcuugaucauuugccugcagauaacuccauuggaaacuguagaguauuucaguggggaauagccaguaggucuuugaucuccauauagauagagauagaauaauucagaaagaauucuuuuggagugauuuauggcagaggcagcacaauuuuaugaauguuucccuccaguauguccaaaauaucuuggcaaauaucaguacaagauguacucuuuccaugguuucaacuucucuuaugaaaugggguucuugauuauaugguuuuccaaccgcucuuuuuucuuuaauacaaugguuuuaagaauaaguacugacaguuaaacauguaaacuguuggugcuuggugaggggagacuuacuuugaaaagagcagaugguaccccgugggguggagacgaugugguaaauuugcuuucuuugcuguguccauaaggucauguacaaauggccagaaagcaaaugaagguacccuugaagccguuugcacuuagaugucaacuuucuuucaggaaagacuauuuuucuuuauuuuugcuuuuauauagaucuaggccucaauguuguuuguugguuucucuuuuuuauugcuacuuauuuagugcugccucaucaaugacuuagguuucucuuugaaguggcugaguaccaccucuauaguucaguuucuuaaggacuccagugauaaacuagacuugaaccaguaaccuagucagcauauuuuuccuaaaugccuccugccuucucaucaacauuuuaaucugugagaggacacaugcuagaauuacuauugacggggauguauuuucuccuaaguggcuuuguugguuuugggaaucuuuccucucucucuggguagcuaaagacuacccaucuucacagcuaaguccuaccuccuccucuccauuucaaacuggccucagucccauuucugaccucucagagcacuaacugccagccugauaauaguuuuagcacuccauuucauuauuccuugguucuuucugguguuuuccuuuuuacuucccaauuuguuugcggggcucugagggagagaccuuguuucacagaauuauuccuuuauuaacaugagguauaugguccagugacccacuuuguugucacacaguuugugaccagaggaagaaaugauguaagaaacacagggcucccagauuucaaagaaaaaaaaugaugagagagugaacggguuggcacuaagcucucucauuacguaugaacuaaaaucaugucagauauaucagaaaacaucaacuggauauugaugagaauguuaauguacacugaguuauuugaaacacuucagcuauccuucuacacuguccucuagauuguauugaggaucuguaccucgguacuggcacggcuguugcucagggcucagcaacuaccuggaugaagcucuuguggccccauugcuacccugagccaggguaccugugggccagguauuuggcgacuuuccugcuccuccaaucacagucuugugugccuuugccugucuccucagcuauuucugcucaguacaucucggucagggucgaucagaaaccagacccagauuuaggucaguaagggagaggaagacugagugccauaaaggcaagcaagaaaggggaggagugggaaugauacaagucagcucccacuuggcuccuaacaguauuccccuuuccuucucugccaguggcuugcugcaaaggaaauacaagucucuguucagucaaagagauguacauaaaaauguauuuauuuauuuauauuuuauuuguuuguuuguuuguuuguuuguuuucagacagaguuucgcucuugucgcccaggcuggagugcaguggcacggucuuggcugacugccacuuccgccucccggguucaagcaauucuccuaccucagccucccaaguagcugggacuacaggugcacgccacugcgccuggcuaauuuuugcauuuuuuuuaguagagacggggucucaccauguuggccagacugaucucgaacuccuagccucaggugauccaggcaccuuggccucccaaauugcugggauuacaggcaugagccaccaugcccggccauaaaaacauauuuauaaggggguuaacugcagcauuguuuaugcaguaagagcaaacaauuggaaaacagucuaaaugucugaacauaggggaaugguuauguagaggacacuaugauaaagccauuaaaaugggugauuuuuuuuuuuuuugagacagagucucacucuauugcccaggcuggagugcaguggcacaaucucagcucacugcaaucucugucucccagguucaagcgauucuccugccaggcuggucuugaacuccugaccucaagugaucugcccgccucggccucccaaagugcugggauugcaggcaugggcuaccgcacccggccuaaaaugguguuuuuaaagacuuuuaaugacaguggaaaauauucacaaaauaauacaugggaagaagcaaaacaucaggcaauauaacuaaucucagaacugacuauaguauacagauagaaaaugcuauaaggaaauauacuagaauauuaauggagauuguuuuugugugguagaaucauggauaguuucuuuuuuguuuuacauauccuaaaauuucuuuuuuucuuuuucuuuuugagacaggaucuugcucugucacccagguuggguugcaguggugcaaucuuggcucacuguaaccucugccuccuggguucaagugauucucgugccuuagccucccaaguagcugggauuacaggugugcaccaccacgccuggcuaguuuuuguauuuuuaguagagacgagguuucaccguguuggccaggcuagugucaaaauccuggccucaagugauucccucgccuuggccucccaaaguucuggaauuauaggugcaccuccuaaaauuucuguaaugcagacuuaugauuuuuauaaucagaaaaaugagaagaaaauguucuuugccauaaucuucaaccuccaacccaagacaucucacaugccuagauguagauaauuauuuuuucugagaacaaaaguaauauauuugaauuauuaaaacuuuuuaaaaacauacaaaaauaugaaggaaaaauagcagugaauugucuuaaaguguccuucuuuaaauaaaacugauuucuuuuucagaaaagcuuauuugaaguaucacuguacuuucuguuaccuaauaaaauagcaaaggcucaaauauuugguuaauucaaaauauuuuaaagcagauucuuuuauuuagauggcaucuucauccaugauuuuuagaaauggaaaggacauuguauaucaucuggcccaaccccuggguaaaguucaagaguagguuuugacaguauucuaugucaggcacaguucuaacgucccugagacucagcgagucuaagugaccugcuucaggucacacagccagcucuagaaauugggagauaguacuuugcuccaucaguuguaauuccaacggggaaaaacguuuuugacauucugcagaugguagcauucuuaaaaacacauaccucaaaccucuuuucugaaauaagaaauuaccuuuuccccccucuucagguguauaacuuuaacucaaaaauauccagagauugccaggcgcaguggcucaugccuguaaucccagcaacuugggaggccgaggcgggcagaucgcgaggucaagagauugagaccauccuggccaacauggugaaaccccaucucuacuaaaaauacaaaaauuuacugggugugguggugcgggccuguagucccagcuacucgggaggcuaaggcaggagaaucgcuugaacccgggagguggagguugcagugagccgagaccgugccacugcacugcagccuggugucagagcgagauucugucucaaaaauaaaauaaaauaaaaaaugaaauaauaauaauaauaaaauccagagacaaguuaaaaagaaauauguguauguguauauguaugugauaugaaaugagcaaaguuuucacuuccaugaaaaaagguacuuguguuugagaauguuuucaaauuaaagaaaaaguuuaauauuaaguaaauauuugguauaaaaauucaccuagguuaaugucuuuuaagcuuuuuuggucuacccucuugcaaagaaauaguauuauuugauuuacaauuaacuucugaaucaaauguuaacauuucauaugccauuaaauacaucuauuauagaaaugguucuuuugaugaauuuuuauaguggcaugcugucguauuaaccagaaauacaacauuauuuuuauuauaucugcuucagaaacagaagugguuaguuugauucaaacagaaauuccuggaaaacccaugugguuuucuuuaugagcaauuuaaggacacguucuuccaaagagagagauggacaauauaaaacauaauccacuuuuaaaaauaaauucuacucugugaaaaaguucccccugaguggugcucaguaaacccuuugguaucaguaguuugucagcucuagcacaauuggagcuugugugggaagccauuucacucaguggugguugcucugccaccaccaagaagccagagaacaugggcuguaacugaggagaaggauaaccaugagagaaguaauaagcagaccuuagaaaaucuuugaaaugguccuagguaagaucucuuauccuggaaucagauuccccuuccuccuuaucauuuuguuggaggaacauuugagaaagaaauggauuuucaguugacuaggaaaauguaaauugauaaaaaaaaaaaguuaaagaagaugaacccuuguauugcuguguuguuuaauccucagaucuuccacauggaguaagaaauaaguaccugguauuuccucagggaccauagcuauucagucuggaugagcucugacucuuaagaaaaaguguguagaguugcugcuauguucuugcuaccaccacuugaugguacuucuuuauugaaaacccaucuguuuucucauggacuuuuugcacaaggcccucuaugugccaggcaaucaauaaauauuugauugauuguuaucuucuaaaugcaaauucaacauuuaacauucaaauauugaaguuucccugugccaaaaaacaaagggaucucugcuaggggguugccuacuugaauacuuugggccugcuccuauaggccaguuggccuguguuguguucuccuucugcgcuuuaguuuaaguugaauuuaaaaaccauuagaccggccgggcgcgguggcucaugccuguaaucccagcacuuugggaggcugaggcggguggaucaccugagcucagaaguuugagaccaaccugaccaacauggugaaacccugucucuacuaaaaagacaaaaauuagccaggcgugguggcgggcgccuguaauccuagcuacucaggaggcugacgcaagagaauugcuugaacccaggagguggagguugcagugagccgagaucaugccacugcacucuagccugggugacagagugagacucuugucucaaaaaacaaacaaauuaauuaauuaauuaaaugaaaauaaaaaccauuagaccauuggucaaaucacuuacaaccaccuagagauucagaauuuuccaauagcuggugggaaacuuggaauccuggaauucaguuaaacuguuuauugagcauuccuugagcuguagacuucuggguuggguagugguggagugugggaggcagaguuuacauacaauaaugauucagacuuagucccuguucucugggaucuuacagucuaguagaaugggauucauugaagaagacugaugauacgcaguuugaggaagagacgcuuugaccaccagaagaaauauguacuggaauugguugguaauagcugugaaugucaggauccuguggugcuggaacaagguagaugugugaguggagggaguaacaacaaaugauguagcaauaaaugaaaggagauguccggaggaagguagauguggccucagagaagcagggcucuguucuguaguaugugccaauguugaucagggauaucaugauguaaauauacacccagcucuguguccuacaccauaugagacugauguuccuuauaaugaaccagagccauuaaaugguuuauguuucauauacgguacuucauuuacagagacaaacaaauguaagaaauauccauacggcaauguguaaguauuuuaaaaguuacuuuuuauccagaagaucucaaucugcaaauacuuaacaaggucaggcaucaugggagauauuuaaaaaacaugugugugccuuugagccguuuacuaaguugagaccaaacauauacaaaugggaaguugacucucaguaccaggcaguacaggccaacugcuuauagacaguaacugcuguggacuucagggauggccagcuuccuaggaucuuagguaguccggaaaucuuuucagguucuugagcuggccuaagcaggauuuaggugggcucaacauaaugccagaucugcagaaacauugucuuuugcccuuugggaaguugcagugugugaccugcucucauaaacuccuccccaaaacaggcuuaugcacuuagcaguaauagauugaaccaucaacuccuuaaagcacaccugguugauaauuagcucaaucacauuguguuucggucauuacccuuggauuucccaaggaugaguuuaauucaucucccacauuaaagugagugccugcaugaccaaaacucaacagaauagaauuucugucucuauuaugucaauuuaaugcugugguaauuuuauugcaaaauagguaucgguuuacaauuugccacccaaauaucugcacagaaauuguuacuguaugcuguaaaaagaucuuugauggcaaaaggcucccguuuuuccuaaacaguacuucaucugaaggaagacagagggaaugagcugaaacucugauuugaggaauuugggguugauaagaucuaauauugcuuauucagagaugacuuacucugguuuuauagcuuauaaacguauugaugauagauacaaccccuugauuccaagauuuuacagaguuuauuuuguguuuuaaccacacucccuuugccucugaccuacugcuggaugugaagggauaaacugguggugcauaugcuauauuaccaaagugggaagggagagaggcaccuuuauuauaucggauuacugccagaugccuagaaugcucaaaucuacucacugguugcuguuuaaaagggaaaaauacaaaucuaaccacuucuaggaauggugccagaugucuguacuaaggcaacccaacuccagaaggcuauaaaaauagcccccaaguaguagguucugauuucccacugagcugaccaauaaauccaacaaccaguuaauuaaaaaugcugggagggaauguucauccuccauuacccaccuguccuugugaauacucaucgguuacaaaugggaggguaccacuuaguguuucaaugucuggauuaggaaacucuguccuucuuuuuccacagcaacccggagauauauauggccuugguggguugccugauaccccuacuugggugucaagguuuauuugaggcuaaagugauuugaggcuuccaaagaaguuauuuuacuugccuaggggcuuccuggcaccauccacgugagcauguuuggagagacuaccucaucucucccuuuuucaggcuuugaguuuuauuagucugcugaaaucugauagaaaagaaaacaccuugcugcccugacugcugcuauaggcagaauagcacgguauccuuauauacaaggggguugcuugaaguuggaucuuuuauuccuuuuaacaagaaauuucaacuugauuaaacuaaaaaaaaaaaaaucaguuugugaugcaagcaaaaacguggauagaauacaccaucaguaucauccucauuguuaaaaucauuaaaaggugcacaaagaggcugggcuugguggcucaugccuauaauuccagcacuuugugaggccaaaguggguggauggcuuguguccaggaguucaagaccagccugggcaacauagugagacccugucucuauuuaaaaaaaaaaaaaaaaaaaaaaaggccgggcacgguagcucacgccuguaaucccagcacuuuaggaggccaaggugggcggaucaugagguccggagaucgagaccauccuggcuaacacggugaaacccugucucuacuaaaaauacaaaaaauuagcugggcgugguugugggcgccuguagucccagcuacuugggaggcugaggcaggagaauggcgugaacccgggagguggagcuugcagugagcugagaucacgccacugcacuccagccugggcgacagagcgagacuccaucucaaaaaaaaaaaaaaaaaaggucacagaguaguagagagaguauuggaguuggagugaaaaguucuggguuugaauccuguagguacuagguguucucuaugaacagagcuccagcagcucaucuggaaaacagcuguaauagcaccuaccucagggaguuguugucaagaacaaaugagaucauuuguguggaaaugccugacauuuaguagauauuaaguaaauauugagucugauuuaauuuacggacuuaauauccuuuguugccuuagauagauacagaaagcauucauguaaagagagcucaaaggaggaaaaaguggugauggugggcaagggaggcccaaauucacugaguacaaauuugacuaccaggaaccuacuuuccgaagauaccauuacuaaugaauuauauuucucuugaugcuuuugccaacuuuugaaaaagaacuuagagacauuuugauggagaacaaagaaaagagauggaacuugaguuuuaguugggucugccaccuacaauggauguuuccuuucuuuuucuuucuuuuuuuuuuuuuuucugagacaaucucucacucuguugccuaggcuggagugcaauggcacgaucuuggcucccugcaaccuccaccucccagguucaagcaauucuccugcuucagccucccaaguagcugggauuacaggcgugugccgccaugccuggcuaauuuuuucuauuuuuaguagacgggguuucaccauguuggccagccuggucucgaacuccugaucucaggugauguaccugccuuggccucccaaaaugcugggauuacaggagugagccaccacacccagccuugacauuuucuuucuagggcuguuuccucuauccaauaaaaguuggacuggagaagcacugugauucuuugccaacacccuaaauucauggggacaguuggauuuugaguauguauuaauugggaaugaaaguuuuuauauagagugaaaaguuuggggagaggccgcugaguccaaggguggagaagcuuagcaaggacagaaauuuuucuugccugcgagggaacucucuucgguaaucagaaggccuucaguaaucaugauugauugggguggauauauagauugcuuuuauucaugcuuuugagaugugugugugccugugucuaugugugugugugcgcuguuuaaagacuuuucuaaagcugaagcucuuaugugauucgcugugcauuagcaggauaugaauuauuaauucugcuuauacuugauaaugaaggccacaaacugggacccuguuaucugagggccuaaugcauuccuuuuucuucaucaaaauagguuuguaaauugucaucagggcccugcuaccagcccacuaaauaacuccucuaucugcugcuaccuaugauuucuuuaauaaggaauggcagggauacucagaaucgcauucuaugaggaaacguugauggaaccgaaucucuuuaacuugggacgggggguggagauucaggguaccuugguggcuguuaucaaaaacaugaaggacucucaagucaaaguaacaauaaacuaauuuugguggcuuuagggugggaggaggcagacuuggaucaguagaggagagauaaaggaagacaucucuuucucaauccaggcaauaacuuuccaacaacguaagcugcccaaagagagaauaggcuacuccaaggaaguagugaaauucucaucaucaguccccauucacaguuguagcuggagugaaaaauuagucuauuugaguagaaucuggacucacuuuccuggaauagaccuauagggauucaguggucuggugauuccuucacuauacuaugaacacuucuagcaaacuguaucuuauuuguauccuuaacacuuagcauacagcuugaucauaguaggaucucagaaaauguuuguugauggaccaauuagcuaaaaaugcacuugaaaguaaacaaauagaugcuuuuggucccaggaucaauuguauuaaauuggcuuccauguaacuacagugucucacuuuuucuucauguguuucuuuuuucuuauuuugaggcagagucuugcucuguggcccaggcuggagugcuguggcacgaucucaguucacugcaaccuccgccuccuggguucaagcaauucuccugccucagccucccgaguagcugggauuacaggcacgcaccgcgaugcccggcuaauuuuuguauuuuuaguagagacgggguuucaccauguuggccaggcuggucucgaacuccugaccucaagugaucugccugccuuggccucccaaaguacuaggaccacaggcgugagccaccgugcccggccucuucagguguuucugugcauuuucagucacaccaaacugcucauuaacagcgaccuugucauuguuagagaacuuaaaccauucuguuaccaaaagacccuuccauauuaauauauagagauaaaacaugauuuuaauauuggauaagcauuaucagaguuauaugcaugugaaguaguacaaaaacaacuacaaaaucuggaaauaauuucacacacauucauacaaaaaaaguagaagagagaacaauuuaaaacuucucauuuucuugagauacaagaggaugcacauugugccugucucacuuauaccuuaggagagaucccugagcaaauucuagaaguauuugcauuuccaagggucagaggcacaugaacuugcauuguaaaaucaaaaggucaagacuuuuaaucaggcugggcacaguggcucacuccuguaaucccaggacuuugguaggccgaggugggcacaccacuugaguucaggaguucgagaccagccuggccaacauggugaaacccugucucuacuaaaaauacaaaaauaagccaggcuugauggcgggcgccuguaaucccagcuacuugggaggcugaagcacuugaacccgggaggcagaggucucagugagccgagaucguaccacugcacuccagucugggugacagagugagauccugucucaaaaaacaaaacaaagcaaaacaaaacaaaaaacaaacaaaaaacccacuuuugaucaggcauauuauguuauggagacauccuaaagaagggagggugaguaggcagggacuucccuccccaucaaaaauuucaucauugcacacuuacaucgucugacaugauuagacgguguguguccuucacaggauccucaagcuuccugaggguuaguucguuugugcagugaaacaucuucccuguaagaaugcuacuaccuaggagcuggaaaccugcauaucaucacuuuauugguugacucuaccauuauuauuuuuuuaaaugaaacacuuugaauguggccuuauuaaaaacagaauuaaauauuaguaaaucauaaauauaauuauguaaguuaaauucuaacgauaauaaagaauaaauaaaagacaaaaauuaaaaaauaaaaaauaaaaauagagugaagaugcugucaaaggaugaaauaggcuaaaucuaaugggaaaauugaaucucuuuccccaaauaccucacagcgcaauggcuuuagaaaccauugagaaaugacagacacuucaacaauauaaccuuacugagagcuuucucuuuuuugaaacggaguuuugcucuuguugcccaggcuggagugcaauggugcgaccucggcucacugcaaccucugccuccuggguucaagugauucuccugucucagccuccuaaguagccaggauuacaggugcccgccacuacgucuggcuaauauuugguauuuuuaguagagacaggguuucaccauguuggccaggcuggucuugaacuccugaccucagaugauccgcccgccuuggccucccaaaguucugggauuacagacaugagccacugugcccagcccgacugagagcuuaaaaaggugcgaugacucuccgaaagacugagacucagagauauuuggauaucuaauaaaguaauucaagaugcauauaaaucucugguuucuucuaauuagugucuuaugauuguggcuuuuacuuaaccuaaccugcacccugauugcaaagguuuuccugacuagccgguuguguggacacugccuguucaccuuccuuuaguccucuccaagguauguaaaguuccucacaggaacuuccgaaguauaucuaccccccuuccagcuugaccuucuuucccuuuugguguggagugacuugagggugucaccauaggaauacuguuuuagagccacccugaucacuauuuaguuaaaaaaaaacaaaaaacaaaaaaguccaagcauccuguuuggacagguuguaagcugugacauuagaccuuccugguaugcagaauggcuuucaucacucucccaccccauucagcaagguuaaaggucucaggaagguauuugacuuguggcuguaacuugcccugacugcugagcaaugaugggucuuuuccuugaaccacuuaggaggugcccacgggagcagcauaccagaaaggaguagugaaggagcaaaacugagcucauuacagcauuugaaacgaagaggucaccaagaggaaaguagaauguacaaugaaggguuugucgauaguuuugguuuuuugaaagcucugcuccagaaguaaaaugguuuucaugguguuuuauucaaagacagcagaaggaaguuggaaaaaaauguaacaugucuuagaugagaagacccucagaggcaaggacuacaucugaugcagcucuuaagaagggcuuugggcacagagacacugggcuaggaaauacucugcaugcauuuguuuaucuaacacggaguuucuauguuucaggcacuuguaauuauacaaucucauuuaauucucauaacaaccuggugaggugggggcccauuuuccagaugaagaaucuaaaguaccuaaucuucaaaguucucacacagauucgcuacuuagaggaagaucuuuaaaauuaauuuaaaaauuaauuuuaguuacuuuaaaaauaauuuuuuuacuucaaaagcuuaaaauuuuuagcaugccucagaauuuuuuuuuuuuuuuuuuugagacaaggucuuagcucugucgcccaggcuggagugucguggcaugaucacagcucacugcagccuccaccuccugaacuuaagcaaucuuucccccuuagccucccaagcagcuagaacugcaggcaugcacgacugugccuauuauuauuauaauaauuauuuauuuauuuauuuauuuauuuuuacuuuuuguagaaacagggucucucuaaguugccccggcuggucuugaacuccuggcucaggcaguccuucugccuuggccuuccaaaguguugggauuauagauguaagcucccaugccuggcccagaauuuuuaaaaugacaacuuuauugagauauaauucacauacuauaaaauucacccuuuuaaaauguacauacuauucaguguuguuaggauagucacaaaauuuuguagcuaucaccacagucaguuuugggauauuuuuaucaccucaaaaagaaacuauacacuuuagcuaaucacccucauaucuccccaucuccuucaccccuagcccugagcaaccauuuaucaacuugcggucucuauauauuucuguauucuagacaucucaucuaaauggaaucauacaauaugggggccuuuugugucuagcuucuuuuacuuagcauaauguuuucaagcugccuccauguuuuagcauguaucagaacuucauuccuuuuuauggcuauauaauauuccauuguauggauaccuguauauacauuuuauuuauuuuucuuuauuuuuuuuuaagagacagugucccucuaugucacccagccuggacugcaguggugccaucauggcucacuguaaccuugagcucuuggguucaagugauccucccaucucagccucccaaguggcuggaauuacacguaccaguaaccauacccaacuaauuuuuuuuuuuuuuuuuuugagauggaguuucgcucuuguuguccaggcuggagugcagugggaugaucucggcucacugccaccucugccuccuggguucaagcaguucuccuaccucagccuccugaguagcuaggacuauaggugugugccacuccacccaguuaauuuuuuuguauuuuuaguagugacagggugucaccauuuugggcagucuggucucgaacuccugaucucagaugauccacccgcgucggccucucaaagugcuaggauuacaggcaugagccaccgcacccgaccuuuuuuuuauuuuuauuuuugacagagacagagucuuucuauguugcccaggcuggucuugaguuccuaggcucaagggauccuccugccuuggccucccaaagugcugggauuacagguaugaaccaccaugccuggccuauauauuuuaucuauuuauucaucaauugauggacauuuggguuguuugcauauuuuugcacacccaggaauuuauccuaaggaaauaaucaagaugauauauaaagaauggauuauaaggaucuuuauugugcuaucaagaaaaugaaaaacuagaaauaaccacagucuccagcauuaagagauuaguuucauuaugggacaccuauaugauagaauacuguacagcucuuaaaauaguauuaugaaauaauucauaaugacauugaaaaaugcugacaacuuauuauuaagugauaaaacaguacauaaagugugauuccauuuuuauaaaaauguauuuauauacaucaaaagaaggcuagaggccaggugcaguggcucacgccuguaaucccagcacuuugggaggccaaggcagguggaucacaaggucaggagaucgagaccauccuggcuaacacggugaaaccccgucucuacuaaaaauacaaaaaaaauuagcgaggcaguggaguuuguagcgaguugagauugugccauuguacuccagccugggcaacagagugagacucugucucaaaaaaaaaaaaaaaaaaaaaagaaggcuagaaucguagguaauaggaaaccguggucuucucuagauggugagauuauggucggggggugggggugguuauuuucuucuuuuuuaucuguguuuucuaauuucucuagaaaguauugcauaauuacuuacugagcacauaguaugugacagacauuguuuaguauauauguauuguguaguaaaaaaaaaaauagaaaaaauaauguuauuguuaaaacaauccaaaaagggaauguaugggauuauguauuguauacacacauacacaugcaccaacuucugaggauguaacaggaucuugcaagcagcacuggaguguuauguuuuaacucgaaauagauuaagauuuacagaugacauauuuaucggauaagaaagacauugaauaacuuuuugggagugauucugugcauuucucccuucucaauggaaugucuagcuauucuuucccugcaggaagugauuggaaguggaaugcagaguuuauuuccacuuacauggucugacacuuugacauuuccuaaacugcaggauguuugagagcaaacaacuuggcuuuuacugaaaaauuaauuauacugccacuuucacauagugacaggccuuuguaagaggacaaagcuauucaaguggggaaaaaugagaugcuuaacaggaugacaguaacauaaaggucuugaguccggagaaaaggaccucauuaagcauugauuaucagcaugguguagacucuuucagaaaguguuacuacauuccaugccauuauugugugggguaaauuuaaaucuguguuccauuuacaucauaagugagauuuguguauucuaauaauaggcuagucuugccuucagcuacaucaguacacacaaauucaguucauugcuuucacuggcuugucauaucaagccauccagacagucaccagaagucagucacaaagagucaaauuaguuuguguguugacauacagccauucugacugccuguuuggagaucaagucagcuuggcccaacaugaacauguauaguuccuuaugaacauacaugaguuacuuuugugggcaggauauaguguuggauugaagcuaagaauucugucuggagacauuuaugcagccaacagauguauaaaaaaugcucaucaucacuggucauuagagaaaugcaaaucaaaaccacaaugagauaccaucucacaccaauuagaauggcaaucauuaaaaagucaggaaacaacagaugcuggagagguuguggaaaaauaggaaugcuuuuacacuguuggugggaguguaaauuaguucaaccacuguggaagacaguguggcaauuccucaaggauuuugaacuggaaauaccauuugaccaagcaaucccguuacugggcauauacccaaaggauuauaaaucauucuacuauaaagacacauguacacguauguuuauuguggcacuauucacaauagcaaagacuuagaaccaacccaaauacccaucaaugauagacuggauaaagaaaauguggcacauauacaccauggaauacuaugcagccauaauaaaggaugaguucauguccuuugcagggacauggaugaagcuggaaaccaucauucucagcaaacuaucacaagaucagaaaaccaaacaccacauguucucacuaauaagugggaguugaacaaugagaacacauggacacagggaggggaacaucacacacuggggccugucgugggguguggggcuaggggagggacaacauuaggagaaauaccuaauguagaugacggguugaugggugcagcaaaccaccagggcacguguauaccuguguaacaaaacugcauguucugcacauguaacccagaacuuaaaguauuaaaaaaaaaaaaaagaauucugucuggagaaaaaguauaugacauuggucuggucagugaguguuuggauuugaccucaaaaacucaggcaacaaaaacgaaaagagacaaauaaaauuaaaucaaacugaaaagcuucugcagaaagaggaaccaaucaacaaagugaagaagcaaccuacagauugggagaaaauauuugcaagucauaccucugguaagggguuaaccuauauauuugcuggagguugcaauuuuuuucugugaaaaaucaggcccuggcaaugacuuugaacaguaggauauaaauaacucccacaagcuuagcauuccaauaauggaacacuaggcauaaauggguuuuaauauccagaguauaugaggaacucaaacaacucaauaacaagaaagcagaucacccaauuaauucauaaaugggcaaauaaccugaauagauauuucuccaaagaagacauacaaauggccaacagguauaugaaaaaaaugcucaacaucacuaaucauuagggaaacacuuaguagaaucacaaugagauagcaccucacaucugucagaauggcuguuaucaaaaagaugaaagauuaguguuauugaggauguagagaaaauaaaacuucuauauacuguuggugggaauguaaauuaguacagccauuauggaaaacacuauggagguuccucaaaaaacugaagauaagccugggcaacaugguaaaacccuguuccuacaaaauauacacaaauuagccaggacugguggcaggcaccuguagucccaucugcucgggaggcugaggugggaggaucaucugagccugggaggucgaggcuacagugagccaugaucgugccacugcacuccagccugggcaacagagcugagacccuguuucaaaaagaaacaaaacaaaacugaagauagaauuaccauaugauccaccaauccuacuuccgaguauauauucaaaacauuugauauuaguauguugaagagauagcuguacccgcauguucacugcagcauuauucacaaaagccaggauauggaaucgaccuaaauauccaucagcagauuuaauagauuaagaaaaugugguacauauagaaaaugaaauaauaugcugccacacagaagagggaaauuauaucauuugcaacaacauggaugaaaccgaaggucauuacgcuaagugaaaugagccugauacagaaagacaaaaauaccacaugaucucacuuauauauggaaucagaacucauagaaggagagagcagaaugcugguuaccagacccugcggggugggacuuggaauggggagaugauaaucaaaggguacaauguuucaguuagacaggaggaauaaaugauaaguauuugaggugauggauauauuaauuagcuugacucaaucauucuacaguauauacauauaacaucacuuuguaccccauaaauauaugcaauuauaauuugucaauaucuaaugaauuuuuuuaaaaagaauucuaccucgugucagaccaaccugaguucuuuucuacuccccuaccuuuuuuuuuuuuuuuaaaauagggacaggagucucacuauguugcucaggcuggucuugaacuccugggcucaagcagccuucccaccuuggccucccaaagugcugggauuacaagugugagccacuacacccagccccgaaucugaguucuaaucucugauuagauugagacugucugagccucaauuuucuaucaauaaaauggggaugauaauaucuaucucacagaguugauugaaugaaguaauacuucaauuagauaauugaaugaagauugaauaaaguaauccuuuccauauguguagcauauuucaugguauauuguaagagcucaauaaaauuuggugcuuuuaaugggaaugcaagggaauuuaaaggggaaaauggagacaauuccuguucuuuuuucuucucuucaguacauuucacauuuccuugccuugauuuuuugucuaaaauggauuguuaaaauugcuaaaacucgaaauuuuaagucuagacuuuaagaauauuuuauauuacaauaaugaaauacugacauaggagcuacugguguguuacaaaacaaaaugcacaaauacaacauuuaaacccagcaaauccuguagcaaucaugaacccauaccuacuuauggucaucugaucuuucuauuuuuucuucccagucuuuguuuggacuuuuguaaugauaaacacauaucuagaucuuaauagauuuggccucuucaaauauaaggccuuuguggcuuuuucuguaauucucaucagaauacuguaagucuauuaauaacacuccacucucccucuaacuugcugcuuuuaaucuguugggggcuugaaaacuaguuuacaaaacuuauuuggauucuauugguaauacaaaaguauucaguuaugaaugaggccuugaguuggggagagagagguccccauuuuugcugccgagauaccuuuuccuuuauuauauucugauuguuaucuacauucuggacacuugaggaucauauauaagggaaauccaaauaauauuuuaaagauuaaaugugugacccugauagcauaugaaaagaauguucuuuuacucauuaaaaggaacuaaccaguaaacuacauguaguaauccuaugacaaguaacccagugcugcagugaauuguuacauuggguuaagcauuacgaaaauuaccagaaaguagcugaccaauagugauagauaggugauauggagccaaaugucuuggagagggggaucuuuugaaauuagguuaaaugacauguguuugcaagagcaaaauauuuagugccauggucauaaugucaucuugauagacaaaggagaaauauuuguauccaaaaugucuaguuaauguuugacaauaggaccaaugugcaauagucaagagugguggacuaauguuuugagaguaaacaaaaaauaccagagauuagucaauguagguuugaacaagguuuugacuuugugauuagucgugugacuuuccuaauuuaacauaaucaaucaauaguucauaucugguagacuuucuggugaauuuucugguaguauguuuuauguugaacauugauuggacugucaagugaaugccagaugcuagcuuugacguuuguauguuuaaauacaaauaacaucauuuucauucaggaaaauucuggucuguuaauauuccugaaguucucucuacagauacacaauuacaacauugaaacuagggcucuacagcuugugauuuggggcaaguuacuuaaucucaguguccuaauuuccuaguauguauaguagaaggaguaauaacuaucucaaacgguugcuaugaguauuacauaagauuaguaugugcaaagcuucuaguauacugcuuguacaucauauuaauucaaugacaaguuaauauuaccaccuaaagcuagacuuggcuuugaugacuggguaaggagacauccaauauuugagcuagcuaucuuuuucuugcaauuugauaaaucucuugaaggcccaggggcuuguugcagucuggaggaaugagacucuggaaguagagacgacuuguucacagaaaacugauagauaaucauaacggagaauucuugacucaccaaaaugaaaauuucuuagggcaauugguaaacgcaguuaaguggcugcacaucuuuugcucaugaaacuuugaaauuugguucucuuugucucucucucauccuuuagaugaucacccuuagaaacuuuucuugacucugggaucucaaugagcucuggacuauagacuuaauaaacuucaucuaugaaugagccaucauaaccauuauaaaagcucacuaauuacuguugaaagccacauguuaauaauugcauaaggauuauauaauauaauuucaggaacuaaauaauuaaagaaauuucaaagaccauucaacauaucuuugacaacgagccagaaaaaagaagacagcuuuacuuuaauaguuuaaagggauuuaacaauucaugcaacacauaucuaaagcaguuaguauauuacgguugcaguguugaagaauaacauuucuucuggacaaauggaauuaaguaaugaaagcuaaaacugaacacaaauaaaagaaggguagaguacuggggaaagaauaucaguaaugaguacuuuaaaguagacuugauaguauucagaauuugagugucuagauucuagaacauauccuggucugcuuuuaauuucuaccccaauagaguugcuuaaaggauuucuucagcuuaauugccuucuuucuugcuguuauccuucaacuuaaguucccauauucuauaaaacuugacuuuaaauuccccuacuuuauucuguguccuuuaguccauaugcauucaguauauauugcaaauaaaauucuauuuaauggcaggauggcaaaaaugacuauguuguauuaagaaucuuauuuaaaugucuacuacaaagccuacagaauuuugguuuggccaugcuaagcugggaacuguaaaugcucacagaaaagguauagaaaaaauuguacaaagggggcuauuuugcugauuccagagcagugguguuucugaguaaauaccucuaaccuucugcuguacuuguauuggaaagcaauagaagcagaaucuauaaguauugaaaggcccagaauaaaggcauaguaagaauaaagguauuuuuaaccuuuugcagguuuuuuaauuuguuaaaaaggugguuagggaaaagcucuauauacacauauaagcauucacacacacacacacacaaauauauuucuaaauauagaguggaggacugugaaggcauuuggggcaaaguucagaaucuaucuuuaaguaaaugaugcucaguuugaaguauuuugccggggcugcagggccuauuugagcacaagauggauaugaccuuaggccaucuggggaagggaaagugggagcagcugugggccaauuuauuuggaauucucugaccuacugagagucagauuggaaauaagauucucaagggauuggauagaucuuccuccaccgugccuccugccucugaccaggauaucuuuccauuuucucugcaucguucccuuccucuuugcagaaguuguucaaagucacagcacaaguuaauggcagagccagauuuuaaauucccuguaggcauagaguuggugaguaacuuuucucucgauuuggggcacaguugcaagggcaugcuucaaguuuccaguaaacucucugugacugguaccacaagggcaauuccuuguuaauucaacucaagguuaagccacacacacacacacacacacacaaacuguagaaaauaucugguggccauuuaaauagaaaucaagccaaaauuguguguuuuucauuuuagggggaaagaacaaugauacaucuaaacgguuauuucuaaagagcauauccaugguccagugucuuucaggagcaaaaauaggcaaauucaagcaggaccuaagggccauuugcucagcagcaccuagaaacaauuuuagucaggguccagauuuaaagaguuucuacucaggucaagcuagagauuaggaaagguggcagaugaaaaucgacucagggucuggcacugguuacaaaaggaagcaggucacuagguuguguuuauagaggaaagagaauggauugcaagauuguuaucgcuggaaucauugugggggaggggaagacccucauuugaagccuugguccuccgacuaaaggagcccagagugcuuuaaggacucacacauaauuagccauacauuccacaggaagaaguccugccucuggcuacaucccucugccuugaagcaacggaaaaggagggauaagggugggagcaggaggcacggcgcgaagggcccuucuggccuucugugaagaccuuucuaaagcaucuccagauuuucuagccuguuucauccuuuauauugaaaaccagcagaucuuuagaagccucagcuagcaacuuggggaagaguuuuuuacuaguaugucaguaaacaguggcaugugaaguuugugcaguucugguuuguuggagcucagugaucuccuugcucuuugacaaaaauguuuugugcugcuuuagaguuuacagcauauugucccugacccuagagggagggaaaaaaaggacuuaguucuucacuucacccuuuaagaauucagguaacagagugacaaauaaaaagcauguuuucaccaaccaaaagugugggguguaguucaccaaggugaaacauacaugaugaucaacaugaagacaaacugcuaaguaguuuucauuaguauccaauuaguaggugauuugguugauaaaugcguuugcuaauucauuaacaauuagguaaauuaaauuuaaugaaaaugauuuaaauuugaacauaaaacgccacauguauuaauuuuuacuuuguaaauugaaauccauuugcugccuccccccacaccccuucaaauuguguacaguacucagucaauuagagcacgcaggguggauuuuuuucucauuuaaaguaucucuccucucuggaaaucggucuuccaguggaccaugucugucugugucucuagaugagugucagcgacaaauggugcaugugcacauaauacugaugaggauuguggguacgcagugagagcaggaaaagcccuuugcaauaccaugagggauucaggaagguauuuuagaauuuggagggguuuaaggcuucauuccacugcugauauugaauugcagcaugaccaaaugauuaacaaacuuggcuuucuggaaauaucucagggcagagagguucucaaaugauugcaaauugguuaauuacuuuaaaaagcauguuacuugcuguaaacaaguaacuuugcuggguuuuucuaaacaacuggcuauguuuagaagauagcaauauagaccaauuaaagauauacagagcuggaaagcugauauuauuauuauuauuauuugguaaaucuuagaauaggcuuuguaguuuaggaugauguuuugaagacuacugccucaucuuauuuuaaauaacuucauuucagcauuauggucagugauuuuaaaagcugaaacacauuccuguuguuacaauuuguguuauuuuuauugucuuucugacuuuuuuccugaucuuuggauaaaucucauucacaauuuccuggagaaacaaccagucuuuuaccgugguggaucacauuauaugauuuuuuuccuuguuaucaaauagaagauugaaugagcaaagcuaaauaggugggcaagacaaacaucaauguggaauggucuuuuuaaaaaucaguauucaaauaggcaaaguggugguuguaaucucuucaguguauguagcugaaaacaauaagaugcugccucuagaucuuugaucuuuacuaugaaacgguaggagagaauauguggcccauuguguuugguaacuugccaggguagguucacauuucugaggcaguagcugcggucauauagcaacaucaguguuucgcuuucaacucauauuaauagguugaugaaaguucaagugaauguuguugagguugagugagugaaaaauuauuuaauagcaucuguuaaguauaagagaucauucacugcuggcuuccuucaggauaucuaauuucuccacgaggacuugaccugauuuuuuaucacaugaggguuggauuaccauuuaccucaaagucagcuacugugcucauaaaaguuguguuuauuuuuucucucucagauagguagccauaaacauugggauacaagaaucacuggauuuuugucuuccuuuuacagugcugucuccuaguggacuucuguuuucugccuucccauuauauucaguuuuaggggguuguauagaaaaauccucuuaaaaggaaaugguugaugaugucuuuuaaacaguuuaaacuauguaaaaagaaaaagccuuucagugaagcaagguagcaauagcugauucaaaaacuaauaaggguuuuaauaagaauugcaucuuuuuuuuuuuuuugagauggagucucacucuguugcccaggcuguagugcaguggcacaaucucagcucacugcagccuccaccuccuggguucaaaugauucuccugccucagccuccugaguagcugggauuacaggcacccaccaccaugccuggcuaauuuuuguauuuuuaguagagaugggguuucaccauguuggccaaggcuggucuugaacuccuuaccucaagugaucugcuugccucagccuucuuaagugcugggauuacaggugugagccaccacacccagccaaggauugcauucuuguuuuuuugguauauacugauuggauugucccuaucauuuccauucaucaacuuucuuaguugagcauuugacagacacaccucucaauaucacuaauuuuagaauuugcauuuagauguuacagaguuagucacuggguuguuugaguuuugcacauggaguauguuagguaacaucaagcacccuaacugcgcucuguggaaaccuggacucuauacauggaaugaaaccuuaaaagcuuaggauggaaauuuggguaaauuuuguuaucucccagguuacggaggugguggggaggcaagggacuuaacccuauguaaauaauuuacugguauacccugguuuccucaguuuuaaaaaucucucccuggauguacuaugacacuuucucucugaggcugauguaguccaacaaagccacaguaauccagcaaacacauuuuaacauucuguguuuuauaucucgauucccuauauuugucuuauaugccaccauguuccuguauuuucccaagcagacauucgacuuguacaguuuuccagcauuacucucuucuuuagcaguuuauaaauuccaagcuuguuugaugaacuggaagccuugccaaggaugagagagauagauacaugugcugcguccucauuuauuauacuuacuaaacagaugcuuuuugacuugaccaugucuuccuggcuuuucuuuuagcccuuauuugacucccaagacaacuggacauuuuagcuguguaucuaacugggcagaauaguggcacauccuuucucaccuuuuaaaaccaagauguggugcagcugaaacagcuaagaaguuugcagcaggcucugaccccuacuaucaguuacugaaguguauguaaaaaaacaaaaaagacaaaaacagcagaagcacguuuuggguguggaaaagucaauuaaggccaaaagaaucaaacuaauucagcacaguucuuuucagaaacacauuuuuuggucuuugcuccacacuuggauuauuuaauuuuugucuagugacagugagaauuuggaccucucuaacaaagauaauaugauuuuuuuuuuuugagacagagucucacucuugucgcccaggcuggagugcaauggcgugaucucagcucacuacaaccuccguuucccagguucaagcaauucuccugccucggccucccaaguaguugggauuacaggcaucugccaccaugccuggcuaauuuuuguauuuuuguagagacagaguuucaccacguuggccaggcuggucuugaccuccugaccucagguaauccacccgccucagccucccaaagugcugggauuacaggcgugagccaccgcgcccggccucaaagauaguaugaucuuaacucuuguaauauuaucucagcguuuacaaauauacauuuccaaauaucucauauaauuuucaaaauagagaaaaaaaguaaguuaaaauucuuuuuuucugauuuuaaauucaauauaugcuuuaaaagaaaauuugaaaaugcagaauauuaaaaaaaaacauaaaagucacucauaauucuccccaaagauaacagugguucaaugguuaauauguugguguauuucucuccagucuuuuuuucuguguguguuuguguauguauuauagucugcauuauguaauauguacugcuuugaaacucgcuuuucccacuauuuacugucaacacuauuuauugugaacauucuaguucaguaaauuuuuuauaaaaccuauuuuuuuauggcuguauagccuucguuacaugaauauagaguaauuuguuuugaguuaaucaucuuagauuguuucugacuuuugcaauuagagcucaugcuauaauuaacauucuggugcauaaauauuugggugcauuucugauucuuuuauuagaauaaauucuuagaauuucagcacuacuaggccacagaaacauguauaaaguuguaaaaauucuuugaugcauuuccaaauugcacuuugagaaguguuucuguuuagucccaauagcagggugugagaagagaaugguuggcauuauccuuguuuuauagaugcaaggguuuagguguagagagauucaagacuugucuaaggucacaugaugauauuacuuauccuuugguuuucugagccaguucuauauucuuuccacuuuaccacuguuguaguaaaacuuggugacagaucuauagugauuuaacugugagggaaaacuuaaugcaaccauggccuuaaaauaaauuuaccucuauuauuauuauuacaaacucuaauguguagaauuugauauauagugaggacucacuucccaaaggcauucuuuuauaucuucaauauguuuucugacucacaucuaaaauauccacuauagagguuauguuuaacugagaaauaauagccuaaagugauuuuguuguagcuuuuuggucaccaaaucugguuuacaguauuauuccuuauuaaguaauagucuuuccaguucagcaucaagacauugaaaagauuaguucugucaggauuaaauugcucucaaaccaucauaaguaacccuuaaugucuacaaaauggacugaaacuuuuguugacucucauuuuuuggaagaagaugaagguaaaaauauaguuuuaaugucaagacuccagaaugagaugggauauaacaauuaagggugauuuccuccaaugaaacauaaucaaaccaagugugggaaguaaaacaaacaucuaccccauguccccaaacaaaaacaaaacaauacugucaaaaggacuaaccacauuaguaguuuucauuucuuucacauagcacuuacuuaauucuuagaauaacugggcaucuuggccuuuuuugucugaggauagcccauucacaacuuccaggucaccagggagcccugucuggacucugcuaaaggccucuugcucuuugccuuagagaauaaaugugauaacauuguuuugcccuugauucccagguagauaggacauaaauuggaauuaaaacauucagauucugaaagccaagauaacacuuuaucuuauuugaggcugugcuuucuuuaguaucaccuuacccugggaacccuccuaaguguuuaauagguaccauuacuucugggguuaggagugcauugcuggaagccuucuuauuguauccugauaugccuuugggaaaaagaaagcccuucaaguguuaacagcguccguauucuguuuuaggccaaugccauuguuauuucaaaucauauuaucuuaaugaaauaggagucuauguaauaugaauuuuguuguguuugacaaaaauuaaaguugcauaagaauuaugaucauguuacaguaauugccuaaaaugugguguuaaaguuccucacuucaguuguuuuuuguugauugaacaaccuuuggguuagaugguaaaucucaauggcuuuaguaauaaagaucuaaauagucuaauaauauuucuaaaugaaucaguuuuucaguguuucaggaaaugacaauuuuuuuuaaucaaggcacuuauacugaaaucaaauagugauaauaguguaaguucuuauugcuuaacuguuuucagacagcagggacuauauuuugaaugagugcaucugcugaaauuagauucucaagaauguucauguuaugguaggcaucuugaaacagaugauugauggguuccaucaauccacagguauuuauugagcaucuacagaguaccaugcacuauguuagguacuguggggcuaauauauaagauccaauuucuacucacaagggaguguauaggcugagugacaaagaaaccaugaacauacuaucccuuuuugagcugagccuggaugguggggaggcuauugauaaaagaauaugagagacugggauauccauuguaaguagauauaauagucuaagcaaaaucuuaaagacaggaaaaaugagcuuggugaaugccaaaaaacuauuugagcuggaauaaaaagauuccuuaaaggaaauaguauaguggaagagaaaguugaaaaggcaggcgggggauacaauacucucauuuccauuugccagcuguguucuagggcugucugccuagaacuaaauaaauaugaauaaauuuaaaaauguguccaauuuaaagcaacacccaagaaacaaaaucucaaauuaauuuguacaacauguggcauuguaaaauaacccuucaggguguccaauuuaaacugccuccucuuucgucucuguguauaucaugugggccacccagugaugccaguuggaaaugagacacuaagauuagaaaauuuugccagagugauucagaucuuguuggaucaagcuaaccagcuuugugauuucaaacucacuacucucuaguuaaaugauguagugugcauuucuagauguuuggaaguaaaagucauugaucaaaugaucucauguaugagcccuucauaugagacacuccacuagccagugauagcccagaaucuguccuugacacauuaucuuguuuucucuuuuucugucuuggccaccaccuucaucugucauguucuuuuaaaagcaagacccuaaaacuuuaccuucuaaaucaauauucuaaggugaauuuugugaugcuuugaauuaauggcagagaaccagaaguauaggcaauugcaaauggaagaugaugaauaacucauuuauaugugaguuggaaagccuguuuauauuuacauuugacuaugggugagucuguuuuuuagaaauucacuuucaaacuaaauaaugaagucauacauaaaggucugacuugagcugcugagaggcuggcccaauuuccugcaaccugcugcaugcuggggagaguaaaaacaucgucuguuguccaaccuauuacugacauagcaucauccuaagugcuacugacauguguaacugaaauauuuuauucuguggcuuacagcuguuucuucuuagcuuguccucaauaaauauggaagggaucaucauggucaaaggacuuaaaaaggaaaaguaggaugguuguguacaggaaacuauagcaaaaauauauauaugugcauaaaauggaaggauuggggaucagugacauagacaaaucuuuaaagauuacaugaaauaaaggaggugaaguaaaaccaagauaacaucacaguuaaugcuaaagaaauuauuggucaaaccaaacagaaaaguucacacaaaaugagaaaaauacuuuaucugagauaaagaaaugagaugguuuaugcauuuccaaaauggaacugcaaaauguuugggagaccagguggcuaaagaacacggaaugggagaauuguaaaguuaaagcaggugagaauaaucuuuucccuuaacugacuuagacuuacaagaaggaagauaggauuuggugauuuuuuuuggugcaaguuggaucccagauaaaccuugggagcucuugggaacucuucguggguaccauaauuagaacuguauuguuucugugauuuccaguaaucuacuccugaagagcagaauaugguuugaaauuguucccauucaauaagccaucauagauuuaaaucuuaucaucacauugaacccuguuuuggugaaacuguguauuuucaacuauuagcaccucuuguuuugaguaauauagaguuccauauauuuaaaccagcuguuucccauaccacuacccauuuuaaucuguuuuaagcuuaucuuuguuuaguuuuaagaaguccuuaucuuuacuguauuaggauuuggugaauaaauucaguucacccugccaauauccauucuuauucggcaaacugauugcaucccuuuucaaacuuccucuguuuaaccuggagugucugagcucuguaauaugcccuuauauagauaguauuuccacccccaagaagauaacagcuaacuuucucaagcuuuguucugucucaucacccauggggccuagaauaguauguuguaacccaggaggaaaaguaccuugcuuaaacuccuggacaccacuuuguuuauuucaauaauuuguggauuauuuacaucucagcaacauucuuggggcuugggggauguggaauauauauauugggacuggcauaguacucugcauuuuucauuggcuggccugccuggaaaccugcagaguugucugugauaaucguucauuggcaaaagaaugccgaaggauaauguuuaugccuggcaccauuuuuaauucauuugccuugaguuuaacuuuuguaguaaacuucugggauggcagccuucuagggcccauuaaccagaguuuagaagacugugugguagaggucuuagccgucuguuaccuguacaguuccugccaguuagaugacuuucacuagggcuacuuuaugaggguauaaaaacuucuuaguaaauucggccuuuuauuaggcacugcauagccccuauuucaggaaaacggucuguaccaggaaauauaagggaaaggaaagacuuuuaagcuuucuuuguaggugccuuuuaaacauguuagccaucuuggcacuugccacuaagugagggaggcagccaucauucagaagagaugguuuuaacaucugugguuuggggacacaaaaugagacagcauaguaauaaauguccuaaccccaggucauuuaggucagacauguuucuucuagcauuggugcugguccugccugagacugcaggaaucaguggcaucaggagcuucuucagcccauauagaaaaauacaacuaaagggaaaaaaagagguagacuuugaagccaguagacaaauguucagucuaaguaauugugaaaacuuuuagaaacaauaucuguauguuccuuccuuccuccuuuccugucaucucuguuuucccuccauccccaucccucucaagguuccaccaaaggcccaaagcaauaugggggugagaaaaagaugguuggguggaaggaaaaaucauuuuauuauuugaguugcuuucucccuuacccaagcuccagcacuguuuguugcaugaacaguuugagcuccacaggaccguaaguuacacuuacaaaaacaggaaugugucuuuaaauaauauuaaauguuuuagugacaucaagaugcuuacagggcuagucaggcagguaagcauauaaccagcuuucuucuacaagaaguuuuauuugcaucuuuuaacauccccuugacauuuauauaccaagguagaaagcccgaaccucagagaaaaaaaaaauacaugggguuuaugaguacuugaaauaaaaaauugaacuuuuucuuccugucauguuccuuaaaauccuuugaggaaaaauguuguuaugaugugcccaaagacauuuaacauaaaagguaacuggugcuggaugugguggugcaugccuauaguccuagcuacuugggaggcugaggugggaggaucgcuugagcccaggaguucaaggcugcagugagcuaugauugugccacucuacuccagcuugagugacagagggacacccuaucucuuaaaaagguggggaggguggcugugguuaccugccaucaucuuuaaguuucuugggcauuaagcaagcuggaagccaguuuaauagcuauccuuaugucuuaugucuuacuuuucauccuuguggaucccuuuggaaggaacuaaauguguuggcaccauuuucacuaucauauaguuuucuuucugaaugugaggcgguaggauucuacuuaucauguacuguacaguugcacuacuugaggaugaugaacuuccacuauauaucaccuaaucacuucuuccauccuacuuuguaugugguuuaaaguguaucaucucuugccugguauuuuuaaauaauggcuuuuacauuuuuaaagggaaauucuuuuggggguaccaguuuguggugaugguugaaaauaucugucuagcaucauuuguaggaaaaggauaguauaaugaacaaauauuuauuguguaccugcuaugugagauacauuauguaaagcacugagcaugaugucucucacauagaagguaaggcaugaagaucuuaacuagggcuguagcaguggagauagggaaaagcuagaggucgauguaagaaacauugaggaaaagagaacugauagaauuugugacuauauggauggggaugagcaagaggaaggaaggaaauauuuuuuacuuucagagcuguuaguaacugggaaggagcagagugaugucaggaguagaaauaaggaaguugguugaagcaauaaggauugugggaugaucacuacaagaggcaaaaugaauuggauuuuggucauguugaguuuguaauacaggugaccugcuuacggggagcuguccaagagggagucagaaauacaggccuacagcucuggagagagauugagacuuauagagaaauccaggaauuauccacauaacucaucauaauggaaaucaugaaagcaggaaaauuuaccaaagaagauauuuuagaaaaaagacccagcaaagaaauagagcaugagaaugaaagccuugaggguauguucauguggaaggcagagagauugaagaagaagcaguguaaaauacuccauagggguggaaaaggauggagguuagacgugaccaucccauuuagcaacucuaaaagucauuggugacauuugaguaccaaauuucauuagagagauggguaugaaagucacauugauuggaguugaggaagaggauguugauuccucuuuuaauauauuuggggguagaguggagaagagugugguaauuugagacaggaaggaaggagagaucaagugaagagaaagaggcaggacaucauaggaaaucauguuuaagauccucauuuuaucagagaaauaucauucgcuaagagugaaaaggacaggauuggguuuaggacuuaggaaaugugggacaaauggaaaguaggaaagguuuagauuggcugcccugggaaaugacaaguagucagcaaaguauaaauaaaaaggcuuguuaaacaauaaccagggcucagcuaaaguuaagcuauacuguaaguuuauaccaucaaaauggcaaaauuacguuacuuucuccaguaacaguuggcacuuacuaaagaaaaaagucaugaaauugggaaugggagcagagaaaguacaugauuugguauuugucagcuugagaauaaagacacacagugaagaacuuuaggagacuaaugagagcauugaauauuuggaauaagaaaagugauaauuuaaaucaucaauuuuuugaccauucauucccuuugcagcaaauaagcucaauuuccuuccaaauaugucuugauuaacaacagcaacaaaagauucacuccacccccuaucuuauugcuguuagagugaugguugguacaucaucacuaaaaaaucagaguugaauucuugugugugagaauucauugaagccauaugaaacauaaaguggugauuucuguaguugcccgguacucuuuuauuuauuuauuuauuuuuuugagacggacucucgcucuaucgccuaggcuggagugcagaggcgugaucucggcucacugcaagcucugccuccuggguucaugccauucuccugccucagccucccaaguagcugggacuacaggcgcccaccaccgcgcccggcuaauuuuuuuuguauuuuuaguagagacgggguuucaccguguuagccaggauggucucugucuugaucuccugaccucgugaugugccggccucggccucccaaagugcugggauuacagguguaagccaccaugcccggccacccaguacucuuagaagcaaaauaaaaaaaguuacccuccuuucccauccuuggaaauuucauguuacuauucugugcucauuguuaaagcaggcuaugccacucaagcuugaaauauguucguguugccaugguuugugucaguaguccuuccucaucaugcuuauaguugcuugugcucacugaaccccaacaggugugugacuuaauguagaugcuaaagaaagauacaggaaaguaucuguuagcacuagauucugggugcgcuuucggugaaguuguacuugugauauuugcuauuacuuacuaggguugauuuugcaaguauuauguccaaaaccccuguguucuuccuaggcgccauguaucugaucuaagaugacucuuuuugugagcaacauaagaagauauuaaauguagucuauauuuucugaaguguagagugcugucauguuuaccucuagagacacccaguuuccuaugguaacuuuuccucuacaaguuuuaagugcaugaaagaaaaggaugggaacaaggaaagaaagaaaaguagguacugcugaauacuggaggaagacuugagcucagggaaagaaaaaggaauaucaggccuaauuucaucuucauuccacugaaaaucugugagagcuguuucuagagacuuuuucaguuucuuaccacuucucucuguguguuauuaaaccuugucuguucccuuuuaguuauuagcccuaaaaccccuuacaaaaccucaaaaggguuucugggcuuaaguagauacagauggggaggaggggaaacuauauagcuguguuccacuuggcaguggcccaagagaaagcagagucaaagaauaaguguuaucagcagaggaagggagggaggaggcccgcccauugaggagaaagugaggguugacuugagggacucuggaaagggcccaggggaggauacccuuuucaaauggcacauuaucaugaggucuuauccuuuucuucuggauggaagucauccucccuugcucuagacuuuaccuguaccccuuuaaaugagccuauuacuuaguauuaucuuguauuuguuguuguuaucuuguauuuuagcagcuaauugcaagcaugccuuaucuccccaaguagacugugagcuccuugaggggagauauccucuuuccugcagcuuuuguuccagugccuugcccauaguaacaacuuauuuuaacugaaugaacaagugaauguagccuauugucuaccauuuucugcauugauuccacaaguauuauuugagcucugcugaugaaauggaagaguucccugaucccccucacaggaccugugacagugguuuggcucaccacugcucaaaccccugacaggagggggagcaugcagacaggcaggagcaggagcuagggugagugcuuugggcucuggccccauaguaguaucuaggggugggugccugcagccucaguguuacaguguucuuuuaaccuugccauccacagaugguuuaaguguuaaccagcucaguggaccuuccgcguuuuugcaaagacagagggccagugugacagcuuuuuguaucccaagcuuuugccuagcaucccagaagaauugggucacacaugggcuugaagggugaauaugggguuuuauugagugguagaggugccucucagugggauggacggggagcuggaaaggggauggagugggaagaugaucuucccuggaguuuggcuguccaguggccaaacuacccucccacugccccuagcugaacuccucuuggcguuuagauguuccuucccuucucucuuucucugcgcaccauucugccauucaucugcuugucuccucagcucaucuccucgucugcuugucugcuccuggagccugggguucaggguuuauauggguacaagacggggguaugcugggccaaaaggcaacuuuuugggcacaaaaacaggaaugccuguccccauucagggccacaggucuucaggcuugaagauggggccuuugccagggaaccggccucuccgacccaguauuucccugucuccuuuuugugucaauauuauggggauagagaggauuuuugagauagaagccugcccuccagcagcugcauaucuaggugggaugaauagaugccaaagacugcucugcuugugauuccauaggccccauuggauucugcuagcggaugacuuguucaugugucuuucucauuuccccaguugcaauuuuaggaaauacucucuuugcucugaaaauuguuaucaauucuucuucagccauuuauuuucugggacuaguaacccaauaauucaaugucuaguucagugaagagucauugcuagaccugauagugaugguaacaaacuucuuccugggagccacucagccauuucaagacacaagggaaucuuagaauaaacaauuuuuuuuuuuuugagacagagucuggcucugucacccaggcuggagugcaguggcaugaucucggcucacugcaaccuucgccaccuggguucaagugauucuccugccucagccucccaaguagcugggauuacaggcgugcaccaccaugcccagcuaauuuuuguauuuuuaauagagacaggguuucaccauguuggccaggcuggucucgaacuccugaccucaaaugacccaccugccucagccucccaaagugcugggauuacaggugugagccacugcacuuggcuguaaaugaucuuauucaggugcuaaauggugggcuaggagccugagagagaauaauugguucuuuucucuguacgguuggucccauagggccacuuccaucucuuauuuaccuaugccuuuuuucuagucuugaugauugacuagagaaguuuggggggcauugcuugaucucuuccaaaaaaaaagaaaaaagccagaaguucuuugaaaaugacuuuaguuuuuucuuaaagaagcauaaaauaucagguuaguugggauaguuuuuaagcagggaagcuguauuuccuguauuugcuaagaauauuaugaaugaguuaacauguuacuguagguuaagauaaucuagaaauguaucuggaaaaucuauuucaauuaccuucugggugcuuuuagcaaaaauaauaaauuucaaagaauuaagagagucauaaaaagaaguguuaugaggggaguauaccucauuuuucaccuucaaaauuaaauauucacuguggaauuauguacugccagggucacugcauugcuuauaggcauuaauagcugccauagguaacugcugaaggaggugaaggggaccauuucccauaacacagagauuaaagcacgcaauuuacugaaaauccccuaaauaaauagcaaccuaaugcucaguugugcacuaaaagggaugcugcuucacauuuacaauuugcauauggauacccuguugaaacuugcauuugcauauauaagguauugauuuuggcuaauggaacaugaggucauuucucuuuaguuucccucaauuuaaguaucauuuucuuucucuccuuauugcucacauagaggaaggcagaaaaauagcuucagaugauugugucuggaaauaccagauauuguggucuauuuuuauuucaauuuuucauauuuaaauugucuguauaccauaguaaugucaguagcuggcuacugcuuaaaacuagaaauuuacaugacaaguaauaguuacuuuaaagagcuacuuaagcuguuugaaaaugccuccagacaucgcuguagcuuugucuacuaaaaccagugaggcccagcauucuuggucgacaugaaguggcuugguugaacuuguugguauacaauacagugaauugccugacccuccuaauugugcuucagacuuaaugccaaaauggugcauuaauuggaugugggcuucagguuuuuguuaacuaucagcuucguugcugaccaauuaccacauguaggaaaagauuagaaaauauucuauuuuacugagauaacaaaaucaaccgauuuacauauacccauacauuuuaaaguaagcaaacuuuguauagauuuuuguugcagcaaccaaaauccagauggauuuccccuucuaacaguguauuuuccugugugaaaugucucuugucauuauuuuccucccguuucauuuaauaagaacauacguagcucauuaugaaguagguacccuauggagaggauugccugugacuuuccaauaugaaaucacaauauuuuguuugcaucuauuuuauaaaaauugcaaaaguaauuuauuuggcaaaauaccaccugcaauaguauaaccuuaguuaaauuguuuuguugcuuauauguaaaaaaaggacucuuguugcuucccaguaccaaaaucacacaauguaauuaguuauucccuuuuagaaacuaugguugcagugauaggcuugaauuuuugaugacagagggagaaaacauaaauauuaaaauaucuuuauuuuugugugggauacaaauaaaagaacaucccacagauaacuguaauugcauuuuauugaaggaacagaacuuguaaauagggcaacagcuggacaugcuaaauuaaaaaaaaagagaacaauaucacauuuaaaguacgagugucuaagaggaaguuuauagugcaugccucacauuuuaaauucagcaagaaagaacagggacauccuuuuucucacuggcaaguuuguaaucuguguaaaacacuagguauguuuccauaagcuauuuaaaugcaagugacauucagaaagaagauccaggaugaacacuugucauaugaguuucauuuuauucacacuuugagaguuguguuucacacucauauuugaauaagaaaccuccuugcaucaugaaugaaauguuuucaacaacaaaaaagucacauguugguaaauuguaacacauuuuuccauaaauuuucaccacaacuuuagaauuguacucccaagaaaaaauacuguuaaauugggaaauacagccaaucugucaguuacacuugaguucaggacagacaaggcugcugggacaugugagcauuggguauucauagagauuaggcauggggcugagcagugauggggccagguggaaaggagaggugaugggaguugcagcuguuuguuucuacccaccaucaugauaugccaacagcuggagaaccaauuugguauaaauucccaggaccuuacugucaguuaaugugagccuuccaggaacacauaccaaauaauagcuuacuuuccuaauucuaugaugggaaauuucuucagagucaaucccugugaaaugggaucaggaacaguuuuagucaaaaccgugaagugcgcacaguuuggguuuccugcccuuuaaccuucccuucaucugucaucccuucuuccuccucccaaggugcucaguauccuaugccuuuaaaauauuaucucaacuguucuuauugcuuccuguccccucucuucccccaugccaccaccuuacugcacccuuuccagaaaauacucugugagcaagguuuugaaucuguuacuugacccuauucuuccuccacguaaagauaaccaaguauucuuauuuuuccagacaccaucugugggaagggaaauuugccaguaaucaaaaaggcguaguguguuaucucucuuaggaauauuuuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaaaaaaaggaauauuuuuauguuaacuagggguguguguguguguguguguguugauguugguggugguugcacagugcccuuaauacaaaggaaugaaacauaaaugauagcauuuauuaguucuguggccuucucagcacucuucaaauucuaucacuugagugccccuuucucugccugcuaaggcuaucucugaauaggugauguuuacauccauuuauuuacugccuaccaaaaccacaauuuaaaaauguuccuguugcccagugaagccaagaagaaacuuucaagauuaucaaaauguucauuccuaguuagagagagaaagauggcaucguucuucaaaauguuucuguuacuaugcuuaaagaaaauauuuuuuuccuuagagcauuaguuggaguauugagacucagauuuauggcuauucuauugacaagggguuauugcaaagauguuuuauuugcuguuucuaggggcuuaucaaaaauaauugacuagcugucauuuucuacaugagaccaauuacuauugacccagcuuugcuuauuguuuucauuaaugucuaacaaagaaugaaaauguuguugaauguucuuagaacugacaagagaaaagcagugcuaagaagugaguauguaucucuuggccuucccagugcugcuaagcagagccaaagcucgaugccaggauguugugugagcaacggcuucuacaguaugcaaacucaaaacuacccuacgugauguuugggagaauggaggauauggagagguagcagccugcuaugugcaguuguacagguugugcucugcacauucacauugugguucaugugaaaggcauucucuagaguugugcaaggcacgaccauauguggaagccugggaggcaguagaauaacuucugugucuucugugauaaguguagucaguauuauuauuauuauuauuauuauuauuuugagauggagucuugcucuguugcccaggcuggagugcaguggugcgaucucggcucacugcaaccucugccuccuagguucaagcgauucucccaccucagccugccgaauagcugggacuacaggugcccaucaccacgcccagcugauuuuuuuuuuuuuuuuguauuuuuaguagagacgggguuucaccauauuggccaggcuggucucaaacuccugaccgugugaucugcccgccuuggccucccaaagugcugggauuacaggcgugagccaccacacccggccacuauuuuuuuuuuuuuaaaggaagcaauacagccaugagauggcuaucauuuaugacuuggcaccuuauaaagguaaagguggccuguuuuaccuuuguuauguggucuauuggcugaacauuaaccacauauuuacgcaucuuucuguuggcauguaggaaugauugcauuucuguagugggaggagccugguaaaugauuuuuuuggcauaugcagauuagacagaaagacagguaugacuuaguaaauaaguguuccauucuucaagaguagaguagacaguaacauuccucaauuauugaguggcaaaaaaaaaaaauccccuuuuucuaaaauaccaagauuguacucaauaaagaggaaauggaaaugcaagcaccauaaucacaugcaaaacuaauuuaugauuuugguuuaaggagcuuauauuaggcuguucuugcauugcuauaaagaaguacucaagacuguguaauuuauuuaagaaaagagguuuguuuggcucguauuucuacaggcuguacaggaagcauugugcuagcaucugcuucuggggaggccucaggaaguuuacagucaugguggaaggugaagagggagcaggcacaucacauggccagagcaggagcaagagagagggagaggaggugccacacacuuuuaaacagccagaucucgugagaacucaguaucaacuaggacagcaccaagccauugagggauguguccucaaaacccaaacgccucccaccagggccuccaacacuagggauuacauuucaacaugggauuuggguaggcacaaauauccaaacuauaucagagcuaaaaacuuccuguaugaaauugggcuuuccaaacccuucaguuucuugaagcaucuccaaauauauuuaguauauuuggaguccccauuuaaauuaacacagaagacguaaccaaauuucaguugaucaaacuuuaggauuguuaaucuuggggaaaccauacccaaaguugaaacuuuacauaaaaucuggccagauucuagcuccuagaaucuaaauuccagauacuccugagucaguuucauucuugugacuuaaauuaaguggucccugccauagcaccucuucuuuugagagcccaguggccccaaguuaccauaaauuaaggguaaccaaacuagaugcagcuagaucacuuacuaggaugugauuaucuauaaguaaaauuuuaagucuaugcaguuuuauacguaugcugauaaugcaccuucccaauuggguuaaaauggauauucaauucaaucaauuuuuuuugagacaggaucucacuuugucacccaggcuggaguucaguggcaugaccacugcagauucaaccucccaggcucaagcaauccuuucaccucagccucccaaguagcuggaacuacaggcacauaucaccaugccuggcuaauuuuucuauuuuuuguagagacagaguuuugccauguuguccaggcuggucucgaacuccugagcucaggcgauccaccugccucagccucugaaagugcuaggauuacaggcaugagccaccgugccuggccaaucaauuuuuuaaaagaugacuuaccauaugugcuagaauaugaugaugguugagauacuccucaccauugauuccauaggaccuucuacagugaacuuuguaauuaacaacagaucuacugucaaagagauuugaguuagaaucauagcuccacucucuccuagcugaucagcucuagaguaaucaguucaucugucucaggcuuaguuuauucauuuuuagaaugagaauaaugauagagucuuccucauagaaauguuauuaggauuaaauaauauaaugcauucaaagcacuuagcacagagccuggacguaagcacucauuaaaugcuaacuguuaacaaguuuuuaguggucauaguuuuucacucgguguuccccgagugcuguucaguuuuguucucccucaagagggcugugaauacuuugaggaaaggauuuuuuuuucugccugauuccccuuuguauucuuaccuuagcccagugaguguuucgaagugggaauacugagccucaguuucaaaaucugggggaaaaaaacgguacuaauaauggcacuuaacaggguuguuaugaggauuuaaaguauuugcuaugauaacacaugaacgaaagccucagugauucacauauccuacgaugcagcgguuuggauaugauuuguuuggucccugccaagucucauguugaaaucugaucccguguuagaguugggccuggugagagguguuugggccauggggaaggaucccucaugaacaggcuuggugcuguccucaagauaaugagugaguuucauucuguuaguuuccagaacugauugcuaaaaagagcguggcaccacccuccuccucucucgauucugcucuugccaugugaucucuccuccccuucaccuuccacuguggguggaagcagcccaaguccccuugcagaagccgaugcugauaccaugcuucuuguacagccugcagaaccacuauccaaauaaaccucuuuucuucacaaauuacucagccuuuauaauaguacaaacagacuaacacacauaaguauuuacuuccccuucuuaacucacagaauugccaaggcuccaaugagaugauacugaugaugcuuugcaaacucaaaauccugacauagauuugugugaugaaugcggagaguaucuguaaaugucucucaaaauuuucucuuugucagaaaccugaaaccugcccagacucguccuuguuuguguaagucauucaccaccaucuauagcagcuggaacuuucgccuucaucucucccuacccacacacagcuaaagugggcccuggggucccugaagagcagauuuccuaggcaacaguuguuuuuucuucccaggugcaaauaugggccuucugagggaauucccagggagaccccaagccugggaauuuuagucuggaauugcuucacuccaggaauccuucccucagguccuaauagcucugccuuaggaaguccucuccaggaagacuggcucagcaccccuguaugguugggaaaguuccuagaaauggagccuugaauagaggaugagggcuucuggguaggauuccaugguuaacacauuugggaacuggugggucagacagagccuuaauucacuacugugugauuuuaaucucugagacagauaauauauaggguuugcuaaacuuauuagaucaaaggacaguuaguuuucuuuucuuuuuuuuuuuuuuuugagacagagucucacucugucgcccaggcuggagugcaguggcaugaucucggcucacugcaagcuccgcuucccggguucacgccauucuccugccucagccucccgaauagcugggacuacaggcggcugccaccaugcccggcuaauuuuuuguauuuuuaguagagacgggguuucaccauguuagccaggauggucucgaucuccugaccucgugauccacccgccucggccucccaaagugcugggauuacaggcgugagccaccgcgccuggccagacaguuauuuuucuaagaaguauucauaggacaaaauguuacauggaacuuucuuuugaaaauaugauuccccaccccccaacccaaaccaaaugagacucauucugguuucugucuucuaaaaugauauccuuuucauuaagaugaaucuggucccaauccaaagugcaaugaugacugacaguagugucuaguauaauuggagcagugauggagguggggcagguaaaugcaagaguggcagaaauuaaucugcagucagaaauuaaucugaccccagacuaaugcuggggcaggagagagagauauaugagagugccagaauaugguagauaugguagaugccagggcagggugaaggcauccaggugggagcugaaauccagccaggauacugcuagacaagcuguuuuucuuauuacuccagccacagaaaguaccuuugacaaucccuccaucucuuuucuagcuggauggcccagaguggggaccuuuuagcaccagcggggacgccuuuuccuaauuugcacaauagugcccuauguuuuaguagugaccuuaagggugguuauaggagaagguggaaagacaagagugucuauuugauguaaguguagggaauauuagugauaguucggaaauuucuccagauaauggcaagacacuccuuuagcagccccccuuuccugaguuucccauuguuccacuuauuaaacucugacauaugucaugcccuguguaccuggauauccauucauccugaucacaaccugaucucccacuuaccacaccaucucagaacauugucuggcagauuaaaauaucuccccagcucugcuaacccacucuuauaacaugacuagcuccuccuucccccuuuuaucccuuuaucuauaaguacuuuuuaaaacaagggcugacagcuuuauuguucaggaauaauugucaaaaggcuuaguggacuguacuugccaguaaaagguuauuugcuggcuuggggugugugcuccucagcuguccugugucauuccaauuauauugucauauggugagauuugugccugaugucauuguaggcaaggauauaguagaggcagcucauuuguauguuggugcuucccaguucuccauuuguugagaugcuuuuaucauucagaccuuugagacaauccaaccugcuuccuucaucuuaaaggugaggaaaugggcccagaaagggaaugugauuuaccccaaaucauacuauguguuggugaugggaccaagaugaaauccagcuccccaggccucuggcagggacuccugaacucauagcuuugggcacugaccucauggggugaaagggaagauuauauuucuauuugaauguuuucuaacacaugaaauuuauauagguaguuauaccuagcaggagccaaagaacaauaauuuuaaaauaguucuauaaacuucauauccaaguuaauuaaacaaacuuuuauugauuuaagagaaacugguuaaucaaguucaugauucauuaauaaucaauuuaaguugauaugaaaauauuugugguaugagcaaaagauggaggaaaaaggauccagagaacaggaagaauaggucagaagaagggggauuuagagagaaguguuacuugugugguggagagggguagauagaaauuugggagucgucuguagagagaugauaagaaaagaaaugagaaugggugagauugcuggggauaaucuaacagaaacauuacaugguagauaauuaaaauacccauuaccacuugcuguauaucuuucuuuccugaguucaaagccuuucaccaaugcuaucacauuuaccaucacaguauccauuagaagcacgcaguaauuauugauucccuaaagcacacacgaguuaagugaccugacccaaaccauaaggaguggagauagggccuaaaaguauugcaaagcucuguggcaguacaacagacucauuuaaauaauauaugcuuguucaccuuagucuuugcuacuucaugugauaguccaguuuugcuuaaucaaguuuuaguuuguagcuauaaaguuaguacaugucacucuacaaaauuguaaaaauauggaaaccauaacauaaaacucauaccauaauccuacuauuugaggaaaauugcuauuaacauuuuaguguagauuccuuuuucuaugcauuuuaauaccuuuuuauaauuacaaagauacacacuauuguagcagagaauguggaaaauucaaaaauauauuaaaaagagcaguaaaaucaccuguaauuuugauuacaggugauuuugauuacaucuagaugcuuaauguuaguucauucaccugugauuuuacuguucuuuuaaauguuuuuauuuuuuuuuaaauuuuggucaacagguauaugaaagguacucaacaucacuaaucauuagggaaaugcaaauaaaagucacugagauaccaccucauaccugguuaggguaacuaugauaaaaaagacaagagauaacaaguguugacaaggguauagaggaagagaaacucuuguauacuguuggugggaauauaaauuaguacauccauuauggaaaacaguauggagauuccacaaaaaacugaagauagaauuaccauaugacucagcagucgcucuucuguguauaugcccaaaggaaaugaaaucagaagguugaagagauaucugcacucucauguucauugaaauauuaucacaauagccaagauauggaaauauugacagacaaauggauaaagaaaaugugcugcuuguguguguaugauggaauacuguuaauauuuagccuuaagaaaggaagggauccugccauuugccacaguauggauggaccuggaggacauuacacggagugcaauaagccaggcacagaaagccaaauauuuuaugaucguauuuauauguggaaucuaaaaucuaaaggucaaauauguagagguagagaauaaaacagucguuaccagaauuggaguaguggggagaaaauggggagauguaggucagaggauacaaaguagcaaaccuguaagaugaaaaagucaaaagauccaguguaaaacauaaggacuauaguuaauaauaguguauuguacuuaggacuugugcugaaugaguagauuauaucuauucuugccucagagaaagaagguaacuaugugagacgauagagauguuaauuuguuccacuauagggaccauuuuacuauauauauauauauauaucuuguaacagcauauuguauaacuuacauguacacgauaaaauuuauuuuaaaaaaggaaaaucuggcuggguacaguagcucaugccuguagucucagcacuuugggaggcugaggugggcggaucgcuugagcucaggagugcaagagcagccuggacaacauguaagaccucaucucuacaaaaaauaauuuaaaaaauuagucggguguaggaacucaugcuuguagucccagcuauucaggaagcugaaacaagaggaucacuucagccuggaaaguugaggcugcagugagccaugaucgugccucugcucuccagccugggugacaaaacaggacccugucucaacaaagaaaagacaagagaagagaagagaagagaaaaagaacaucuggaauauccaccaaaauuaaaaggaaaaguaaaacuaccuguagcuacuccaucaaguaauaauuacuguuaacauucugauauauuuccuuuuaguauuuuuuccuaugcauucacaaagaaaaauguuuuauuaaaaugugauuaugcuguauauauauaguucuauacuugcuauuuucacuuaauauggcaucaugaguauuucaccauaucauuauauauaguuaaaaacauuaucuugaaugguugcauagaauucacuuguguggauauaccauaauuucuuauggacgcaccauaguuuauuucuuauuuucacuagcaguguauaagaggaccugugucacuacauucucauugucauugcauuuuaacuucuucugucucugccaauuugcuagaagaaugauggaaucucauuguuugaacuuucauuucuuugcuaaugagauugaacuuuuuuuuggaacaacucaguuuuugacauguggcuuucaacgcauacugaaugcacaacuucuagucaaaaccacauauacauguauaggacucauggcuccaguugugacagaacaaugauugccuugcuaauauauuuuauauagcacugggcucagugccacagccgcuaaauaaaucauaagcuccuugacaaccaggcccauaucuuaaucauuucugcaucccccauaacccccagccuauugccuaacacaguguaagcuuuaauaaauauuuguuaaauggauauggagguggagcuuuugugagggucaauguuaaguugcugaaauagcuuuugaaaucucuucaugugaaaaaagaaucccuggagucaaaauuuaaaaccauugcucaggcuucaaccuaucaucucauaugaccaggaacaaugaagaaacagaucuuuccauaaaagggaacuucuuuuugccaaaggauccuuuuucuagccaugguaucaaauccacaaacacagcaccauuaugauaggggagagucaaaaguaaagcuacuagaaaugagcaaauggcuacaaaggaaaaugaauggaugagaagaaauaugggggaaaaaagaaaaaaauaugccaucuagagcuauuuuuccuucacuuuucuacuugguaaauagagcaagaaagcugcaaagacuaguggaaaaauuuuuggauaaggaaacugaggcuuaaagaggugaacugacuugucuaagguuauguagcuucuauaagagcauagcuaggacugagaggagugucuuuuucaaugagauccuacuccuauccccuacaccucacagcagugcaucaaagcaguuuggauuucuccauucuccuugccagcucuauacuuuaaauaucuaucucuucuugcacuucuuacacucucuucuugcacuucuuaugcucuacuacaauuauuuguuuucauuuuugccucccucaauagauucuguucuucaagggcaggaacugaguccugaucucuauaacuucaauaucuagcauaacgcuugauucaucuagaugcuuaauguuaguucaugaaagauaucauguuaauuaccaaagcuguguuguuauguuuuggcauucaaaccugagcaucuggaaaucuuucuaguugaauaaauuugccaaguauauaguaacucccaauaauuucugcuaauuguuaggguuuugccauaaguaaggcuguacuuggagaggagagaaaugacuacuguagagaaaugacaacaggcuagggaagaggaauaugagggaaacagagcagauuagggaaaacugaggagacuagaggagggagauacuggauagaagaagaagauguuaugggaaauuagccauuaguguuaaccauaugcuuuugugguacguguucucauauacauacauaucucacaguaauucuuuguguaguaucacacccacuuuacagaugggacaacugagacauguuaacugauuugcccagagucacacaguuaggaaguggcagagaugaaaucuaaauucaugucugucuaauuucaaaaccuguauuuuuccuugugucuuucuaauacuccaugcugccucucacuggcauugaaaggaauaaaacagaagaaagcuuuuuuuuuuuuuuuuuuuuuuuuggaauuuaaaaauugcacgucaaauuaaccaaauauuaaugauauaccaugucuucuuuugaaacuuucuccuaaauuucccugauaguucuuuagccuacuuuauuuauguaacauuaccugugaaguacucuaccagauagggucaaguagaaguuauaggugguaaugguacuaaugaaagagaacagcaguauuugaaagcaccaaaguuauacauacauuaucuugccucaucauugaggggauaaaaugccagcgugugugcugcuguuggaagccuggccaccuucaguucaccuccugcacuuuugccacucucuuggcuuuacugaacuucccacaagcuccaugauucccacuucagcaugcugcuuaucuugugauuggcaaaauuccuauuuuuuaguuucccacaagcaauuggcagcucauuagaagugauuaguugcuuuccaggauuuuaaacguuuagaauguauuuaguuccccaagaaugaggaaaucuugacuggaucuucaaagaaucccauuuuagcugcguguuuucaaaaguaaaguuaauauccauagcaguuuauuguaccuaguugucuaaacaauguuccagauccaauaaagauuuucuaauuauucccauccuccuuucuggaggcagccugguaccagcuuugagaggaggcaggaagaugggucugucucaccccucuaccccucaaaggccuuaugaaguuacaaauuccaccuguucuggagaggaacucagacugaauaaaauauuaggucauuugguagaauaucuugacuugguuuugccuuaaugcauuuuaucauuauucuacaagaaucuaaagcuuucuuagaaaaguuugcaaaauacaguuagguugaccauguaagaucuaagaccuggaagggauauauauaagccguuuaauucgucccucugcuuagguacaucaauaccuaaaucauaaaugagcgaugguuuuuauccauuugaaaauauuucuaaaugcagguauuuugugucuucuuagucaguaguauguucugguguuuaagucucuggcauggucaagaaguucucccuaauguuugaauucuuuucuagcugugcuuuuaugcccaauugauaugagcaauuuagaaauccuagggagaugcaugacauugaaauuuccugaaaaguacucagaguuggauuacaguagaaacaaugaagaaucgcgccagccugcagagauauaagcagaauaugaaaauguauagcugauuucaucauggauuugcaugcaaauaaggaugaagcagucuaugggagggggaaaacaacagguagagaaaguagaacuuauacuaaugccauuggaaaugaaucaguagaggagaaaauuuuuagggcaauaaugggaaauaauuggaagagauagggcccacuucagagagauuugaggggauagauuuuuaaauagaaagaacaagauugauuguauaacccaugcaaucugcacuauaacaaguauauugggaaguagggaagggaaauagauacaggaaaauacugacugguuuaucaggaggguaagauggugguauaguaccuagagagcuaaguaauccacugauuuugaagcacaaguaaagaacaacucuggugaaaguguaauuggaaugaugugccuuuauaaggccuuggcacaaugagaaguuacauuugagaaguauccauuuugaguggguauucauguaggccaggauaaagauuuuccuagagaacagcugaauauaaauaaguaaaucuuugaggaguagauuuuggaauaguucauuuagacaaaugaaaguucauguuuauuauuauuauuuguuuguuuguuuuggagacggagucuugcucugucacccaggcugaagugcaguggcacgaucucagcucacugcaccuccaacucccagguucaagcaauucuucugccucagccucccgaguagcugggacaauaggcgcccgccaccacgccuagcuaauuuuuuuuuuuuuuguauuuuuaguagagaugggguuucucuaccccgugguaaccaggaugaucuugaucuccugaccuugugauccacccgccuuggccucccaaauugcugggauuacaggcaugagccaccagaaaguuuguguuuaauccugaauaugaucacuguuucacuucuaauuggagauucugccuaaggaaagaaguuagaguagguaaagacuauugucacccagaguacauucuugggacccuaagcggagaaguugccauuaaugaggaaggaugagcucaccaaauagauaugccuuguacauacuuaaaauugcaugaucauucugauaguuaugaaauggagcuugcaugauucugagcccacugccucagcuagcauuccuuuguacugguguuggaaguuucugaccaaggcuggcagccuugguagcaaggauuaccacguaaauacuauuucuguguuugguagugauauuagcuauugaucuucaccucccucagaaauuuggcaguaaugaucucuucucauucaucaugauacuucccaggcuuuggagauucugauaauugugugaaguucugaaacuacucuucaaaacauuuuaccagugacuguagagaagcuaaugagaaaccugugaauuugcuggguuugaacaguaaaguuugaauuuuucuuuuucaucuuaaacuguaaggaagagcucagcuagcuuuauuuaccaaaaaaaaaaaaaaaaaaacaaaacccaaaaaacaaacaaaaaaaauaccccacaaagucauaucguaaagaugaacauaucuaaugaacagaauuuuaguaucuugggccuuaaaguuauaaucucauggcuuaaagugaagguuauugauuucauccaucauaauauuuugcauaauaauccagacuuuaaaugaaagaaauagagaauuagguaaguucugaucagugaacuacugauaagguaacaguuucuuuaaacccagaagauggcuguaguucaacucauuaaacauuagcacucaggcaguuuccuuggagucagagggauccagagaugagucagccaugaucucugcccucaaaggacuucuugucugauaggaaggagaagcccaauaauaaucuaaaguugaauauguugaaugugguuaagagagguaaagacagcccucuggaauuuaggcuugguagagauuacaguugaguuggggcagggagaucaggugaggacuggaccaaaggaucaggugacaguuaaguggguccugucugcagcaaggaucaggcaggcugggcacaggaaaugagauuuuucuguuacuuuauuaccagguggaaaagauuugaaaguggucgaagggaagcuuaccaaaaaaacauaaauaaauaaauaaaaggaggcugaugaaauagaaaugguuaccucuucagcugaauacugauauuauggugaauuauggacacauuauuguuacaccuugacaggucaguauggguguaccuccauagucuauaaaauuuguauuugaauuucagaguucuuacuagaaucgaucaggaaguuauuauagcauuauggaacuucagugaacucauuuaaucuguuguccagccuaguuuguuauaauuaggugagaauacguuuuauuuuuaaaacaucuuuaguucauuagccgggcguguuggcgggcgccuguagucccagcuacuggggaggcugaggcaggagaauggcgugaacccgggaggcggagcuugcaguaagccgagguagcgccacugcacuccagccugggggacagagcgagacucugucucaaaaaaaaaaaaaaaaaaaaaaaaaaaagaaacuuuaguuuuccuuaguaaucuguucaagcauuugcuauuuaaccaaacucuuguaaacgguauuuuaucuuguucugucaucaguacagauggagaucagccauguuuauaauauccugcaagacuuauuaaauguuucccccauuuuaucuaggcuuacauagucccacugucauugccuguacucacaacccccuuacucuccauugcuuugaugaucuuucuuuuucucuaaaccucuauauucuaugcaucuuuccuuuauucccuuccucccagacauauuuagagagugggucagccacugugcuaagugcugcaacauaucagcccuccuucucccacaacacugauuuguaccuugcugguacugugcuuaugugacugcauggcccuuauagagacuauauaccauaaaggaagguugugccuuugaacuuuaugcuuuuaaugacuuucaugaaaaaaaaauuaaucagugucacuagaaaugcuagauuuguugucuauuuccaauugauuucaguuuccuaugggaaugugaccagcauugauauucuugcagucuaucagcaugcaugcuucaaugcugcuuuuguuugguauggccacuucaguugguuuaugugaagauuguguaucuccuaguucaucuuccaguccauuacccuucucuaucugugugcucuaugggaugaauuccacagaacguuuuaggaagcagggcuaugauggauuuauuuuaagguaaaaaauuauuucucuguuuuuuccuugaaccacucccccaacuccaaucucuuuucucagucucacucuauauuucuuuaccccccaaaacaagcauagagucaguaaccauaaagugucauuugucucugauuuagguuugagucugaacuaauuuugaauucuuggcuguaauggaugcuuucauaauaauuauuggcagcaccucuuuccaccuuaguuuuuauuaauacugacugaucuuguguaagaaauaugaaaaauauuucccuuuccucuaucacuucauguauuugaaaugacaucccuucucucuuccuucauugaaguggcagcauugauuuucuuuuguuaaucucugcuucuguuuucagaaacaacaaucagacacacaucccugcaaauagcuguucuuuugucucuucuaaauaguauuuuuaauacaaauuuauuuuccuauggucagcuucucuuguacauuaauagaagcaggcaccaguucucuuguacguuaauagaaacaggaaccagagaaauaacucaaaauauuagucaugauucugacucccacccaacaagucaggcacucugcauugcacuuauuuucuguaagugggcaaaacccugaggauuaacuaguucuaguuuggaaaacaguuaauucauauguuugagcaugacuuaugaaaaauuuccuguuuguagauacgugugugugcucacuguuguaaaagaucuuucuuucaaaucugaaagcccugagcuggagagcugucauggaaaaaaggcaauggaaaagucuccuaaaauuguuccaauuuaagucaacuugcuccauuuauaaaacuguuauauaggcagucggaugucugcuuucagcaagugcaugcgcagugggaccugaaauugagagcaugugaaauccgcaauucguaugauaagauauucuuccugaauaaugaaaauugcaguagggaaacaaaccuucaagcaggaaucagcuuuuuaagcauuuuuuuuuaaaaagauaucugugcccauuaugaaguaagagagcguaaaauguaccuuuuggcgagagaaacaaaaauacuccuuacuacagauggcaaacuguagacaaaugcccuguaugugguaucacauguaauuauaucauuuugucuugaaacauuuuaugaguuugccuugcuggaugucuguugucuuuaucuugucucauaugcauauacucaguuauauguauguauacauauaauuugauuggauaaauccaccuaaauuaacuacucuuggcuuuuucuuugccauguggcuggaggggucacauauuugagauuucaaaauaaagaacauuuaagguaucaguggaaaaaacuuaggaaaaaaaucuguuaucuguucuuauaaggagaaguucagguaauggaagauucagagugaauucuaugagcaaagcugguuuaggugaugaaguuucaauugauacaacuauaucaaagcuugugguagcaaaucuuagaauucuucaucuauaacuaacaggcacaaagacaauauaguaugcauuuauuaguacugauuaaacuacaaauauaagcuauucugguggcaguuagaaagcacaauguaaagaaaauaaaaggaacuacuuuuuuuuaggauuucagaaggaaggcaguuuuacagaacugagugaguucugccuuuucauguuggauaucguucugguucucauccagacuaguucaaaaguucaguauaauaaauuuaugaugacugugaaaccaaacuauuucuucaggucuuuggagagaaauauggaaagaguaguggggaauacuaauauguacuuucauuagcuaugucauguauaaaggagguaaauauuagaguauuugucauucacuucagaaggaugccauuagaaaaugaaacuggcaagaagucuucagcagcucccaaaagaaaaguuauguuuucgagguccaguguaucauuggagugggaagaggauuauuuccauaugugucaggguuaguuuguauuugagguuauuuaaaaagaaagaaguugaaccucauuaauucaguauucuguuaauuuguaaacaagauugccugagggagcuuuuaaacugcuuaaaagagcaaacuuuucaaacacuuuagagguagugccugguauacuaauuucaaacaguuauuugcaugugaggcaaacauccuugcugggcaacauuuuguucauuucacucuagcuaugguaugcacaguaauccuuuccuaagucugaauucccuuaaucaaaauuauagccuaggcagacuugcaucuauguacuucuuucccaccaucaucucaagaauuuuggauagagauuuauacaaaucuccauucacuccaaguuuugaauuugggagcauuaucaagguaccccaaaucuaacaccuggauggaggauuggucaaugaaaaagugucucuuaauauuuuauuuguaacauggaacagugaauuuacaaggaucucauuaaaacugugagagaggaagacccuggaaaguuuguaaucagcggauuaagugaaaguuaauuguacagcauccuuuagugcucauuuaccaaacacaauugauauucuuuuuacuuaaugugcuguuucuguugcuuuauuuugaugagcauuaacaaauauuucuaagaguucucuuagggucacuuguaaccacagucuccuaaauucuagggaauguggcauuguucagcucaagagaaaauucugagggagcccaaggccuuagguacuuauguuuagcuacugggacucacuuugaucccagaacacugggaccuuuuucugagugucugagaaguagacuuucucuuucuaguuguauucuauuauucuugcucgaaggcuaaacuuuuccuaaacuccccucaucuuugaugaaagaaaagcuuucacucaaacccccauuuucuguccucagccagccacauuguuaccucaagccuaauucucauuauuuugagucagcaggacucaacuaguuugcagcuaugcauucuccauacuuuauuuuacacuuuugucugauuccucgcaguuuucagcuccuuucaggccagacuuccccuuucauuucaucugaucuauuuuaagugucauuugugcuucuccugaccaacaccuuaucuauuccaaauuagcauauauaagaaaguuguuugucuaaacuuggaagguagcuuccuacucccaccaaggaggacugugaggggagugcaaaaagggaaguuuguauuucuguuccuucugcuguuaccuacaaccuccccgucuucugaacugggacccucaggcuuuggcccuggauuagguauuuuuucuauagcucccaccagcugaggaccacugaguuauuuacucuuuaucuacagugaagauauuuuugaacuaaacaugguaggggcauguggucuaaaaaugggaccaaauauuaaaaaucagaauuuuuccuuauaugcuguuauucuuguaacucaacuauaucuuuacuccacuuucuauaaucuccacuguagguagcagcggagggugaggggauguguugggagugagaguguuuugugaaacaagucuugccucccuuagaaugugaagaauaaguucugguuuauucuuuuauuuuauuuucuuuacccuucuucuuuuuuucuggaaagcaaaauggauuuaccaaauaagguuucacaaauaacuguacucggucucccauugaucuagggccccuauacaaacagcccuggaguuguauggcuggugaccuccucaugcuuuuucuuacgaagaauaaguacaaccuaccucacuagggaguguccagucauguguuuccaguuuuguuaaagugugacugaauguguauguuuaaaguguacagugugaucauuugauauacauugugaaaugaugaucacaaucaagcuaauuaacacaacaaucaccucaccuaguuaccguuuguguguguguggugggaacacuuaagaucuacucucuuagcaaauuucaaguauacaguuuuauuaacuuaguuuccauucuguacauuagauucacagaacuuauucaucuuauaacuaaaaguuuguacccuuugaccagcuauuccucauuccuccugucucacaccucccuuucuccuuucaccgagucauuuugugaaggcucuacuggccaugguuaacuuguccuuccucacagguuuauuuugcuagccauauucucucuuucagaagacauguugauuacucuuuucacuuucuggugaugauugucuucugugagaucuauuauguaagacuuuaucucuugcuaaaaggauguauaagcuaaggaaagauuccuggcaauagcuauguaauaaagaacagggaaaaaguacaaugaaauguauuaaaaaugacuuuguggaagaaauuuuuuuguaucacgaaaugcauaguuacauaguugccacagaaacuuuccagauuuuuaaauuauugucuauauucaugagagguaaccauuuguauaguuaucuauugcugcauaacgcaucaccccaaaacucauugcuuaaaacaacaauaauaauuuauuaucucucauggucucuguggguuaugaauuugggaauggcuagguuggaugauuccugcuggaggucucuaauggggucaugcauuaggccauucuugcauugcuaugaagaauuaucuaagacugggcaauuuauaaagaaaagagguuugauuggcucaugauucuacuggcuguacaggaagcgugguucugggauuugcuucuggugagggccucaggaugcuuccaauaauggcagaagguaaagggagaacaauugcaucacauggcaaaagugggaacaaaagagagguagaggugucaggcucuuuuaaacaaccauaucucaccugaacugagugggaacucacuuguaaccaaggagauggugcuaaaccauucaugagggaucuguccccaugauccagucaccucccaccaggccccaccuccaacauugggaauagaauuucaacaugagauuugggagaggacacacuuccaaaccauaucagguugcaaucuaauguuggcuggggcugcagucaucugaaggcuuguuuggggcuggaagaccuguuuccuagugacucaauaacauggcugcaaguuggaacugacuguaggugaugagacucaguuccucuccuugugggcuucuacauaggucuucuguaauauccuuauagccuggcaacugauuuuucccaaaacaagcaauccaggagaccaagauggaagcuacaaugucuuuuuuggccuauacuuggaagucacacaucaucacuacugcuguguucuauuggucaugcagggccaagccugauucauugugggaggagacuauccaaagucaagaauaccagaaggugugcaucauuggggaccaucuuggaagcuggcuaucacaccauccauaugaaugagaaauaaaccuucugaguaucugauaauaauaauaauaacaacaacaauaacagaagcuccuacuuuucugucuuaauaauuucuauauagaaacuccuaguguaauuucugggcuggcacgcacuccugguucucuucuuuccuccuugccuuuauuuugucuaucacuuucauggaacucuuucuucagucugcacuuucaacauguuuccuuaguggcuuaucuuuaguucuuuauucucacuguacaugcuuuaccugggugacauuaagggugcuguauuagucaggguucucuuagagggacagaacuaacggguauguaauauauauauuacuguauacauauauaauguauuauauauaauguaauacauuauguauauaauauaauauaauguaauauauauaggggaguuuuuaaaaauuuaauuauuauuauuauuuuuuuuuugagacagucucacuccguggcccaggcuggagugcaauggcacaaucucggcucacugcaaccucugcuucccggguucaagcgauucuccuugccucagccucccaaguagcugggacuacaggugcccaucaccacacccagcuaauuuuuguauuuuuaguagaaauggguuuucaccauguuguccaggcuguuccugagcuccugaccucgggugaucugcccgccucugucucccaaaguacugggauuacaggcgugagccaccaugcccggcagggaguuuauuaaguaauaacuuacauggucacaaggucccacaauaggcugucugcaagcuugcggagcaaggagagccaguccgagucucaaaacugaagaacuuggggucugauguaugagggcaggaagcauucagcaggggagaaagauguagacugggaggccaggcccaucucucuuuucacauuucucugccugcuuuauauuugcuggaagcugauuagauugugccuaccagauuaaagacggaucugccuuccccagcccacugauucaaauauuaaucucuuuuggcaacacccacacagacacaccuaagauuaauacuuuguaucccucaauccaaucaaguugacacucaguauuaaccaucacaggugcccacugcugaggucucaaauccguauuuucugccuaaacuucuuuuauuuccagcaucuaucucuaaaauauauugcaaauugaccauuuucaaauucuaacugaucacuuuucucucuaagccuacucuuccuguacccucuuucugauaucugacaugaaguugacauuggaguguuuacugaaugaaucuauuuaugcaucgugacaucucuaauuguaggcaucuuuaugcuuuucagugugggcaaaugucacacuggcaaaaauaaauuauuagacaacuuuagggcugggcacgguggcucacaccuguaauccuagcacuuugggaggcugaggcaggagaauugcuugagccaaggaguucgagaccaagccuaggcaacauagggagaccccaucucuaccaaaaaaaaaaaaaaaaaaaaaaauuaaaagauuagccaggcaugguggugcuauuaggucccagcuacucaagaggcugaugugggaggauugcuugggccugggagguugagcaugcagugagccacugcacuccaggcuaggugacagaacaagaacuuucucaaaaaagaaaaaauaaaacuuugauagaagaauuuuuuaaaaauauaggcaauacauuaggaauaaauggguaaaaguaaacauacacauagauauaauacuuaugguucauuucaaacacuuauuuaugaaccagaaaagaugccugagagucacugucaacuauuacuugaagucucaaugcccaauacugccauaagggauucguaauccuagguauuaucaggauggaaacaaagcucuaccuuuucaaaaauuauuuuauuggguauucuucaaauguggccuuuuacaaucaccucuugucccaaccucagcauaacuucagcuuucuccuuugaccuacucugucuauauaaugcccugguucugagaagcuuagacuaaaacuuuugucaaaggauaggaaaagagcauggugaugauggugaugauggugaugaugauggugaugaagaugaugaugaugaugaugaugaugauaguuaacauauaguaauuuucuucuauguaccaaaugaugugcuaaguggucuguaugcauuaucucauuuaaccaucacaacaaccucgcgagauagguacuacuaucuuuaaccccauuuuagggaugaagccacugaggcucccaagaucacacagugaauaagauaugcauucagguugagauugacaccugucuuacucaaaaucucuuuguaaucccuuccaaacccccuccccuagccucaaucaccuuaauaagugcuguauaccuucuuaaaggauauaauacugccuaaagucacugaguuagaggaaacuccaaaggucauauauauagccuauaaaccuacauaugugagauauaagacacuauagcuucugcuguuacuuuaguguccucucuaaguugaaacucucaacagcucagugaaguaucuauaaaggauauuaucaccacuuaggggauaugugacuugccgaaaaucacccaguaagcuugugauagagcucgaacuagaaucuaggccuccuaauaccuaguuccuuuuuuuccuucuauuuuaguguucaaaguuaugaguauggaaccacauuucuaauuaucauuagccagaagauacacaugacuguucugagaugucuuuuuuuuuuuuuuuuuuugaaacggagucucgcucuguugcccaggcuggagugcaguggcgugaucucggcucacugcaagcuccgccuccuggguucacgccauucuccugccucagccucccgaguagcugggacuacaggcgcccaccaccacgccuaauuuuucuuguauuuuuaguagagacaggguuucaccguguuagcagggauggucucaaucuccugaccucgugaucugcccgccucagccucccaaagugcugggauuacagguguaagccaccacgccaggccuguucugagauaucuuaaaugauauagauuuuuauaacuggggagaacaaaggaccaauaccagucaugugcuugagaacuaccauaucaguguugaugacucauuugcuuucacccaaacgcccucuugaguccuuuaaacuuuuuucccuucaacuuuauugagguauaauugaccaaaaaaauuguguauauuuaagguauacagcauggugauuugauauauguauacacugugaaaugauuaccacaaucaagcuaaugaacacauccaacuuguuuaaaauaagucuauuaucccaggauucccagaccccccugauaaaaguccugggucuuccugcaaggcaugcuuuaauacagcuucuucccacaagggggagccaaaaaugcuuugggggcuaggagaugaaaaacacuaagagguucugaaaauccugcuuccuuucugguuucuuuugccaguaaggcccuuccagcagucuccagaaaggaaaaguagaugguguugcugcugaugguaguguuuuuguauauggacaugggauggggguagggggcuuuuaucugaagaaacuugauccugagagauaaaguccuucugagcaaccagucagcacuguauucucaucaccuauuuccuucuccugcuggaacuuuguccugcaaagcugcauucuuuugccaccgugugggggaauuggaucagcugccuguugaagucugcucccuuaacacugggucgauaaucuugccccaucagcccauuggagcugcuucugccaccucccgcuaaggguguuaaagaggaccugguaaaaagacuucuacugccuucuuugcagaaaguggguagauguugggggagaaaaucccaugugauuauggccuuuagcacugcuuuaacuuugguaguaccaauauuucaguuaagccaggagcaagaaggguugcuguggcuuugacagauaaagcaaauuacugaauccacauuugaagaagaaauuuggccccaaaccaggaguauguauaaaggauggagaaauucaggcuuauucagaauguaaaaauuaauuaaacuauuguuuccauugauacccugcagaucuuuuuuucugucagaaauauuuaagaaauuuacaugugauaauaacuuucaaacacgauauuuccaaaugucaaguuaauguguucagggaacaaaaagacucaaguacccaguaugagguucacaucacaucuguuuccgcaaguacuuuugggacccuuugaggcaaagacagugggggaccuugacuuauuuguaagacauggaagugaagaugggaacaucccuuucaucuccuuucaucuuuaaaaagggagaugaggauugguuggcauagucuaguauuucaggaaaaaauaaauuacaagugauuuuaauugcagaaauaacaauauucauaaaugaaaaaugggguuacuuuuuaggauagagagaaguaggcuauuaaaauggcauauuuugaauaauauaacuucccagcaagauguaauugcugauuuuuuaaaagaguaaagcaauaaucuaguaauucuaaaaauccauucaguuuucuguagacauuuaagaauuacuguuuguuuuuuggaguggaaguaacaucuuuugcaguuaguuuuuggaacauggccacugcugaauaaagaauuccagucgugcauuauauuccuuuuguauaauugcacuaagagaauacguuggcauauuguaugguuuauaaugagcuggaaauaaaaaugaaaaagguaccacaaacccucaacaaugaauuaguuauucugaauauuuuauuuuucuaacagugaugcuauguaaauugaacaaaaugucaaaaaugcuucuugguauuuggucugagaguuaaacgaaagcaagguacagaacugaucagugacuagauuucuugguucuucuaaggaguuccuucacagggcaguuuagcuucugucuaaaccugccuuugaagacauguuggguuaggucuaaaucuguucuuuuaucacuauuacuccaaaucaggcaaugaggagguugugcgacccugaggccccaguugcaauuaaaguacuuaauaauaauugucaaaaacauauacaguuauuauacaagaaugauuaucuugagcuacuagcaauccuuuaaccuuuaggcuauagguuccuuacuuucuuucuaauuccucccauguauuucauaugaguccagucagaaacuauagacuguuaaaaacugugaagcaucugggauuuuuuaccuuacuugcaagccagcaaguuagcuaagacaguuucuuguugcuggcaggagacacaagacucguaucagagaugaagaacaguuuauuacucacagcaguagcaguagccaaagucucagcauuuucucugagccccgguacccacaagauggugugaagagggccacaugaugucugcucacucacuggguugcauuacagaagagaaccccaagcucagggggcucaaaucuuuuauaaaaggcaguaagcaugccagcccuuugcuccagagagugacauuauauuuauuauacugcaauguaguuaucuguaucuucaagggcuguaagcaaaccugcuuuuuuuccccgcagaguaagacacugucucugucuaaacagucuugaaaagauuauuccagaacgaagucacucagugcaucugcucacaagcuguacaaaaacacaagagauccacugggaauugucucccaacacagacuagggccaagauggccucugaagaacuguuggccuaguccauccuugggaguugcugcugacaggacaaagcaccauagucaucaccaucauuacuauuacucuugccuggaagaauuuuguccucaucuucccgaaacagaaaguccguacucugcaccugacucugguuuagccaggagauuugggaggauguaacuuggucaccauaauuuggcuugugacuugagauugggggccaaugguuacaaaguuaacaugcuaauuugguuuacuccuaucucucacuuaaaaaaaauaacuaacuugauugaagcuuuauguagcuccaguucagcgguucaaagcuuugaagggaaagaccauucuguuggaaggaaagauguggaauuuggaagcucaggccaacucccagucccugaagaaaaaugggucuccugacauagccuucaauaagcuucugggcaaaggggccaugaagccagccaaaagaucucuguuuaucugccacauuuucuucacauagguagaaauauuaucuuuaaaucagcaagcuguacaaucugaaauuaacaaaaaauauugaauuauagagcugugcugucaugaaaauccaaaaauuacugucuucaaaguuuugccuuaaaaauccuuuuguuuucuugccggauucuaggaaguucaacaugagaaaaggcuguauugucagauuguauuucauggacucuuaaaguugcaaggaaccuuagagcucugcaggccagccuggcccccagggcuaaguccuugcuguaacuucuugucagaggaucauuguuccucucagagagguagcuggacugggcaaagcucuggaucuguacuaggcuccgccacugaugggcugugagacuuuguggauaucacuacuucucuagccuagguguacucagaccuaaagaagagagaagccagaugaucuuuuaguguucugcuagcucugacaugccucugguggucucuaaauucuggaaugugugaauauuugaacauuuugaaaggaugauuuuuuuuccugauaauagaaguaacacguuuauuuuagaaaaauaagaaauuacagauuuuaaaaguaauuucuaaucuuauuaccaauuucagugcauauuuuagacuauuuuguguguguaauaaaauuggagucauauuguucuguaauuugccccuuuuacuuaucaaaauagcaugcgcaucuuacuauagcaauuguacuguauccugaaggaaguagagagccagugaaggguuuuaaguaauuuucccuguaagucaucccucuccaggucagugguagacaagagagaagauaguuuuuaugcaauuuugggauuaguucauuccauuguuuauugcuuucugugcagaaaaaggauggcucaugguucucuucauugaauauggggguuauagauuauuuuagaaguucagacaucaugagaugcuauauuauuggcacugucuguguacauuugucugcugugaaaacaaauuagaauggcacauuucaaggcacuacucauauggagacuauuuaauuauaccaaaaucaaaacuaucagcuaugaauaucaaaucucacagcucccaacgcagauacugacaaccaucaagccaauuuuuaguagcaugugggccaauuguuacaaaacagcuuuuauuuauuuaagcucuuuauuuaagugaccaaauuuauuuaagauucuuucauuccuuacacauucaaaaggaucagagguacuguacaaaauuaaacacuguaaaauauagggccuuuacauuuuaaaaaucaaggauaccaacuaaggaaccaaaaagcguggaugccaugaaguaucuagauaagucaauccaagucuguuuccuagcagcaaaaguaaacaggaaaauauauuggcuugcauguuuuuauuguugcagcagaaaaauauguauucuuuucccccagacaaauuuuauccugauauuuauuauauggucucucaugugaaagauaauagguaguaguagacaccuucaacuauaguuuugcaaaggaacaauaacccuguuaaaauggaaaauuccuguauugaccuucuacauaaggguugaguguguaauauuaaaucauaauucaguuuagacauuucuuuggaggcugaaauaauacaguccugauauguggcuuucugauuauuuaaaauauggaaauagaacuuggagaaugugguugaucaucuagcuaucaugcccacuuuauucuuucuuucucaagggucagaugccucaaggggaccauugccugacuauagcuugcauaggaaucauguuggaaaucuuggucagguaacucuaggacccagggucuagguuuauccauacacuuugaguagguguucgauaaaauuuuguuaaaugaauaacuuaccaggguccacagccuggacagacacuuuccucccucuuaguacucucucucuacuagggagcaccuuacgugaaucugcuuuuuucuccauguacuaucugacuacucucuuauucauuucucagugaucuccucuucuuccuucucuuuuuuaccauuuccacccuugugcagucugcaucugccauguuuuggacaacagcugccacaaauacaauuugaaugcaaauacaauuacauuucaaaaauuacuccuaccauauugcaaaaaauagaaaacaacaaucaagaaaagacugguuaaauuaugaaacagcaauaugauggaauacuaugcagcuguugaaaagauguugagaagauuuaaugacaugaauaaauauccaugauauauauuuaaguggaaaaaacugugugugaguauacaugaauuucuuuugauaucuauuuuuuucuauccaccuaucauuuauugagagagugagacauagagacacaaagacacacacacccagagacagacacacagacagacauagacacacacagagaguguacagcuuuaggugguaaaauuaaaggugauugcauuucuuugcauuuugcuucucuguacuuuaaaauuuuucuauaguaaacauggauuauuuguguuuaaacaaaaaauauaaaacuccuuggcauggcauacaaagccuuuuaauaggcggucagugcauauuccucuagcuucuguuuuaauauucccucauccuuuguuauaugcguuacaaacuccagucacauggggccacuugaauuucccccagaugcucugggaucucccucccauacuagacugcagacuccuaguagcaguugguggcuggguuguggcccugucuguaucuuuuccacuuagugcagugccuggcgcuuaacaagugcucagcgucuguuuguugaaugaauaggcaauguaucauauacucuucucucgauuuuaaucagacccucccuccuccuuccuugucacugaugcacuucugcuguucaauuaucaaauuauggaccuuauaucauauguuaacauggguuuggagauagucagugaacauguccagaguuguuuaaccaugaaccuuauauauauguucaugcccuuauacauucuuuagccucuaaucaagcucauucccuaucuauuucaugaaagcacaccuucauuuuaggacuuauuuugaacacauaaaaagagaugaucguaagacauccuaacuauaaaaaccugcaguauccauuucccuccugaaaaaacauaucuggcucuguuucuucuaaaaguaaaauuagaccuugcagagaugguacaauuuaaacggcaccacccaauuaauuuuucuggccaauuuuauuuuugaaacaauaauuaaacauggucuucuguaacaucuauucuuucuuuuccccaaggagagauuuuguauuauuuuccuuuugucuuugcucagcacuuuggagugugugaguuuucauuaacuauucugaaugcaggcaaaggcaaugugguaggaacaaacacaaaucaaggccgcauaaauuaauaaucuuuuuagaaccauuguccuguaugccuuuagaaauuaauuuuaauaccagcaaacaaguucaaaaauuccuccuucuuuagcuacuguaagaaacucaaacuuccuuuggcaauuuuaugaaugauaaaagcucacuuuugccuauauuuuuauggcaaguaucauacggauuuaugcaaggggaacaaagaaaugaguggagagagaccagccaccuguguuaaucaguagaguacaggaaaguguguuauaaauuaugacagguagaucuuucccuuucucuuuuugucucuuucugacuaacugggugugugaauuuaucuuccugaauuguaagggauuucuccauaaaauaucaguuaauaaguaccucagguagguucauucauggguagagugucuccuaaagaucuaguagccauagaauagagcacaguguaguuucaugguuaacagcagagauugguguuagacugaagcugacuuuaaccccagccucaccgguaguaagcucugucauuuuauuuuauuuauuuauuuuuuauuuuugagacggaggcucacuccaucacccaggcuggagugcaguggugcgaucuccacucacugcaaugucugccucccagguucaagcaauucuccugccucagccuccugaguagcugggacuauaggcacguaccacuacgccuggcuaauuuuuguauuuuuaguagauaugggguuuugccauguuggccaggcuggucuugaacugaccucaggugauccacccaccuuggccucccaaaaugcugggauuacaggugugagccucccugcccagccagcucugucauuuuagauaaaucgcuuaaccucaguguauaucacuuguguguaaaagggggggaaauggugguauuuacuucauaagauuauucugaaaauuaaaugaguuaauagauguuuuaauuuguacuccccuaauggcuagugauguugaacaucuucucaaggguguuggccaucuacauacccucuuuggcaaagugucuguucaaaucuuuugcccauuuuuaaauuggauuguuuauuuuuuuacaguugagguuuuuuuguuuuguuuuguuuuguuuuguuuugagacagagugcaauggcacgaucucagcucaucgcaaccuccgccuccuggguuuaagcaauucuccugccucagccucccgaguagcugggauuagagacaugcaucaacauacccaguuaauuuuguauuuuuaguagagacgggguuucuccauguuggucaggcuguucuugaacugcaaaccucaggugauccgccugccuuggccucccaaagugcugggauuacaggugugagccaccacacccagccuacaguugaguuuuuaaauauaaguuuuuauuuugaaauagucugugacucacaagaaaugcaaaaauagugccgagaauucucaaguguccuuugccuagcuucccccagugauaauaucucacaaaaccauauauauuguuaaaaccaggaaauugacauuggcacaauacuacuaagucagguacagaccuagauuuuacauacacuuuaaaaauguauuuuguuaaaucuuacuaaauguguagauucaaguacacaucaugauaaucaggauauagaacuguuucaucaccacaaauaaacucccucauguuaccccuuaacagucacacucuucccucaaaccuaaucccuaguaaccacuggucuauucuguaucacuauaaucuuuuuuaacuuugagaacauuguauaaauggaauuauacaguaaucuuuugagauuggcuuuuuuuuucacucaguaugccuuuggagauccaucacaugauaguucuuuauauauuauggguauaaguccuuuguggaauguaugauuugcaaauauuuucuuccagucuguagcuuaucuuuucauuguccuauaaaugucuuucucagagcaaaaguuuuuaauugugaugaagucuuccaaauuauaaguguuguuauggauuguguucuuggugucauguaaaaucacucuuugccuaaccccaggucaaaaaacaucuccuauguuuucuuucaaaaauuguauguuuuuuuuuuuuuuuuuuuuuuuuuuuugagauggagucucgcuuuuguugcccaggcuggagugcaguggcauggucuuagcuaacuguaaccuccgucucccagguucaagcgauucuccugccucagccuccugaguagcugggauuacaggcaugugccaccaugcccgacuaauuuuuguacuuuugguagagauggaguuuugcauguuggccaggcuggucucgaacuccugaccucagguggucugcccgccucagccucccaaagugcugggauuacaggcgugagccaccaugcccagcccccaaaauuguaguuuuacauuuuauguuugaauuaauuucuggaaaagguuugauuuuagggagagauuuauuauuuuuucacaaguaauuuuucaacacuguuguugaaucuuugcuccacugaauugccuucaagccuuuauuaaacucauuuuccccuauuuguguggguauauuucuggacucucgguuguauuccgggaauguauauaucuaucccuuuagcaacaccaugcugucuaaucuuuacaguacuggagcuuuccaauaggacuuaaaauugugcaauaggauucccccaauuuuauucuucuuuuucaaaauuguuuugguuauucuggguauuuuggauuuccacaggaauuuuaggaucaguuugucuguauaugcaaauuaucuugcagggauuuugauaggaauuguguuaauuagaucaguuguguuaauguagauaaauuugggaagauuacaucuuuacuauguaaagucuguaugaauuuugaagcucugucauuaggugcauacacauuuaggauuguuuuacuuucuuuguggauugacucuuuuaucauuauguaauguccuucucuaucccugauaauucuuuuugcucuguagucuacuuugucugauuuuaauauagcuagcccagcuuucuuuugauuaguauuugcauaguauauuauuuuuuucuuuuugcuuuuaauuuccauguuugugaauuuauuaaauucccuucuguuauugauuucuaauuucauucuaccaugguuagaaaacaucucaugugucauuuuaauucuuuaaaauuuauuuaaaauuguuuuguguccugacuuuuggucugccauggagaaugcuugauguucacuugagaauguguguucugcucuuguuggaagaaauguucuauagauguuugcuaggacuauuugguuuauaguguugugcaagucuucuguuuccuugcugaccuuugucuaguuauacuaugcauuauugaaagugaaguguugaagucuccaacuauuacuguugaauugucuauuucuuucuucaauucugccaacuuuucuucauguauuuuggggcucuguuaucaaauucauauaugcuuauaauuguuauaucuuuuugauggaauaacccuuuaccguuauaaaauuuuuuugucucuaauaacguuuuggucugauauuaguauagccacuuuagcucuccuuuugguuacuguuuucaugguauaucuguauguuuucuuccaaccuuuuauuuucaaucuauuugugucuuugaaucuaaaaugugucucuuguugacagcagauagcuggaucauuuuggcauuuuaguuggacauggguuuuuauuguuguuguuucccuauccaauuuaauucaguuacuuuauuuauauuuuuaauugacaaauguuguauauauuuauggaauacaacauaauguuucaauauauguauacauuguggaaugacuaaaugaagccaguuaacauaucuaucaccucaucuacuuauguacuuuuuuuuuucugguaagaacauuuaaaaucuauucuuaaagcaauuuugaaaaauacaauacuuaauuauuaacuguagacaccaugcugugcgauagaucucaaaaaguucuuucuccuaucuaacugaaucuuuauacacuuugacagacaucucccuuuuccccacucccccaccccaggcucucauaacugucauuugauuuugcaucugugaguucaaccuuuucagauuccacauguaagugagauuaauuggagacuuuaauaaauucccauuuaauguaauuacugauaaaguaggguuuccaucugccauuuuuaauuuguuuucuauauguuuuauguuuuuucuuguuccacuauuccugcauuguccauuuuaaaaagaucguuucaggccaggcacaguggcucacaccuauaaucccagcacuuugggaggcugaggcagguggaucaccugagaucaggaguucaagaucagccuggucaacaugggugaaaccccaucucuacuaaaaauacaaaaauuagcugggugugguggcgcucaccuguagucccagcuacucuggaggcugaggcaggagaauggcuugaagccaggagguggagguugcagugagccuagauugugccacuguacuccagacugagcaacagagcaagacuccagcuugaaaaaaaauuaaaaauaaauaaauaaaaauuaaaaauaguuucuacugugccauuuuaauuuucuugucaucauuuuuaacuauauauuuuuguguuauuuuuuaaugcuugcugucagcacuacaauuaaguucucagcuuaugacaauuuaguucagguuaauaccaaguaaauuuaaauaaauauaaaaacuuugguuguucuuuuuuuuuuuuuuuuuuuuuuuugggauggaguuuugcucuuguugcccaggcuggagugcaauggcaugaucucggucacugcaaccuccgccucccggguucaagggauccucccucuucaaccucccgaguagcugggguuacagguaugcaccaccaugcccagcuaauuuuuuuuucuuugagauggagucucacucuguugccuaggcuggagugcaguggcgugaucucggcucacugcaaccacugacucccagguucaagcaauucuccugccucagccuccugaguagcugggacaacaggugugugucaccacgcccagcuaauuuuuguauuuuugguagagacaagguuucaccagguuggccaggcuguucucgagcuccugaccucaaguaauccaccugccuuggccucccaaagugcugggaauacaggugugagccaccaugcccggccuaaaaucuuugguucuauauagcacgguuacucccucuccuuuaugcuguuguugucacaaauuacaucuguauauaucguguguccauaaacacagauuuauaaguuuugcuguauguaauuguuuuuaaaucaggagaaagaaaaaagggguuacacgcaaaaacuacauuuauauugucuuuuauauuuaccuauauaaugacuguuaccuguguucuuuauuucuucaugugaauuagagucacuaucuaauauccuuauauuucagccugaaggacuuccuuuaauuuuucuuguagcacaagucagcuaguaacaaauucucucaguuuuuguuuaucugggaaugucuugauuuccccuucaucuuuuuaccuaggugaaauucauauacaauagaacccauuuuaaagugaacaauucagugacauuuaguucauucacaauguuguucaaccaccaccucuaucuacucccaaaacauuuucaucaccccaaaauggaaucuuguauccauaaagcaguuacucuacauuuccccuucauuagaggcauaguuuugauagauauagacucuuuguuugacagguauucucagcaauuugaacauauuaauccaccaucuucuggccuucaugguuucugauaagaaaucagcuguuaauuuuauugaggauuccuggugcauggaucaguucuuucuugcugcuuucaagguuuucuguuugucuuuguuuuucaaagguuucauuaugaugugucuagguguggauaucuuugaguuuuucccaagaaucuguugaguuucuuggauguguagauugauuuuuucaaaaaaucaaauuugggaaguuuuuggccauuauuucuucagauauucuuucugcaugcuuuucucucucuucuucugggacaacaauuauguuuuuguugguaugcuugaugauauucuacaggucucugaagcuguuuuucuucaugcuuuuuucuuuccuuuccccaaccaaaugaucucaauugauguaucuucaaauucgcugauucuuuauucugccugcucaaauaugcucuugagccccucuagagaauuuuaaaauucuaguuauuucacuuuuaagcuccagaauuucuauuuaguuuuucuuuaaaaaaauuauauugcuuuauauuuuugacauggugaaacauuauucugauacuuaccuuuaguucuuuagaugugcuuuucuuuagcucuuugaauauauuuaaaauagcugauucagagucuuuguccaguaugucuaaugucugugcauacucaggaacaguuucuauugauuacuuuucccuucuguguaugggcuauaauuucuuguuucuuugcgugucuuuuguggguuuuuugguuaaaaauugggcguuuuaaauaauauaaugugguaacucuggaaaucagauucuuucccuuccccaguguuuguugcugcuguuacuauuuguuuuaauuguauuuauuuagugaguuuucugagugaacucuguaaugucuguguguggccacugaagucugguuagcuuaguggucagugaaugauuggacagagauuuuccuuaaaugcuuggaaugaacaaauuuuccaauguuugcugaggggcucuguguguauauuggggcaucuuuucaacaguuaggcaguugacaacucugccuuagccaucauuucuuacuugugcagggucucaaggucaaccauaaguaagaccuuugugccuucucaggucuuucccgaggaugagcacagcccuacauguguacaugaccuucuguauuuccaugaauaugucuaagauuuccaaagccccuguggauaucuucuuuuccaguuuuuccuguuaagcuuuuguuuauucuuugucccagcuguauccaccaccucaggcagucacagagccuugucaguaauacucuuugacuaauucccaacccucccuccuccccaagaaaaugcuuuuuguaguggguacuuuccaaaucaggucaaaugcaaacagccuuguaaauugcaucuuccagauaaccucccaaugggucacauaaugacaauuauuugagaaugacacuuugugagagcuccacuuccauucugcuccuuaagguggcugucaggcugcaccaggaaugcagacuguuauuuuucaaggcuacugcagaacuggagagcaggagauggaccuagagcaaguuaaaauuucacaaaauucacuauucuuacaaagauucagcgauuuuacuugaauaacugcucccugaguugcuccaagccuuccauuaauuuccagaauucauagaaauguaauuuucgccaggcacaguggcucaugccuguaauccuaacacuuugggaggcugaggugggcagaucaugaggucaggagaucgagagcagccuggcuaacacggugaaaccccgucucuacuaaaaauauaaaaaaguagcuuggcaugguggcacacgccugaagucccagcuacuugggaggcugacgcaggagaauugcuuuaaccugggaggcagagguugcagguugcagugagcugagaucgcgccacugcacuccagcccgggcgacagagcgagacuccgucucaaaaaaaagaaaaaguaauucucgcaauuuuuuugccaguauuucauugcuuuuauggagagcaauuuuuuugguauuaacuuuuuuuuuaauuuuaaauuuuuguggacacagguauauagagcacuuuuuaaauugaugcauuguaauuguacauauuuaugggguacaauuuaauauuucgcuagagauauauguuauguaaugaucaaaucaggguauuuagcauagccaucaccucauguauuuaccauuucuuugugguaagaacauucaaaagcuucucuuuuagcuguuuuguaauauaccauaucuuacuguuaaccaucaucauccuacuaugcaauagaacaucagaauuuauuccuccuauguaauuauaacuuuauaccuguugauuaaccucucccccuucgucuccucccuuuucuccuccccagugucugguaacaacuacucuacucucugcuucuaugaugucaauucuuuacucugucauuuccacugauguccuucuauaucuuuguauuuuaaacguaccuauaucaguacaugggagauagaucucuuauagacacccuguaguuuguaauaucuaucuuuuaauuggauuguuagaccauuuacauuuaaugucauuauugauauguuuggaucuauaucuaucauuuuaugaucuguuuucuguuuuuuccuuucuguuucucauuccucuuuuucucuuuuccuguuuuccuuuggguuauuugaacauuuuuuauuauuccuuuuuauuuuuuuggcuauaucucuuuguauuuuuuuuuuaguguuuuuaguuuuuagugcucuaggggauugccauauacacacuuuacuuuucacagucuucuuacaauuuuuuuuuuuuuuuugagauggagucucgcucugucacccaggcuagagugcaguggcacgaucuuggcucacuacaaccucugccucccagguucuccugucagccucccgaguagcugugauuacaggcaugugccaccaugccuggcuaauuuuuuuuguaguuuuuuaguacauauggggugucaccauguuggcuaggcugcucuugagcuccugaccucaagugaucugcccgccucauccucccaaagcacugagguuacaggugucagccacugugccuggacagucuucuuacaauuuguauuuaaccugaaugcagaaaucuucuauuauguaaguccccuuuccaucccccuuuuauauuguauaauaguuguuuuauaugaauauauugcaaaaucccaucagaaauuauuauguuuguauuuaaugguaaaacauuuuaaagaccucaaggccguuauagacuauuuuauuuauuuggauauuugucuuuucuguugcucuuucuuuaguucuuauuuucagauuuuccuucugauaucauuuuccuacuauaugaagaacuuccuuuagagcauuucaguggcuaugaauucucuuaguuuucaauuauauggaaauguuuuucuuuuuaauuucaucuucauuucugaaagauauuucacuggauacagaauucuggguuaguaguuuuuuuugucaucacuuuaauaaugugccacuucuuucuugcuucugugguuucuuaugaagaauccacagucauucaaauuguuauucuccuguaaguaauaugacauuuuuccagccaguuuuuuuuuuuuuuuuuuuuuuuuuuuuuuuuuuuuuugagacggagucuugcucugucacccaggcuggagggcaauggcgugaucuuggcuuacugcaaccucugccuccugaguucaagcgaaucuccugccucagccuccugaguagcugggauuacaggcacccgccaccacaccuggcuaauuuuuguauuuuuaguagagaccggguuucgccauaucggccaggcuggucuugaacuccuggccucaggugauccgccugccucagccucccaaagugcugggauuacaagcaugagccaccaugccaggcuguuuaguuccuuuuaugccaaguaauuuuauauguguucuggacauuuuguacauuauguuaugaggcucugggucuuguuucuagucugugguaauuaguuuaauuucaucuuuuaaacacauauaaauguuuggcauaugauauaguagucccuccuuauccauggacaugcauucaagaccccuaguggaugccugaaaucucaagucuuaguucagucaaauaguacugaacccuguauaugcuauauuuuuccuauacaugcacaucuaugaucaguuuuaauuuauacgcagggcacagugagagauuaucaacaauagccuaauaauaaaauagaauacaaugauauacuguucaguuucacagauagauuuguccuuaccauagaucuuagcaaccucagcauaugauuuuuuucucuuuccuuauuaagaacuuucaccuuuucacuuaaaggaagcacuuucugacuccucuuuggcauaugugaauugccagcaccacuauucuugcacuuuagagccauugguaaguaaaauaaagguuacaugaauacaaggcacugugauacugugacaguggaucugauaacugagagacuaagugauuaacgggugaguaguauauacaguguggauaugcugggcaaaggaaugauucguaucccaggugggaugcagcaagacagugugagauuucaucacgcuacucagaacaguauugcaauuuaaaacuuaugaauuguuuauuucuggaauuuuuuguuuaauauuuucagauugugguugacugcaggaaacagaccacagauagcaaaacugcacauaagggugagggggacuacuguauuuaugcaugcccuuuagaaagguaaaaaugcauagacucugcaguauaccguuaucuguuuucugggucaagugaugccaauucaacgaugacucuucaaucaaaccaaagcaaucuauuucaacacaaugauuuugacugugagugacaauuauaggauuauuaauacuuuauuuguaauauguuuuccuagcaaugcaaaauuccagggucaaaaauucuauauuuuccugaaaguuuuaucaccaagcaacaaauguuucuuuggcuucugcucgcuauuugucuaccauaauuuucaggcccaugauggauauaaagaugaauaaugccuacacuagguauuauuaccuuuuguuauguggaugagggagcugaggcccagucagacguuacucaccuaguaagugguagaaccaggccuccauuucaaguguuccgaauauauauguaucucuauagccccagcuuaccucuaucaaguacauaaucugagacaaaaggaaauaaauauuucaacaguuugaagaguuugaacagaacuauucaugugccaguauucccaaauuauagauaaaauugacuguguaaagauugugacacuguugcuccuuacuuuuauggaccacuuaagaaugugccaggauuauacagaaauugaaaguauuaauaauuggcuauaguauuuaccaaaguucuuuuuccuucugauggcaucaaaaagcuaauuagucaauggagugcauaugucauuggcuggugacuuuuguaauaauuaguguacauuuaugcuuccaaaacaagcuauuuugagguuaccuuugaucauuaacuuaccuucauuguucauucaccagguguugaaaaaaaugauucuguugaaaauguugcuauacagguguguggcuagaaagaucacuuuguauacacuugaagacuuucauccuuuggcuuuucggcacaaccccuuuuguggaacuuuaagaaaugcauggagcucuugcuaugugcuggccauuggacuaaguuucuggcauauguuuccucagucauaccuuugaacacagucaguuugagauccuagugcuagauggccaaaucacacucuuguacuaucucccaucuaccagcuauuugcuccucugucuuuuuugcuuaucacuuuucaggcugcccagcaccuuugagagcccuugcuagccagacaugauuacucuuuugcugcuagcuuaggauaguuaguguauucuuucugugaaagaaaguacgugagaguaucagguucaagcuaggugcccugauucauaauuuuuguauggacuuccucccauuuucucuacccaaacuuauggcccaacuggcugcucugauuugugguguuuguauauuucuuuaucucagucuuaccucuucggcuuccugagcuucuaauugugcuaacucuaacuacuaggauggucuuaccaaaccuccuaguuccaaaaucaucugguaacucaaauuuuacugccacucaaagucccagcaugacauuuucuugaaaacaaagcaucccauuucugauugcuccacaccaggcugaacugccugcuucuguugcccacagcuaaacugcaucaucuaauguuaugaucacuaauauugcacuaauuugcaagaaaaaaugcauuagcagcacuaguagaaaaaucaaaucaaaauugacuguauaagauauguaucucaugcugcccuuugcauucuuguuacaacuuucauucuuguccuuaggguuggaacauuuauuucucuucaguuacauauauuaucauggugacaguguuaacaaauguggugugaaaaaaaugagguuuccauguuugguuucuaagcauuuccugaccaggcaucuaaguuauuauuggcuuccucauugucagugggauuauacaguucuguuaugguuagcuauguggcccaaacuuuauuucuuagugaccggagagacaaugaagauaauaguucagguuuagguuagacugaaaggacuguagugugauugaaguaaugguaagaauagauuuuggaaccauauagauuaugguuugaaucuagauucuaccauuaaccauguauaaccuugagcaaguuuacuuaaacucacugaaccucaguuucauuaucuuuaaaauggagauaacaaacucacaggauuguugugaagaucaaaugugauauuguuuauagcacacuugucacuuagccugcuauugauuuacagagaggcuaaguaacuugcccaagguuauauugcugguaaguggcagaguucagucuggaauccaagucugcuugauuucaaagacccauguuuauucuacuguguuuuguuuuguuuucccauuuauaaggcauuugaucuguuauuacuuagaaauauagaugcuuaguacuggaaggaacucaaaugucaucuauuauaccacugaucagauauucaaguuuccuucacagcauaucucacaaagcccugccaagauucaagcuauucuugagcaccuuaguuugucuauacuuugcauaauuuuugcugauauuguacucuaugucaaagauugcugucauuuaaagugucuaaccauguuuauauuauguuggacaggacaccaguagaagggaagggacugucaggaaguaugcaaguagaaugggagucuaguuuaaugagaagccccugacgccguaaguguugguagcagguuaaaaaaaaauccgcuuguucucacucacaggugggaauugaacaaugagaacacauggacacaggaaggggaacaucacacucuggggacuguugugggguggggggaggggggagggauagcauuaggauauauaccuaaugcuaaaugaugaguuaaugggugcagcacaccagcauggcacauguauacauauguaacuaaccugcacauugcgcacauguacccuaaaacuuaaaguauaauaauaauaaaauuaaaaaaaauccaucaguagagaaaaaucaccaaaagggucuccagucuaggauucuccugaacugauuucauccuaacuuuccauguuaugauaaacauaacauggaaacauaacaugguuuggggucauggcacagcaguuucagaaauaacugcuuugaccugcacccacuuuuauuuuuacugaaauagggaaucuucucagauucccacagggacuggguagccguucauugccauagugcagacagcuauaacuuuacaacuugcucagaguuuauauggccuaccacucuauugggcuuguuaaacuggguaauuugcuuuuuagcuuauuauaacacauauucuauucugggggacaaccaaucuauugcacuuuucauuaccuguuguucaauaacaacaccuaaggaauucaggguguuuggugcuggaguccugcuuuaaauccuuaucauuuggauuacacagcugaucagugcucugacuucuaauaguuagacuaacucuggaaacaccuagcugcuuuuagaccaaugugcaaggguggguggcucuccauucucagcucauuucaauuccuuaucucagggagagggccaugcagucuuuuuggaugucguaauuuuaaaccacuuggaauaauauucuccuuugcuuuaauguuauacaucccugugcauguucuucaguaauugaaagggauaucgggcaaauuugaucugucuagcuuugacuuaugcuguccuuaucuuggccuuugugucauuaagaaaaaaauugguauugaucuuggaccauaccacuacauugugcugcaauuuuucuuccuugcuaguggaauauaaaucgauaaaaggcagcugcuuuacacgaaggccagauauggugccgucauuuauauauuguaaauccaaugauagcugaucaaaucagugccucuccuguuccaaacuugacaugauugaauugucaauagaaaagauuuuacaguaagagaaggaaagcugacaguguaaaugucugaaaacccaaugaagcucaauauaaaauaaaacaaugagcuaggauaucauuuuauaauuuccaauggggaaaaaaaguguuuagugaaucacagcugaaauugggggugaucacagggagggggaagcaggaaugaaaagccagcuaacuugcauuauaauuuuugagaaaucugaaaugcaaauuugcagaugcaaauuuuaggaauuaugcaucauagucacugaguuguuuauuuacagaaaugguucaaauacucuccaucucuuuccuccuccauacacauaguuuuuagugauaauacccaguugcuggggagaaauaagccuaucuuuccccaggaguccugcugacuucuaguaaguggcuugggaacaaaucuuguagaacuuauccuugcauucuuaaagucaaucaguagagcacuaguuucauuuaaaagaucccuagaaggagucagguuuguuuuuguuuuuguuuuuguuugaagcugcagaacuuucucagauauauacaucuugcuucacauguggccaaccacacuucccuuaggaaaacuaaaaaacuaaaaaagcuguaccccuuaaaacuugaagaacuccugccaauuuuucaggauaccugauuugucuggcaucacuguaauacaaagaggguuagcaagcaaggaugcuggcuaagaacaaccucaaaagucuacacgcuagaagaaaaggucccaagagaaggugguaaaaaaaguaagaagggaagaagagaggagggauaaauccuagaggcaauggucauguacuagauauaugggggaaaacagaggauggcuuggaggagaauaaugguauuauacuagcaaaaaguggacagaggugagaucaguaaccaguuugcagcgaggugauacaaaaauagauguuaaaugaaguuuuagacaugucaacuuucgggguacaauggaaacugugcaauggaaaacugaaggcaagagccugaagauacaccuuuguuuuguuuaugggucccuaauuaaaccugugaacucaugccccagaaaauguaugcauguagaugcaugaaauuuugcaucacauuucagagggucaaugaugccccaaacccaccuacagcaccuuuaguacagugcaugugcaauaagcugaggguggagauauauagauuggagaguguaguucauggugggugucacaucaacuucuuugacuuccaggaucuugcucuuccuuguuccccuccuuccuuucugaucacuacuuuuccauuuuuuuuguuggcuccuacucuuuucccuguccagcaaaauuggguguuaaccaauaaucuagaguauucuuggcccuguuuuucuucucucugauuuuuauagagauucugugagcauuaaaugaaauaauacauguaauuugaacagcacaaucuuuggcuuguaaaaagcacuuaguaaaggguagccaugauaauaaauugagagcaauugauugagcuuuauaagaacuccacugucagaacaagagauuaaugaaguugguugaaugagacgaagaacaagccaucaagaacaaguuuugauaagcuucaaaaaaagagcaauauuaggucaggugcaguugcucacaccugucacccuagcacuuugggagaccaaggcaggaggaucccuugagaccaggaguuugagaccagccugggugacaaagugagaccuggucuuuauaaaaauguuuuuuuuacuagccaggcaugguggcacguucagcuguagucccagcuacuuggaaggcugaggugggaggacugcuugagccuaagagguaagggcugcagugagcuaugauuguaccaaugcccugcagccugggugacagaaggagaucccaucucaaaaaauaaauaaauacaauaaaaagugcaauauuggagaagcuuccugggagaagagcacaucacagaaggagagagagaggauggucagugguguaaugugccaccuccacagggaggagaauaaugcugaauuucauuuauauuuaaagaugucuccaaaaauaugcuccaacaaccucagaauauaguuuucaagaugaaaacucagaaaccaagcaucucucagaagcuaauucucccuuaaucaggucccaugcauuuagaacaacuacugaggcaagaacgucaugcaaacaaggcucugucugcuuuuaaaugaaacagcauucucuuaucaguucacagccuggucucucccuaugggaugucauaugcuucucaacauacaaauaaguaccaugcucuuauauuugcaaacagacaaaucaggucucuugaaaaauuggcaggaguucaaguuuuaaggaguacaacuuuuuaaguuuuuuuaguuuuuuuaguuuuccuaagggaagugugguuggccacaugugaagcaagauguauauaucugagaaaguucugcagcuucaaacaaaaacaaaaacaaaaacaaaccugacuccuucuagggaucuuuuaaaugaaacuagugcucuacugauugacuuuaagaaugcaaggauaaguucuacaagaucuguucccaagccacuuacuagaagucagcaggacuccuggggaaagauaggcuuauuucuccccagcaacuggguauuaucacuaaaaacuauguguauggaggaggaaagagauggagaguauuugaaccauuucuguaaauaaacaacucagugacuaugaugcauaauuccuaaaauuugcaucugcaaauuugcauuucagauuucucaaaaauuauaaugcaaguuagcuggcuuuucauuccugcuucccccucccugugaucacccccaauuucagcugugauucacuaaacacuuuuuuuccccauuggaaauuauaaaaugauauccuaacucauuguucuauuuuauauugagcuucauuggguuuucagacauuuacacugucagcuuuccuucucuuacuguaaaaucuuuucuauugacaauucaaucaugucaaguuuggaacaggagaggcacugauuugaucagcuaucauuggauuuacaauauauaaugccacaagagugggucacgcacaguggcucaugccuguaaucccagcgcuuugggaggccgaggcagguggaucaccugaggucaggaguucaagaccagccugaccaacauggugaaaccccgucucuacuaaaaauacaaaaauuagcugggcguggugguguaugccuguaaacccagcuacuugggaggcugaggcaggagaaucacuugguccugggaggcggagguugcagugagccgagaucacgccauugcacuccagccugggcaauagagugagacuccaucucaauaauaauaauaauaauaacaauaaaaauucaaaaauagugaacucucuaagucccuuccaacacugacauccuaggauuuugaucucugauuuugacagaauguagcaucucaaacaaggcuuacaaggguuacaugcuguccuuaauugaaacuguuugucucuccuagugagcagacaagccucaguuuucggaaaccacaucagcagauuucauuccaggguggggaacuauuucugacaaggagccccgcaaaguaugugugcuucagagaaaagggaaaacugaguaaacaaauacucccuuugcugaagggggauguggguugaaaaucauauuauagaggagguauccuggaguguccugaguaacuagccaaaaauuugaucugguuucucuuagcaugggguaacucaccaugccaacugacauauuucuccagugaccucgacauccgaaaguguccccugaaagcacagcugucuguucuccaugcuucaagccucacuauuuucccuaauagccugcaagaugccauucugcagauguuucuucgacauuucuuaacacaagggcauauuaggcuccuuuacauuucugacguuuguacgauugaaauccccuccuggaaauccgggguugcuuuuauaugaugcaggccauccaugcuugagaagcuggggccuugcagagcagcaucuuaaugccauucacccaccauuuccaccaacugcccaaaucugggucuacauuaaguugcaauuugcuuucucaggauauucuagugagcagaguggaaagaagaaacauuggcauguccuccagaauuuuaacuaaccagagggcugucugcugaugggugcuccgugcaccacuagcuccaaaccuuuacuaauuaugcaaacucaucaggaaugucaccugauguucuuccauuuaaugagugguugugcaccacacuucauucauucugcaucagaauuauugacaugauauugacauucaagggcaagcugguuuucuaaugcuugccagagaaucaaaguuuuuuuauuuccuaacuuuaccuauccuuucagaaaaccugagaaugucauugauacuuaaugcugcauauaguguuuccaccaauaauacuucccccagagguuagucuucggaguacauaggacaggguaauuaggucuauugaucuuugcuacagccaguguuaucggaauggugaucaacuuuauaaauaagacguggauauucauuuuagcuaaggggcuacgacaacucuuguuucuuggacauucuuugcccuaacagaagcauggcuaagcagcuaucaggacauccugaagagcuggaagcccucuuuuguaggccuaguguuaggggccagaauagguaggcacuugcugugccaagaaggggaaaaccuuaaacuuaaauagauuuggcccauggggcaagauuuguaaagucaaaaacucugucaggagcucccaccccugccaucuaaauugccaagugaauucucagaaagagaguuucucagguaaaauguucagcauagaacccuucucaggaggcuuuucuuucacuucaccaaggcauagaguggggcaaguaauagcuuagcuugcagcuggagagaagccuuaaacagguagcacugacaauuguacuggaaccuagaucaacaucuaccuagacccagagagucugggcacugggaaggauuguuuucuggauugucugguguauaauuccuacagucaaaggauuugagcuuugcugagccagagagaggcucacagggagccaggacaccuuguguuuaucacauuuaguagccacccugagcucuuuucuauuuggguucccaaagagagcuccuuuuaagaaaacaggcacacauauucaaacgucguagauuuaguucuuugccuggccggaauaggguggguggagggguuggagauuaaacugucaggcaggcauacagccaaggaagcaagaguccaguuacaagagaaaucugaguaaggcccuaggcagcaagaucaauucacagugaagccaggaagaucuggacugaggucuccuuauuccuccucaccuguucccccucccaguuuucuauagggcuuauggaaaucauggcuacugcuuucagaacacaucuguauaucuguauacauagccugaaucaacugcagugacauccacacacauucgaguuuaaauauuaacagcaauuuguuucucauguggcuuugaaauuuuaaaaguagauccuucugacuagaaugguaaauguuuuugagacuagaucugucugucaggcaccucuucaccagaguauuuaaauauuuuuauaugaugaaguccuuuagacccauuuauaucagucuccagcuugaaaaauaauuaaaauacuuagguuuagauaaagguucaauaaaauuuuguccaaauaacaugaauguuuguugaaguuugggacuacuuuauuaguuuaaauaugucuuugggucuucacaauaguuugcuguagcccuuuucagucccagaaaaagaggauaucaauuuugcaccacuguuugcaacaaaaucuccuuuccuuauuugguuuuuaacuaauacuuuuuguaggacuucuauauuuuaacuaggucuagauacuugucuaagaauuucuuuuaaguagcccccaaguuaaagaaguuauuuaaaccugagauuuucaagacaaguuuaaacuagcagucuaacucuguaauuagucuggugggaauugucuguggagaccugagggcagauuuugaccuacaugagcagcuuuguugauuauguggcuuuaaaauggcuaguuuucagaauuagacauuuuucucucaguuuaauuuaugcaaguugaccuacugugugcaaaugauguuugaugacaaaagagagugagucacacuuaggcagcaacaucagugcccauuaagcagaauauaaauaacugucucuagauaugcaauagagauuuaaaauggucccauggaagcugaauuacauaggagaguuuccugugcaauuauucugaaacaaacagaaaacaagcaaaaaacccaaaaaccaaaaaccgaaaaacaaaaaacaaaacaaaacaaaaaaacaaaaaacagcccccaccaauuucaguugggacaguccuuauaucucuuuagucaaacaguugaaucucaacuaugugcuccccuacucaaccuuguuucuuauuucacuguuuguauagcuccuuccucccaccuucccuccuccuuuucuuccuuccuuaaggaaugaagcucuguaauuuuaaguacguuagcuagagagauguaauuaacuagagcuguauaccaaaguacaaaacuuacauuuagaagugacucacagauagagugacaauauaaauuauuguccaaacaaggauacuuuugagagugaaaggaagugcuaaaaauaacuaacagguuaguugcucugcaagguauaaaccaagccuguagcaggcuaaucaggauguauggucacccuauucacacagacgauuaggaugcuaagguggaagaggcuucagaaagcaucuaguguucccuccuuugaaagaggaaacggagacugaaccaguaaugccugguucugauuuaggucuucuaucuucuaggccaggccucuuucuuuuuuuuuuuuuuuuuuugagacggagucuugcucuaucacccgccucccggguucaugccauucuccugccucagccacccgaguagcugggacuacaggcgcccgccaauaugcccggcuaauuuuuuguauuuuuaguagagacgggguuucgcucuguuagccaggauggucucaaucuccugaccucgugauccacccgccucggccucccaaagugcugggauuacaagcgugagccacugcacccaggcgccaggccucuuucaacuacuucccgugccucacuucucuaccaagauggaaguacauauagcguggacucacuucguuuuuguaguuuuuccucacuguccaaugaauaacuuuuagacaugaaacauuucagaugucagaaucccaggcuccucuucccuccaaaucagugcuucacaauuaagcagcuacacugauacuugcagaacucccacuguuaacucauuuuuggucuuucccccacuuuucuguaauuuaggaaggaugacgaauucacaaaacccaagccaauuagauauuauagaaagauucagauaaucuggauucaaaaauauuuuuccuuuuaaaauucaaaaccagugaauccuuaauugauuucaaggcagacuuuucagacuagccauacuuaaguggucaucugcuaaccaacaagguuagacaauggaguacaguuucuccuucgauaaugaacuugagcuuguacuucugggugagagaugagaaugaguaaaacucucagcugugacugacuuuuguuuugaaacugaacagaauguaccugaaauaaaaugggccggaaacugguauuaaguuuauaaauauaaugcucacugucucauauuuuuauuauccugugugucuucuuucaucucuguucacacacuagguuugcuugcccuggugauagacaggcagcaugaugauucccucauuaaugaaaaggauggguucugaaaacacacuuuguuguuagaaacuuuauuaccaguaguagagaugacagagaaaacauacagaugaguuuuaggacacagggaaacaaggacucgcagaauaaaaauacugucagauccuaauggaaauauggaugugacugauacagggcccuuaauguugaggucaauaucucacuccccuuuuauguauagcucaauaaucauuuguugacugaauagcauugcuggaugccgccauugauucugcaggccaaugugaguucuuccuuucauuugucuaaugacucugaguaggaggauguucuguggccaacaguaacacuguuggugguuguuuuaccagagacuggaaauuggauuacaaggaucaacuaggagucugggaagcugcaacaaggaucaacuaggaggcugggaaggaugagagguggaaguaucucuagcucuuucucacuguccucccugcuuuucuucuuccuaguggguccuuauagugaauugaucacccugauacuuuuccccuccucuccaaauaaaccuggaugucuaggcaaacuagacauuuggcuuaacaaguuaugaauuuuaacaaaugauuuaaaaggaauaccaacauaacuaacuucauuguaagugaacuuccuagaaaggaggcauacaaaauugcauaaauauagcuguggauuggucaauuauuuuuuucccugagucauuucuuucugcacuccucauauuccucuugcacacuucguauaguugauguuuuaccauuuggcccuuauuuugguucacuucuucuccuuauucacauaugcuuaacaguuuuucuccauugucugucucuuuuccacaccguugaucuuauaacaaggauaugaauaggaaaaagagaauaacuugaaagauggguuaaaaacaacuuuucuaaugcauuuggaacaugccuaugucuauauaugugucuuguccuuguauuugagaauaccuaaagccaaaacugucuuuuuauuaugugugaaauuucauuuugugcauuaugcauuguuugugggggaagauguacaagaaacuguagguggugggauuauacauuuucaaaguuagaacagguauuuguuuguuuucuguuuuuuuuuuuaaauacucauguccugggcacuuuaaauacauuaucucauuuaauucucacaaaaaucucaugaagaugugguaucuugcucauagucucacagcuaguaagugguagaaguggaauuggaaugcagauuugucuggcuccaaagcuccagacuuuuuccaugacaccauacugcuucaaaaugugaauaauucugggucuucuacuuccugauauuauagcauauaaggaccaggcauauuuccccacugagcucaguguucuuauauugaauuucuuuauaucucaaagucuguugaauaguuuuucuauuuagaaagcauucuaagcuuugaguuguauuuugggaugggauaaccccccauuuuauuuccccaagacauauggaguucuuugaaaaaaucaaacugucauuugagacuaagaaggaaaggaaagucagaguguguuaaauuucccuuugucucaagggcaugguuuucauuaaguucuuugccuuuuuuguagggaacaacccugugggccuggguguauguuuaauguuugcuuuuauguggaccuggucuucuuccuauucucaggguccugucaugauugcuucguaauaguguacccaagucauggugaugucacuguagugccuuagccuuuggcauuuggccaguauuguuaacagcguugucuuauguuuauucugauguugcuuugguccagcagaaaugcaugggaggcagggaagcuggagaugacacugcacuggaacagugguucuucaacuugaucuuccuuccaaauccucuggagggcuugguaaaacacagauuucuaggccuuaccccauauuuucugauuugguaggucuaggcugaggccaagcaauguacauuucuaacaggcucccaggugaugcugaugcugcugacccagagacuacucuuuggggaucacggcaguagagaaugaagggaaauuagcuuuaccacuugauauuauuuuuuugcagauuuguacaucucuugagcacagugccuggccacauaauaagugcucaaugcaugucagugcugcuuauuuugguguguauacagugauacuuauucacuguacuuuucccuuugccagccuuuucuagucuagaaagaguuaccuguacaagagcacuuaacagcauuugccugguuuggcaaacucacccucuagagacucauauuucuuucuuugucuuaugccugugauucaggcagcugugucagguucauaccauuuuguucccccuggugucuuaguccauuuguguuacuauaaaggaauaccugagacugaguaauuuauaaagaaaagacauuuguuuggcuuauaguucugcagguuauacaagaaacauggugccagcaucugcuucuggugaggaccucaggaagcuuccacugguggaaggugaaggagaacaggcaucauauggucagaggggaaggaagagaagagagaggguggugccagacucuuuucaacaaucagcucucucaaaaacuaauagagugagaacucacucauuacugugaggaugggaucaagccauucaugagagaucuaccccccaugacucaaacaccucccaccaggccccaccucuaacacuggggauccaauuucaacaugagauguggaggggauaaauauccaaacucuaucaccuggucuugaugaucugagaacaugcaguaggaugcuuuuuuucacucguuuauccuuucuuugcuguaagugaacccucagaauuccuuuaaaauaggcgaucuuggccgggugcgguggcucacgccuguaaucccagcacuuugggaggccgagguggauggaucaugaggucaggagaucgagaucauccuggcuaacgcggugaaaccccgucucuacuaaaaauacaaaaaauuagccgggcgugguggugggcgccuguagucccagcuacucgggaggcugaggcaggagaaugacaugaacccgggaggcggaacuugcagugagccaagauugcaccacugcacuccagccugggcgacagagaaagacagaaagacucugucucaaaaaaauaaauaaauaaauaaaauaaaacaaauaaauaaauaaauaaauaaauuaaaauaggugaucucaauuucaacaaauugccuauuaucuuguuuuuugaaaucugcauaauuuacugagguauaaacaaaagcauagaucaggaugcuaaaucaagaccaguuuuuucuucaggcuuguacagcauacaacuuucuaacuuaauuugaagacuuacuuagaguaacacaucaaaugaagaguguucugcuuuggucacuguucuguuaccuugacuuuaucuucacucccaagauaggcccaaagaauucuaauuuagagauaaaauuuuaaguuuuuugugaucuuaucacuuccaguuacaucugacaauagucucugugucucuuuucugucugugucuuauugcaaaagcagagagggaaauaacauuauuaugggucuugguuuaaccacaacaguaacaaugaaaacaagguagaaaaccuuguacauucugcucuuguuucauauagcauagagcaccacagguauuuugcuaaguuguacuaagugccagauaauugcucuucaauggcaugaaguaauuuacuuuccuuaauuccagaggaucagguuuuguauuuuccacauauaacuggcuacuaaauauaguguacucuuucccugggauauacuucuuaaaauguuagguugcaccacauaaaauuguuaauuuuccuuuuuucaucagugaaaauggcuauuuguuaugguucgaucaaauacuuuuaaacaauacaguuuuuaaauggaaauauaaagugauucuuuaagguacuugacgaugaugaugauaaggaugauaaggauaauagcuagcauuuauacagggccugcuaugugccauauacuuuauaugugauuccucauuaacucaucucaacaaccuuaggagguagguacuguuaauacuauucauauccucuuuauaaaggaaaacacugaaucuuagaaagguuaaggaacuuggucaaagucauacacguuaauuagcaaagcugagauucuaaccuaagucuagcugauuccaaacuugggcuuuuuucaacuguaucaccauugucauguuguaauucaguauagggaauuguguaugguaaggcauaggaggcagcauucacugaugaccacauucaaagguaagcucccuuccauucagcucuaacuuuggcauagaacuugaccucauauuccacugucccccaguccuaggcugccccugcucccuuuuacugguucaauuccuuuucugagacauucuggaagagggaguuccaggacacaaccuuuguuuucuaccuagugugagauggagaggaggauaauuagagggguggggagugggcugguguaaaucccuguagauaguccaguuuguggcauugccauaacuuucuguuugauuuuugcccacuuuauauauuucuuuuuuauuugcaagacaaaauaaucagauaauuaaacaaagucuacuacuucacuucuguucucauauacucaacacaacucaaggacgaauuuugacccagauaugccugcgucuguguaaccuggugaauaagaaguuucucugaaaaacuguugguggaauuuuccucugauggcaccagugauacuuuaaucaggaccuauuuuaaauggauaccauauaguaucuaaugguaauauuccaucucugcacagauauaauauaguauaccuauuagauuuuugugaauagagcagauauuugcuagggcucauuacuuuuauuuauuuuuacuauuuuuuuuaaccuccaucaccaccaccaccaccuaggauucauuacuuauaaaaaaaauauguagugugaagaaaaauggcaaaugcagagugguaaaguuuuauaacauauuuuugggucaauuuuuagaaauuauuuuuaaaagaagaggcauaagguagggauguuagaauucuaguuuguggaaaugcaagggaucuugacgugccucuuuuugaaauauuauguuaagaaaaacaacuugaaauuuagacuuaaagaaggaacagguuggagaguaaaagagaugaauuuaguguuuuggccuugguauauuugagaugcuucugagacacccuaugggcuugucuggagcucaaaaaaaaaaggucagggcuggggagagauugaggaaucuuccgaagagagcagagaugauacccuaggaugggaugaguuaguauagaugucuugaaacgguuaaagauacagauuccuuggguccugccuuuggagauucugauucagcacaucuggaauggggcucgauccccgccucuuccuuaacaagcuccccaggccauuccgauuugcagccagguuagcgcauuggcucaucuaucaacucaggucuuggcuguugcuuuguugccucuaaaggggaucauaaaaugugaaagauucuucuccuguucuuucaaaagaggguaguuuccaaaacaaagcaaguuugagagauauauuuugaggaaauauuugugaaaacaccagaaauaguggagccacuuccauuucaaucuucuggauuugauuuguuuguccauuaaaaaagggggggguaauuauuugugugucuguguguguguguguguguguguguguguguguggauuuaucucagacauugaaugggucauuuuuuucauauuuuccaaagucacauaaauaauaauaauuuuaaaaauucagagugcugggcuaauuuuacuacauaaguagaauauacuuagcagcuauuaguggcuucuacacugaaauagaacccugcaguuaugaaaaucauaccugaaauuugagaaaaguuguuuuugcacaguaauauaggguaaaugauaacucugguagaaauagccuaaaugaaguucaauaaaugcuggacacuauuugagguugacuuuuggauuuuguuguaaggguuaucuccagaucuaaguguaaacucagaucacuccggucuuccugaaucagaccuauuuuucauuugagacagauggaaccaucaagaauuuuuccccuuugacuaugucuuggaagaacagggugccauuccuuucaggugcauuuaaacccaauccaaguagucaaacugaagaaugcagagagcaauggcuauuacaggccucaaagaguccgaauccuuugcaauggccaugaaccagucuugccuuuucagaugaucuauaagccuggaauaggacaguuuuggaccaugguagggaacuuggaaauguuaguuggucuaaauuccugguuauggaauuaaaacaaguuguaucuacuuuaguuauuaacuuaauccaguauuuuuguuuuggcuuaauccuauuagugucacauuuuacuuuuagaauaucuuccacuguuaccgggcgcacuggcucacgccuguaaucccagcacuuugggaggccagggugggcggaucacgaggucaggaguucaagaccacccugaccaacauggugaaaccccgucucuacuaaaaauacaaaaauuagcugggugugguggcgcaugccuguaaucccagcuacucaggaggcugaggcaggagaacugcuugaaccaggaccugggaggaggagguugcagugagccgagaucacaccauuguucuccagcaugggcaacaagagugaaacucugucucaaaaaaaaaaaaaaaaaaaaaaagaauaccuuccacuguaaccuugcauuuuuuuacacaucuccaagucuuuuacucauucucucauucucucugcugauguagacagauauuuuuauaucuggagcuggacacagucccuauuuucugggcaggaauucucauuagaugggaauacugggaagacuuuggaaugaucagucacuagugugugauguauagauuguuuauauugauaaaauguuauucuagcaucauuuagggggaaguucucagaacaguuuuauauguguuauucacuucuaacuagcccugugagauacggaggguaggacaagggucguugacauucagccuuccuguggaaucaggaagaggaggagugauggacaagagaauauauguauauggcuaugaaacaguuuugcaaaucugcaggcaggugaucaucauuaugaguuuucccauggggcaaaaauauuaagcacagucuugagaaccacacaguuuauacaaaacaguuugcaggcuggacugagucacagaguuggcucuuaauauguuguuguuguuguuguuguuguuguuguuaauauaaugucuccuccuaaaaugcuauuauuuuuuaugaacugaugggggaguauaugugaaugugcauacaaacuacagugccuugacuuuucucucaugauagagggcuuuugcauuuaauacugugcucauuuuauguaccauguuuaagauuagaguacaugaucccaugaaaugaugcuuguauccagaccuucaaaaaaguuaauuauucaucugcauguucuguuuguauugacucugauguuggggaaggaguuauaaggcuuggaauuuaugauuaagacuguuagaguuuauaauuaagugucuugggaauggcgaacagaaaugaagagggcaguaagguuuuguuuuuuucuuccccaggcccauuucuguuucucaguugcauuuucucacuaucuuuaaacacauacacaugugcaugugcacacacacacaccacuagaugguuaguucauucaugugcaauuaaacuuagaaugcagacuucauggagacaacacauaaaaaacaaaagcuuaagagaccuauuagugaaguucauuugagugccugagguauaaauaaucuuuacagccuugacaaaauguaucucuaaguguucuuuguuuaacugagauaugcugauacaugucuuguuguauuuuaguguucuugaccuuuuaauuaaaaucccuugaaaugaaaccuucaagagaugacauagauugcauugaauuuaccaaagauuggcauuuguuaagaauaauggcaguuugguuaacaguuuuuuaaaaacacacuugcuauuucuuuccauagaggaaggggaagaggugauuuuuuuccugcaugauuuuauaaaaugcguucgacuacauaaggccuuauugaauucauaagcaggaaggugcauguauaaacacauguuagcaagcauauccuaaugaaaaauaggacugugaaccuccauuuaccaagauagggaaggaaguaagcaacagcgccauugcuuaaaauacuuuccacugaaccugaccaaaaguagaaaauguauuucaaagagcaucucuggcugggaccaccugucuaucuaauuucuauggcuguuucagauggaaaguucuuggugguagaaauuucucguugaauaaaaagaaacccccuuugugaacucuguuaccacaauuaauuuucuuauaagguguuccuuaccagaaaguuucagaauucauugaucaauccuguguuuccuacuaacuuugauuacuagugcuuggauauccuaauucauuuacugggggugggauuuuuguuuauucuguuaguugcuuguaaaagaagaugucuuacaugaguagacuucaaaucaaagcagcagagauaguaucauugcagcuuagaguauuugaaauggacuagaugugcuugaacaaaagacuugccuaucucauuaaauggcuguuuaauacuuucccuggugaaagagguggaccucaauuugauuugguagucuuccucacacacauugguggucuucuuccaugaugcauuucaaucuaguugaacuccaaacagacuacuggcacuguuuuuuucucaaauuggacuuuccuaauguaugcagcucuaauggcucucucuaaacagucuuuccagaauguacuuaagaacuuuucuauuuuugcuuuuugaauuuguagcccgccguauuacuugcaaagccauucacaugugcuuuguuucuuucgcucuuuuaaaaaugacaacaaaaagcgauuucagaaaaaaaugagcccaaacagacuagauugacgguacucaucaaguuacuacccgucuccugacaccauaauaaccauauuucagaguugugcaugcuugaucguuacaacagaguagaugaaaucagauuuagaguggggcuuggaauucucugcucaaguccacagaaaucugaaagcccuaguuuguaaucucuaauaucuggucuagucuggaauucacaaaauauugcuuguucucuguguugaagaaauggacauuucugugauacauuuaguaaagcccuuuggcucuggggaauaaguggaugguggaggucagguaaagccaaaauagucuuccaaucacaugacaacauaauuauuuuuaucggacgcaaacgcugaauuuggcuauuugggcauguuuuaguuauugguuuuugcacugugucaguuuccccaaaggaaccaaucuuugggaagccaaagaaagaauggauugaagauaccacagaucaaauaaagugcaagguuaaucggucaucucuguucaaaagggugcugcaauucuagguaacuuuuuaugucagucagaaagcaggggcuuccuuccaaagucauucauguuccuuuuuguugacauauugacucaucaggacaccuggaaagcuguagagcuuauccuucuagacagguggcuaaaugaaggucuagaagaggauucuuuccaucuguagucucagacuuugaccuuuuagacuccagagguuauagcuaucugaagccccucuuaaguuaccauauguucucaagcaagaagaaugagagucacaauccuaucagagagaacuaugcugggcuugcaugugagugaagaaagaaguaucaaggagagcuucugggacaaggaaugccuaaacuguagcuuuaagggucaauaaaaauuuaucauguaaaaaacaggcagggaguacaaaaaagggaauuucaggcacagagaauaaacagcacguacaaaagcuauguagcacuguauacuagauuuagaaagaugaauaugauccaagcccugcccuuguagaccucacagucaauaggcuaccuauucugacuuccuuucccaguaauuaagauggcuuuguccugaugguggauuuaacuucaagccuuuggcccagagguagcuucaggacuuuuuuuugagacagggucuggcucugucacccaggcuggagugcuguggugcaauaauggcucacugcaaccucugccuccugggcucagaggauucucccaucucagccucccaaguaacugggacuacaggcaugcauuaccacuuccagcuaauuuuuguauuuuuuauagagacaauguuuuaccauguugcccaggcugguuucaaacacguggccucaagugauccugcugccuuggccucccaaagugcugagauuacaggcgugagccaccgugcccaguccaacuucaggaucgugcaacugugcagucacacaaagcccugcacucagaagcgcccagugcuugguuuaauguucugccauugccaucuuuuaaaauucuaaauauuuuuugaauaaggggaccacauuuuuauuuugcacgggacccuacaaguaaugaaggugguccugcugguguccaugcuacuuuaaugugcugacgugaggcaaaacacaaauguccacuacccuuucuaguacccuuuugucuucuacauaccaccccagcugugucccagugagggaaacuucagauagacuuauucuuacccaaguugauggggcuuaauagcuuucccuuccaaggacuauuugccuucuaaaagaagauagcaggcaaagggugcagugcucaaaggaaugcauuuaaggguggauguugaaaaacauaaaguguuuaucacaauuauagcagcaacagcagcaacaacauuugaacugagugcuuacaaagcugcuucucacauauuauuccacugucaaagcacaagcagucugaugguuucuguguuguauucauaaaagguaaaucaacaaguuagauggaugggguaaccucccuaaaacaagcauguuuauccugugacccacgggagacaagugcuuguacuuaguaucuagcagugucgguaucuagcaguguuggugguggcuguaccccauuccaucuuuccuugcuagcaucaauuaaggggaacauuuugaguacuaaagcauaaaaagaaggggagauuguaucaggcugaggggucccauucaucaugugggaauuuacuacauggacccaucuaagacagcugacauggaccugucucucaugaacaccaucaucacaccaucugccugaccagguccucuuuuaauuauuuacacucugaucuuuugggggaaggaaaacugguuugcucucuuauuuuagauagauaagcuuaaaaugaaauauaaaaucuuaauguguuacugagcccuaguugaauuuaaaauugaccuuuuuucacuuguguuaaagaagcauuguaagaagcgaugucuugaaguuuuugacaaacuugcacuguugagaaaagaguuaucaacuugagacuuuaggaaacuuauuauaauuuuucuucagaaagagagcauuuuuuuuucuuaacagcuuuggaggggguauugaaagaaggcugaagagaaagagaagaaauuagauuuaacaaucauuuaugcacuuuauuuuuuauuuucuaauuuuuuuuuugaggcagagucucacccugucauucagucuggaguacaguggcaugaucuuggcucacugcaacuuucgccuccuggguucaagcgauucuucugccucagccucccaagcagcugggacuacaggcacauaccaccacacucagcuaauuuuuuguauuuuuaguagagacaggguuucgacauguuggccaggcuggucucaaacuccugguuucaagugauccgccugccuuggccuccaaaauugcugguauuaccaguggagccaccgcacuuggcccauuuaugcacuuuagaaacaaaaccuaauaauacacuuguccccuagucuuuaaggaaucucagggggguagagcuggugaucagggagaauuccagagauggauaauaggaagaaguuguaguuuugugggcacaacaccagguucaagcaagcauggcagcauguaauaaauauggcagaagucuagucauccaaucaccucuagucuuucuauauacuggacauuguguucuguucuauagaaaaaagaugaauaaaauaaggucuuugcucuugaguucaaagucuagguggggagauagacauguccccagucaguacaaucugauugcggcugagaccaccggacugugguuaagagccuggauuccuaauccaagguuuggggguaggacuguaacagcagcagcaaggcaguccacaggagccaggguucuggccaagaaaccaagacagggacucaggcgagauacaguaucaagacagaggcagaacugcuggaauugacuaaaguauguaaaucacaaggaauuccaaaggcccaguuauugcaacuggguaaaaugucagagcaggacuagaagacuugauguugaggggugacuugaugcugagcacuguguauccuaggagcuuccuuagguuaggagauuaccaugagccuagguagggcugggguacuauggggaguaauaaguaggccucaucuguagucauucaagaaaauaguggcagugaaguugaguuaguuuaacuguaaaggcaaagcuaaaaaguucuaugauuucuaggagacuaaaaaaagaaaagguuauuucugacacuuuauaaauugcaccacuuaagcuguugguuaguuuggaccaauguguccucuaaaauccuuauuugaguggugaguccccaaguaauugaggcagagggugcuagagaaaccucaucuaaauaagcacagagcuaaucuaugggagcagagaauguuccagacuuagagaaggcugccuuuuaaguaguuucuguuuugagucucagauaagguauacccaauuucuaauuacugugcuuuaacugaaagccauuugucuucucccaguuccuccuuucuuaguguuacuguagccagggucuaacuugucaguacauuucucuucaggcacauuuagggauuugucauacaugguagaaagucauauuuuucaacugugguacuuuuaacucuaucagcauaggguugauuuuguacuuauacuucagcauacagaaaugaaauuucguugauguguguugaaaauggcucuuaugccaggcgcgguggcucacgccuguaaucccagcacuuugggaggccaaggcgggcagaucacgaggugaggagauugagaccauccuggcuaacacggugaaacuccgucucuacuaaaaauacaaaaaaauuagccgggcgugguggcggggccuguagucccagcuacucggcaggcugaggcaggagaauggcgugaacccgggaggcggagcuugcagugagccaagauugcgccacugcacuccagccugggggacaaagcgagacuccaucucaaaaaaaaaaaaaaaaaaaaggaaaaagaaaauggcucuuauagccuuuuaaauuuaaaagagauacaucuaaauuaguaaaauauuaaacugugaaaaaugacuguagucacugcccaugaagacuuuugcuccauggaauauacuauauugaugaugauuguuuacuuggagacucuuaugagagggccaguccaccauuuuuccuauuguagcaguucagggaaauagaguaggauucuaguacauaauaugcuuuucaaaagccucaagauaauuuauauuacuuguaacauaaccuuuaaaaaacagauuuugaguccauagguauuuagauacauacacaagauaguaaaguuguuuuacuguuuuuuuuucuuuugaagauuugaaugaaaaauuacacuucacugggugguuuucaugacaaucuaucuuaucggaccuaagccagguuuuugagaauagaagcuggaaauuuucucuugucucgccccaccuugaccaggcacugcaacaugaauuuggaauugggaccaugugugacccuuauccauuuauuuaauaucuaauccuagcaaagcguaagcagacucucugccuuuguaguuuuucauggcuaugaccacuuuaugugaauuaccacaaggggaagacauggucccugacaggcagauaaaggauagucuuuccaaaggacauuguuccugaaaaauagaauggcuuuuuaaauguuccuuguuucuuucgauuauaucaguuguuucugguuagaauagccauaugugucuuagcaauuuaguuuucaaaaacauuacaugauccacacaucagauacuuuucaguuggcauaucuuaggcugagaccaccauuuuuguugauuguugauacauagcgguucagugaaacaaaugcuucuaaagagccccuucugugucaggcucuaagguaaauacagagacacaaagaugagaaagacacaguccugacccucuagcgguucauaguccagugggcaagacaaauggacagauauuuucaacauauuuugauagacucagauagaaacauacaaaaugugccauuggagccaauacaaaaacauggucugugacuaauagaaucuauuuuuccccuugcuacucacuaaauagauuuuuuaaaaauucucccuucaacuagcauaggaagccacugacaucuucagccacuuaguagccaaccuguuaccauaaggaagugcauuuacaguggggauucuguugagaucaugugaggcgguugugaaggcacguuuacaaccccaauugaugguaguuacuuuuggucuuucucuuccuccccauggggaagaaacagacaaugaguagagaccagaggaggaaaaagaagcaccgcaaaaaaggaauagagaaccuaaaaggcacaaauagugcccccccacccaaagccaaaugugugccuuugaggcuaaaaaggugacugacccugguguuaacguuguauauuuucaauaagcuauauucagcugucuacuccuugaauuucuucuuagcaacuuaaacacaaacgaggccuccuuugugcucagggacauucucaagcacuuacguucuuuccuuggaauucacaggcccugcucuguucuguguuuuauugcucucagcuuauuuccuuuucucuugauuaaaaacuaaagccucuguagacaugauaaguuaaaaauggaacagacaccaagcauugcuuacugguguccacacccuggaccaggugaacugaauccagggcaauugggauaaaaacacuauaugggaucagccuuuugcacgucuuguucaaaggaaaaagaagugcuuuaaaggucuugcuuuuucaaauucucuguggaauuauuuugauaaguuuggagcuguuuauuuuuucuuucauucuguugucucuugugcagauggaagagaagccuccuauauuagcuuaguuuaagugaugcuaaaagggauacauuugccggcacuaucagggggcccaacugaaaaugaucaccucugacagcacaagauggaccagcucuuucuuuucaccuccugaggguuuaaacacucucaacuuuuuuauuaacaggaacuugcagggacaagccugcuaagcuuaucucauuccaaaugaacacuuuaauucaucaaaagcuuacagugaggcuaugcagguuuauagaagaaauaccauacaaaaggcucucagagguccaaggcagugaucugguucugaagcuagagauuguugguuuuacacacaaauauauaggcuauuagaauugugagcagccgugcaguuguggccugagggguugugugcaagauuggaguucauaaaaggaugucacccagggugcagaguuaggauauuucuggguuuggugacuuaggaaaaaauaugaggaaaaucuguuucgcuuuaaggguuggaguacacuuacuaagagcaucagagcauuuauuucacaaggggguauugucaaacuuaaaugcauacaucacaguagccaaaaccuaugccaucacaauaaaaauucauauuaaauguuuuuggauauucauuaagcccuuauauuucuuaauacaaauuauaugcauaugcccauacacauuaacuguaauggguuuuucuuuauauauuuucuugcacaccuuuaauacuauagcaagguguucaauuuuuggauuuaauuauacucuuuugaaaaacuccccaacuuauaauguguauagcguuuuaauuaaaaugcauuuccaccaagucacaaugauaaauuucuuggagcagcaaauaagcaacuuguaaugucagccuacuuugaugccaggaguuggcuuuuuuuuuuuauuucuauuuuuugguguuaauucagaauaaucauaaaccagaagauuaucauuaucauuuuauuacauuacucuaguuaaagagaauacaucaaaaggacgauuucauuaggcagcccuuugcauaauggccuuuuguuagaaggaaacguggcucccuccccuaguguguauagaacaacccaggacaauucuggcagcuggccauggaguccgucuuggcucuggcaagaacagaugguuuuggggucuguuguucacauuugauuuccauguuacaaauuuugaaugaagucuuuacugaacccuuuguccugcagucugcagcuccucacaucagggggcaguuaggcgccgguccugacaugccaauuugacaccauuuauccagaacuuggauuccccuuucuucuggcccucuacuggauggaagcaguaaguguggguauaccgcccucugguguccagcucggagaggugccgaaagcuggaguucugaacuccaggagcuuagggggaaacaaaugccugagccuucucucugguacuugggaggugccuguuugaaugccaaauccuuaucagaaaaggacccaaggugugaaugccaugguccauagucuuucaacucagggaaggaucuuggggcuuauccauuucaccaccuuccuugucucauucuauacccauuuauugagcaucuacuauguuuguaauuuuuaauucaacagauauuuauucacaccuacuaugugcuaggcacuguguccugaagcaaauaauauaacagugaaaaagauguacaaaaauccuugucuuaguggaacuuccauucauuuuggggugggguuggugaaaggccaggcuaacaagaaaauaaauaaauaaggcaaauuuaaauuuaugguaaguacuaugaagaaaaaguaacagcacuuugggaggcuggggugagugaaucccuugaggccaggaguuugagaccagccuggccaacaugacaaaacccugucuacuaaaaauacaaaaauuaaccagacaugguggcacaugucuguagucccagcuacucaggaggcugaguugggagaaucacuugaauguggcaggcagagguugcaguggcccgagauugugccacugcauuccagccuagguaacagagccaggcuaugucaaaaaaaaaaaaaagaaagaaagaaaagaaagagagagagggagggagggaggaaggaaggaaggaaggaaggaaggaaggaaggaaggaaggaaggaaggaaaagaaaaaggaaaaaggaaagcaggguggaguuagagagagaugcagguggggugacauuuuagauaggguggugaggauaagcuucugagugaggugagggaacagccauuuagaauguguuuaggucaggaaaacugaggucaggaaaaggggagagacauaccucaagucucauagcucuuugauaguagaaguaggacuagaaugcacacucccugauuccaaagccaauguucuuacuucugaguugcaucuaaguaagauaacagaaaaagauaauuauugagcugcuucuauguaucaggaaacagcuagacccuggaucagcaggggccacacaaacaugaaugauggugaguucccuguuuuaaaggagcuuaaugucuaaaugcaugugccuggcagguaucuuuugcgcagaaagucggcaucuaccugcacuaauggcacucuauugcucaaauaugacauugcagaccuguggugucugggacuagccaguugaguguuagguacccugugugcuaagggaugaguuuccggggaagcugcagcauuaggucacuugcuauccccucaaccacugccccagcagagucgcugcuccuuauaaucuccuggacucuguacuggccauggggagaggcuaucuuggcuugcuuugaaagaagucaagucaggagaacucuguggugagaaggucucuuuuauucacaaaguggugguggugaugcucaaagguaaucagguucagagacagggucaaagcacuaaugaacuggaacccucauccacaugguagaccagucacuuaggacagacugaggagaugcugccuuuguugaacccugccacacccacaccaucuuucaugcccuuggcucccccagcuuugaguagccaauucccauuccuuucauggagugauuuauacugugcucaggaucuuucuucagaagaaauaacugccuguccucauuuuuuuuuuaacauaaugguucagagauuggaugggagaauuucucuaguugaccuuuacagccugauuuucuucuuucuaaaaucuauuaucauauguagauaugguguuauaucugacagccuaauuguggacaggccuuuuaacaaacacaccaguaggcugcacagggguagaguggguaacugguuuagcauuuauuuaccucugauuuuucuacaacugaagauaauuuuuuaagucagcauuuuuggaguaaggaacuuugcagcaaaaaauguauucuuuugaaagauauguauauuucaucugcuacaauaaaauacccuuuucggucuccccccaacacagcaaaugaugcaugugacaaucaaaaaaugagaguuugaaaugaaaugugaugaauauaaucugaggucaacuuuuaggauggucugugugaaugucaucaaucuccagaggaaaugaucaccuccucuucccagagagagaaauguuccaaggggugggugggaggggaagaaauucuuccuuuaccucugguccuugccaauugccagaauuucuuugcuacauauucgucuuucucugggccuucaaauuguuucucauucucucucuccuucguccucucacucuuucucuuucucacucguaaaucagccagccugucuuuuuuuuuucuuguuuggcugauauccauuucuucuaugucauccagccaauugacuccucauuuaucaguuaacaacuaauugugcacugauuacccuagccuucucccagcuuuggcuggggaggaaccugcaauucacugaccucauuucauugcauaucuggcaucagcacuguuuuagaaauaagugauagccuuggggagcuaaaggaaagaaaaaaacaguaguuaaguaggaguuccccaaguuuucagcugacugagaauuuugcccuuuuggaaauccuuccacuaagugcucucugcucucguuuaccacuuuauuuggcaaaguugaaagauagcaaaaugauccauuugugaggaguuuaaauugauaauagauaauagcuuauauuugcacaguacuuuaaaagcauuuuuguaugugucuccuuuuucuccuguaacaacccugggagggauaugggaucaucccuguuugaugguggggcagcaaaauguaguugaaagcauugcagacucagaaucagaaaaccuggccucuuuuagucguccauagaggugacagguguccccuggagauccuggaaguagguuguuccaugacaauuaaacuuaagcaagaagcaauagaucaacgcagagagcugucucuggaagguauuaauauaaguuaaagcagugaugugucaaugagaauggagacuggagagaguaauagagcucacauugaagggccuguccaguucugucugaaggcaugggugucuaauaguucauuacauuacaaagacuugaugccauugcacauauagaugauuuaacuaacucacuggguaaugcuuccagguuugccagccaaccuucugauuauaauucaucuuuucauguaacuugucuauuggagggagaguguggccagagaaugugugaaucuaguccucuuaguaguaauauuuaauaccucaaaugaauacuuugguagucugguugcauaugaccgucucuugagaacuuacuuagcaugagucagaugaauacugggacacugucaaaaucaaauuuccuggugggcaaaacugaggaccaaauuacagacuauagaaaauuuaucaaagggaagccuccccugugaagccucauaguggcugccuggucugucagccuuccuuggugauauccuucauuaucaucacauauauguccuuuugaaccuccaaggauuccugcuuucauaggcuguguaaccuugggcaacucaguucuccucucugagccucagugucugcaugcuuagagugcuuuggaaacuauccaaaacuaaggugguaauauucugaagaaaaggaagaagaaacaaagaagaggaggaaaaggaagggggggaggaggaggagggcauaggaggaggaggggggaggaagaggaggaggaggagagggaggaggagggggagaugagaaggagaguuuuggcaucaaaagcaauuugcccaacaccauauauauagcugaugguagccaaaaguagcguggcaaccaucacuguauucuuuucuaccaguggagauauggagggcugagaaguggugaucuugugagauggggauagaaaggcaagaaaggggcaaccucuugaauagguaaggggugugugacugucaugucagaggugaaacagugaggcugaacucuaccugggaagaaaggguugaucauagaucauuggagaauucauaauagugagaaagcaucuaaucccacaacuggaucuuuuggugcugucuuaagggaucccacaaauagcucuuuaagcucaaguuuuuauaucucuccaccuucuaggucuuuuccuagagcccaggagcagaguuuucaccugaaauuuuuguuauauccucugucugguggcuaggucucuuuaccuaggaagcuggauaaggggaguuuauuaugaagcuaaugacauuugcuuuggaccacuacagauauuucuguaucauauauauacauacauauauauauauauauauauauauauauauauauaaaauaauaugauaucuuuauauuauauauuacguauauguauauaucauaaaacaucuuugaggguacacgcauauucaucuuuaauccccaggggcuaacacagugccuggcaauaauguuaaggaaagccuuaaucacugaccuauuauugaaugaaguuuucuuugagagugguugugucccaucuucuucauuccaaguucuguugaugaugagaguagaagagagagaguagccaaguguauuguaauugaacuaugggaugcucagaaaagcagaucauguaggucuacuuucacauuuuacagguguggacguggaagaccaggggauuaaagccacaucucaagguuguacaguuaauggcagagguggggccagaagcuagaucaguugaugaauaauuagaauagaacagaacagagcagaacagaacagaauagaaggaagugagcagauaacugacuucaccucuacuugguaacagccuggggccccugggggaccugccacucucuguuuaguccauucuauucaaaacuucuuucuguuggagggaaaggacuaguugaauuccuagggguucuucauuacuuguucaguguuccuccuuucuagaaccaacaccugauugcuagaagaaguaaagaccuucuacaacaauggggaaaaaaauccugaaaguuaaucauugcuucauauaaucaugggccuuggcauaggcccaccagaaccuaacuaguauccaggacuguuuccuuuagauggcuguugcuaaugagcgagagggaaaaaaauauaccuuccaauaucaggugaaugauaaacaauugugucagacuccucauuccuuugccauugauaaauguuagaggcucuaaucuucucuuucuggauaugauuucuugaggcuugaauaguaucauggacuggggauuagaauggcccaaguuuuucaagauuuaggaaauccuacagaaauagaauuguguugagaaccuacugcuuugugauuauuuucuauuacuauaaauaguauuaaaugucauguuauuauccaucaaaccugagaaaggagugaaauacccacagagaccugugauaauuuccuuguuuuuguucaccuaccagaccaacuaugugugcaguuauaaaauacuugacuuugaacuuuuuauuaggaaagauagauguuugauuguguuacagaauuuugcuccuuaguucaguuaaaaaucuggguucuugucacaugaccaggaaaauuuaggcacgcagacacauugaagggugaguagaucagaauuuuauugggcgaaaaggaaaaaaagaaaaaaaaacucagcaaaaugagauggaguccugcuaacaggcccccgaccucacagaucaaaucccaggccaccacacaggaacugaagaagccaggcucuuccccugcauaagcuaccauuccccauggcuccacucacuucucccagugcauaugucaggcuccagucugcugugggcaugcccagacaagcccugggcaaguucccucaucugcacaaaagcgucuaauacacacuuguggggcaggucggagauucuccggggaccccuuuuuaucugccuaggcauuuggcugucucaguuguguuuaaaaacccuaucgggguucuuucuuucuuccuuucuuuucuuuucuuucggcagaguuucgcucuugucacccaggcuggagugcaauggugcuaucucggcucacugcaaccuccgccucccagauucaagcacuucuccugccucggccucccgaguagcugggauuacaggugccugccaccacgcccagcuaauuuuuuucguauuuuuaguagagauagguuucgccauguuggccaggcuggucucgaacuccugaccucaggugauccacccaccucggccucccaaaguguugggauuacaggcgugagccacugcacccagccucacuuuauaaaauauauauucuuuauuuugacaggauuauguuuaagguagcuuuugaugagagacguuuaucuuuucuagaucuuuuguccccggugauuaguuguaaauuuuuauaaaucaaagaaaggucuuauugaucuauagguuuuauauuauacugugcaugaauagcuauugcuauauuacugaagagacugccauauagucaggguaaaacauugauuuucacggacuauaguauucuuugcagaaacaauacguugaacuuuaauuuccugagaaugucaacuugccuugcccgucaagaaauuaaucuguggcuagagcuuacugauauagcagucucaccuacuugauuagacaucaugucauuuuauuacaucgauaucuuucagaggcauugccaauacuuguauucagaaucccaucuuuccuuuugaugagguacacuuagcuccaauaaguaaacaaugaguaagugcaaaaaccaguaccuggcacacaauaggcauuuaaguuuagauauaauuuguugagaucuuacuaaugccuggcauaguacgaagcuauuuaucuguaucuauauuuauauugguaccugucugucuagcuaucuaccuacuuaucgaucucucauuuaguccucaaaauaaauccugugagauagguacuaucauuucccuuuuacaggcgagaaacugaggcugagaggucauauaacuuccccauagucacacacaccauaaccugcaaaaaguaguagagcuauggcuuggaaccuaguuuaccugacacucuagucuacucagguauacugcuuuucacaaacaggcuggaacuggcuuugagauacucagaucugcccugcuucugacaaacagcaaagaagaccccccacuuccccaaccaaaagagaaagagagaaucagaccugggguaaaagucugugcucaagcagugcuaucugucagcagcuauauacauccacaaguaaagcccccuaaggaaguuucuuccaagaaaguucccauccugguuuauucaaagaccugaauuuuaagugggaccaccucagcauuuccacugaucuguuuccugcaggggguaaaaaacacacacacaaauaaauaaaaaacaaaacccuaugcaaaaagaagugacuguccagaauaggcaaauccauagagaaagaaaguagaguagugguugccuagggccggcggggaggaaagagaggaaauggagagugacuguuacuguacacaggccuucuuuuggaagugaugaaaauguucuggaaucagaugguggugaugguugcacaucuuugugaauaugucaaaaccaaugaauuguacacuuugaaggagugaauuuuaugauaugccaauuauaugucaguuuuuaaagaaaugagggaucaugccccucuucuuuucuaacaauaacaauuuccuuacauucucuguguuacaaacagucugcuguuaaaggggagcgguccuagaaauggaaugucuguuuaaagcguccauguccuuggggguucacagugccauuuagggggaugccauuaguggccugugaccuuugacuuaagaacagugguaacuuugaaaucagcucugccgaggagcuggucaguaugggcuccuagauuccagaggggauuuucaauucccugauuacaaauuuccuaggaaaguaggagacccaguuuggguuucugccucucugcaugauacucagguaaaggcugggguuuuuccccuuuaggagaaaugugaauaguuaaaguguaacuucugcaaauaacuugauuuaucuugaagugcagcaauuugcuacacgugcguuuuucagaaagcacuaauaaauuccaggucagaaucauuuaaagcgccccacaaauugauagugaggucuuaaaaaggcgcagcagcuuuggaacguuaaauuuacuugcuguaaauuuggaauaagaacauaaagaaucacuuuccagcaagaugaugaaaauucaucauguucauuauguguuucuuuagaagcacacuacauuaauuuuccagcucaacuaaguggaggaaguaagguuucucguuacuaaagaguugcucugauguuuagagaggcgguccaguuucauuaaugaauccaaucuggucugacuugagauacugcuuaauguguccccaaaacucgaauauggauaagugucauacaaaucaacaucagguuuucuccuuuuaaaacaauggccagaagguauuuauaaaacuuaguuuuguuuuccaaggauucaaaugcaauagcuugcauucagcucuugauuuuuucaugguaaugagggagagcaaugguauggcuccucugaaaauaguaucucuuugcauuugacucugaagaaugugucagaaugaaagaaaggaaaauaaagaagucccacuggucagcaccuccuccuggaagcccucuucagacauuugucccacucuagggcaugcuggagaaugauaacaucaccucucagcccaaaggggcuuuugcuagcuagggggaaagcaaaaagugucuuccuguucaaaagccuucuugcucagcugcaggccaacauggagaagugaaaggagaagcaaggcaaucaugugcgucaacaucaaguguccugucaccuacuuuguuuaacuuggcuaauaggaacaugaaagcaaggucauuugcccgaggauaccugagauauacaggcccaucuuucuaggcccuguaaaacacacuuuccaucucaucuuaaagaaccucaaaaagcuuugcaaacuacacaguggucuagaauugcuugacaccuccugaaaugcaaccuauguugugacugguagcggcuguuaaauaacuccuagaaauucugcccggaaguucagaucagggauggggagguaguacuuuggguugcugugguuccagcaccuccagaccuuggaucccuagcucucuguuuggccugaucugcuugggcucuccugaccaagcugaguccuaggacaccugaaccuuggacaucuuuuuuggccugauaucuguugugaucacacaucccucucuguccacccccugccuacugaccccuugacaucuacccaacucugcuggccuaaugagcucucagaauuggccccugcuaaccugucuucuugcugccugagucaaaagcuuuggcagucuguuugcauagauguaauaccuauucuuguggcagaucucuaucuguaaccaugggaacuaggcacagacauuuauaugauaagcauccagucucucuauggucaucucuuguuugucaaugcuaguggagaggaguagagacauagguaaucugauagaaugggugauccaaaauucauuuguauuugaaguugaaauggacauacacacuucaucaggcagccauauauaaagagacugcucugagucugguucugacuucuguuuuauaguaaggugcuaggaacagagaaggaaagggacaugggaaaaaugaaaagaacaagaggaagggaaaaaggacagaaaggggauggaaauauagaauaggaaaugugaagagacacacugagaggugagugcuucuuugaguuaaaacagguggagugcugagugcuuccagagguaacugacuugcucuguuggccuugucuuuuccuuguguuccguaaaugcuaaccucagauuuacauuucuaucacagaguuucaggcuugauuacucuaagaagugcuucucagauagucaccuuucuauuacgcuuucuguagagaugaaauuuagcaacugguaauaauuacggugaaggucucaguccucagcagagaaugugaguuugcaggguagucacaaaugauguugcuuuggugcugggccagggguuuaggguuagcacucugucucccacagaggagauggaagggaaugccugggaucuucaauaaguagauucccucugguagcauucagagcuguuacuucucagagcaauugcuaguuugggaaugggcucucugaugagucacuguggucugcaugauuuguagaggucuuugcaaauggcagugcuuccaauccaaaagaaguuaugaauuucuguccucagaagugcugggaagauuaaagccccaggaacccaaaauaagcuguugagggcauaagagagauuggauuucacaccagacaguaaauuucuucaggaaaggaaucaugcccaauucucuuucagguuccuggcacccuuaguaccaugucuggcacagagcgggcacucacugaacacaggaguugaggcuaaacaaggaaggguaggaguggagacuaaaggguagcuuuggccauugcaacugcaggcuuugugcaguucccugacuuccaauuugccucuuccccaccuucccacuaggcaugcuuacaccuaguuucugcuucaucagccuuguucaaggcuuucagaaaaagaagucugcucuaauguaccccuucugccaaacuaucuggaguucaccuuugcaaagggaagucaauccaugaagauaguguugcaaguuguuuucucaguuuguagaaaaagugcuuuauuggucuccugacagacuggccuuaaagucauuccauagaguccccaguugcugcauuuugagccccgacaccuggcucagcucuagccucuguuauccuggcuguguagccugccagcugugacagucaccauauggccuggucucucacucuuccugccucagcauugacuaauguggcagaaaaacacucccauuacauuuuuguggaugaggcagacaaguggauuuacuuuugaagugaaggaaaugagacugagauuuccuucuagccuguguugccagagaacucuucaucagugaggcaguugggaaagaaaauauagagcuaccuuuguagauacagaggaucgauucagagagaaaaauaaugaaagaaauacagaauuaaaaagaaacaagaugcaaggguguaaugggggaggaaauacaauauccuacauacugagaacaucauuucugaaauaauuuucaauaaguuagugaaagcagugcaguuccacagggcuugggauaugagaaaaauaaaguaaauauuuggaauaagccaucauggagaaaggucucugaugaguugcuauucacucugacuagacuauaaugauacuaaacagaaauccuuuggcgccuccuauuugcaaguuuuuauugaggcacucaagaucaucguucucuuucccuuugggauaacagcaucccaagcagacuguacaggguuugauggaggaggugauguugcccauugaucuccuuuuacacuacuagcaauagagccugcuucauuccuaagcuaggcaccacauuucugaaggguggcugucacugagacugcagguccggcucugugaaagcagguugauagguaauuauauguucccaugaauuacuuucagagcuggguaauuaucaugaaacugaccagcuggaacucacaauuagcucagguccaggcuucccaggccaccagucauuaccuucgagucaggguaaucugggacacaaaucguuucuuuuaaauguuauaagacaggaaaacauuuaaaaugaggaauggcuaggcccucuagaaaacuaaaaucuguuauuaaaacaaaguauaaaagaaaauauuauaccuuuaaagaagccuguuugugagaggcacaaggaagaaaagggauacucugaaauaguuuuggcagggaaaauuucaaaauuuaauauaacuuaaaaauauuccuuaagauuaaagagaaacgagcuguaauauugaaugauuaggaagcuauaaccauuuuuucuagcuuccaaauagcuuucucucuaaucccacguuuauaagaacaaaaaaauuuugugacucuucauagcuuacaagaucaaaccuaaaccuccuagcauggcgucuaggucauuucccagccucgccccagccuacuuucagccucugcuuccauauggaccccauaaccauuucauuucauccauccauauggcauuuauagaaaggugccaugugcaagauacuucuagguguuuugugaucuaacgccacauuacuccaccuugguggggacuuuauuaguucaccaugcuccuauuugggccccauuuaaaaaaauuaugagguggugagugccugggcaaggauuguagcaauggcuuggggguggggauagucaggaccaggaugugguaggagaggggagaaaaacuuuaaauaacaaaaaugauggauaugacccaccuucuguuuuuuuuuuaauuucagugauuuuccaaacuccuaugaaucaucuaaacccaugcaagauaaaauuggcuaagcaagguguuauauauuaacacaauggaaugaacaucucauagcuacaugaaaauguggguaugaaauaaugcuauuaauaacaaugaacacugaaugagcuuauuauaugccagacaguguucuaaucauuuuguauauauuuuaucauguaacccugacaacagcccucuuagggcagguacaauuauuaucccgauuuuacagguagagaacccaaaguacaggaagguuaagugacuggcccaaggucacacaacuagcauguggaggaaccaggauuggaaagguuguguucugguuccagaguucauguucuuaacuacuguauuauaacugucucuguacaggaaaaagaacauaaaaaguacauaagcauagcuacccacauauaaauaccuuguuaaagacaauuugcagugaugcaaaugauuggauuuaauguuagauucauucuucuguaaagaagcuuaaauucauaagaagaggaaaagagugagaauaguuuagcgucaugggggucaagggaaagcaauuuaggaaggaaagugucaauggugucaaauguuaacugagccaggaauuaacuuaauaacuucaagcaagucacuuagccuccuuaguaauuguuuccucaucaguaaaauuuucuauugcuuuacagcuaccuuuugaagauuaaugagaugauguuaauaaaguccuugugauuuccuuugauaauacuuucucaaaauugcagaccauauuuuuagaggguaaaaaaacacuaaaggcagaaaauauguaaauuuuucaaguguugugcgauaaucuaaaguguuucauguccuucaacucugguugggguagcaacauaaccccaaaugucuugguauuugaagggaagaaucagccacgggcccuguacuguuauuauauucaaaccaagcucucagagucauccaggcagucccaggucaagaagacaaccugauauucccaguugagugucucuugcaugucuuuggcuaucauguuuaacuaaaucugaagugaccuuuuacauuuuugccaagagggagaucaugauaaugcuauaauagacuuuauguucaucuuggccagacauaacaguacuugaaaacuaucucaaauucucaguuguuuauaaugucuaauaaucacauugcuguuucaauucguaucaguugcucaguggguccauuacuaauuuuguuuccaaaauauuuaucuauaauggaaaaaauucuuuguaagaaucuauucugaugguuacauguaaguaacaacucaacuauaaacaaccaaagaagggggcugucugaggggccagguucuuucucuuuuauugcuucuuuuccauucugcuuuugaguuuuugguuugccuucuacagucuucauaaagaaaggguaacaagcaguucagauagcucgaguaaccaucccaauauaauucucucaagcuccaaugcauugcugaaauguucaagucucuccugcuuuugacccauguaauuuuugggggggaaauaauaaaucuucaguagcuaaugugugucaccacaagaugacugucuuuaguagugugcaacccuuuuuaaagcagggguuugagcaaguucaacagauaggucauuguguucuuuacaaaacaagguuuuauugcuaauugacuuuauaacuuguucuuauucaaggcaguucuaacauauuucuuccaggaggagagaaaguuggaugauggaaagaacaaaagaccggggcucaugaggcuuggguuuuaguuccugccucgucaguuuccucaucugugaauugacgagcuuugaucaucagagugcccagacuuggcucugcaucagauuugccuggggagcuuguuaaaauaaagauucuugugaccaaugccuagaaacucugaauugacaguucuaugguagggccuaagaaucuguauauuuaacaagcaccccaggagauucugacauaacagguuugcagaccaacaauaguuagaagucauugacuuagauuacuucuaaggccuuucagauuucaacauauguaauucuaguaucaaagauuccuaaucuaaacaauagaugaaaauaaacagaacugagauaagaggaaauguauauuaauaguuucaugaugggcuuuuguauucugaaaccagaauuugggguaucaggcacuacuagaagauguuggcaagguuguggguccagcaagugugcuggagucagaggucagacuucuaacuugagaaaaggaggugggcaccaugaagucauaauuucacaucaagaauuugggcuccagagguccagggaagauaagcaggcauaaauaggaacagaagccuaccauacaggaauugcuugagacuuagaauuaaaguaaaaagagaauaaagagaggguggagaccaagagaggaguggagaaagagggguugaaaccaggagaauaagaauaagaucucuguucuuggaauaccugugguccaugcauuaagaaagaaacgacgucuuugggaggucgaagcggacagaucaugaggucaggauuuugagaccagccuggccaacauagugaaaccccaucucuacuaaaaauacaaaaaauuagcugggcgugguggugggcaccuguaaucccagcuacuugggaggcugaggcaggagaaucacuugaaccugggagguggagguugcagugagcugagaucgcgccacugcacuccagcgcgggcgacaguguaagacuccaucucaaaaaaaaaaaaaaaaaaagaaaagaaaggacgugacuacuuccuugcuguacuaauuuuugaguauacucauugcuguaagagaaugagagcaaaguucguggacugugauuggaacagaagugucucuuaggucauaagguauuggggaugcaccugaccuaguauucuucugaccucuggauuaucacugucagggcuaugggaaauggcugugacuggaaaggaauaauagccagugugaacaaagacaggaagauggagguggaucucaaggagccugagauguccagcucaaaugacucagaaaauugauaacaaugaauaauaaacaauagugaaggaucuuggcaucaguggcugcauuuaauggagaggcucuucacuugauuuuccacauacagucaugaccuguauagguagguacauuuugccacuccaguugaaagugaguaaaaauaugggcaucacaguuuagcgaucucgaauacuagcagcaggccucacuguggaucuaugcguagacgagacagaccaaguagugcuggaaaaggggucugcgaagggcugagacauggggauuguuuugucauucuugggaaggccaggagggggcgccagucauuugauugauacccuauaaucuguguaacgagauucuuugagaauguguuuugaucagaaauagcaaugaauuugguuaacaauaucuccucaguuuucugcuauauauauuauuagaaagauauauuuagaauagauaaacuauaaaaauaacuccauaauuacaacccuagaaguuuaauaugucacagacuggaaaaggcuucuuugauuugauagaaaggguguguuugaccauuguucacugugcucacguguugauauuugcuaugcacaccacaguuuuuccuuucugggaggcuuuuuauuuuccauuaacuuugcagucuuaccuuuuccacugauaacuuuuuaaaauaguuuuggguaugcaccuuucuuuaaacccaugccccuuuuaauuuuuuauuuugaaauaaauauagacuuaauguuguaauuauuagauaucaugaauuaugcuuaugauucucagagauggccagaggugucuucuucauggguuacauuuuuguucccaagguaucucuuuuucaaagugaugcucucaauucugccaaagccccucguguagugaauuguuuauguccaauccuguaauuuccuugucaauauacacauccuuuugcuguguuggggaaagaccauguaauuacugaccccggcacgauaccaauuuuuacaaucuuauacugaaauagauuuuugugacaauuagagcaguuagacagccuagacagagugcaugaucuugggcccuaauguuaguaagauggccaggcuaucugccugucuguucauaucaaucucaacauaucuuugaauguaucgcugagacauggaagcaacuuacaggggccuccccaagacccugaaaauaaggaaaaugaaaucacuaccuaaaaguuaagcuagaaaaucaacaagcuauggaugagaacagaacuaugcaaauucacuuugaagagacugaauuacaaaagaacaguggagucgcauauuuguugucuaauuuugugaaguauaaauguaguaaaaaaaaaaaaacacgcuggcagcaaauugccaaaaguuaacucauguugauaacaguuggugggaauaugggugauuauuacuuuacuucuuugaacuuuauuuuuuuaauuucaaaaaaaaagagaaaaaacaagacugagacagagacagacagacuuaacggcugcuaugaaaaaaggccagacaguagccugacugacaguguuaacacaguagaagaaagaaugugucaaucagggagugggagccaugggcugucagucaugaaagcagaugaaaaggagaaagucacagagaaagauaguaacacugaucagugcccuucuaccaagaaagaaacugccuucuugggcucugggcuaggcacagaggcaacacagcaaagugguuauaagugagaucccagauccagacugauuagaguucauaucucaugcccaccacuccccagcuucaugacccugggcaagugguuauaccuuucugagccucaguuucugucuauaacaugggaauuuuaauaaugguacuuaccauauagagccauugugagaauaaaaggagauaauuuauguauucaguauggugccugacacacaguaaucucucaauaaauguuagcuauuauuauaauauuuuauuuauaauacccuauuuauagagauauauuuuaacaugaugccauaauuagauauucaaagcuuauaccuuggguugacauugcuuccacggucacuaagcgagcuuuggauuauauuuugucuuccuauguuauuuaucaguagggagauuauaugaggaucugucaccucaugaauuauauguaucauuauaaauggguuacauauauuauauaugucauuguaaauggguacacuaguguucagcuuuauucuagcagucuuuggaggguuugauaguguggguucaaucaaucuggaacauuaucaaauugaguuuugagccuccaaauccugggcauuuuaaaauuuuaaacauggcccucugugagcuugguugaagugaauccaccucugagggccagaauccagaccuaaugagguuuccuagcagccagucugccagcauucucccgccaauuaacucccucuguuucuacacaaaauuguacgggauaaaaccagaaacucauuucauauuuucuguguacauuugcuugaguccugugcuuuguacauguccuauaugaguuuauacagugccuuaguaagauacuacauuauauuguuacuggaguugauguguaauaucagccaacuaguaacuauggagaaauagcacagaauuauggaauuacaaugcuugaagggaacuuaacacucagguaguccugucucccugaaggccagagaggaaaaaugaccuauccaggaugacaggugguuuauuugagacaacacuauacucauauaaaagcauaaaaauuuuucugaauuacucaucaaagcagagauaaaggacugaaagaauguaucagaaacccaaaacagaacccaaagaugaaggguccaccucauuauuauucugccacauggaaaauauuccauggcugaaguccuucacucugcucuuuuauguucacuuuauuggcuuuuuccuucauucugauauuuuuccuggagaaauaacugucacuaguguucaagagcugacucuucaugaacuaggucaaauuaaaacaugguucugcuccuuuuccaagacauuuuguucauccuaaaaugcuuuucuuucuucuuuuuccuuaaaaggggacugccuucuacauagugcucccauuuuauuugcauuucccucucaauuuucaguuaguucaauuacuuauuuauugaguccuuuucuuugucuaguuuugugcuucuuugucaauugguacuguucuucacauuugguaugcaggccgccugggcucugccuucaugacuaacucaugcacucuuuuaauaaaaauaaaaauuuucauggugaaaccccaucucuacuaaaaaugcaauaauuagcugggcgugguggcaggcgccuguaaucccagugggaggcugaggcaggagaaucucaaacucaggagguggagguugcagugagccgagauugcaccauugcacuccagccugggcaagaagagcgaaacuccaucucaaaauaauaauaauaauaaaaauaaaaauuuucuacccccuuuuuguuaugugaaauuucaguaacagugaauaugccacuugaaacugccuuccucuuuccuucuccaaggacaaggucuagucucccauaucaggcauuagagaggaaugcuucagagcucauuuugaauuccagcucugcaccacuuacuuguuguguggcuuugaggaaguuguuucugcucccugagccucaguuuucucaccuaugaaguggaaauaaucauaauaauuaaauaauaauguaauuaauuaauaaaaugugaggggcacuugaaauagugccugguccaaacgaaugugcuaugcugauauuaguucuuguuacuauugucaucauuguucuuguuacuguuauuuagucaucauuauaaaacuggucuucugacaucacguuaaccaugauacucaacccagauugucaauaucagcacugucuccaguaaugccauggcauucuuaggacaaaauaaacuuuuguuuuaauuuaaugaauaaggagcauauaacauuuuuagggggugggguaugacgauaccaucaacccaaaugugcugaugaaagagacgugauuccagggagguugggaccuaucauggugaauguauucaccugguuguuugucgggagcagaccuuucuccguguuggugugugcuggcaugaugcaccacaccagcaccuuuguuuaugaucaauagugacauaggucugcucaaauaaauuaacauucuugucuggcccaacucauuuugagaaaacugauuugcaagccaguguguaagcugacccauauaaccccuuagcuuaaaaaaaaauguacuguauaccauuguaguuuuacucuaacaagcauugagcgauggcaggcaaacuuuucuuuaguuuaguuuuuuucuuuuuauggcuacaucgacugacuucuaccuggcguucuuugagaggcauguggaaaggagacugaaaacuaaauacaggagaaggaaagggacacagggaaaagagggauauuggaauuugucagcgucucugaauacuggugucuuguucuauaguaaaaccucagaucugagcaauucugaagagcuuaaacacagcauaggaauggagcaagcuaauuaugggucuauuacaggggcgauuugaacaucauuuacauuaguauuccaaugacacauugacaugauggcaugccaagaccacacagcacuaauauuuccuucuucccucucugcccagagaauuuauagccuaaggagaauauaauagaaaacaauuuacuucucuaguuugguuuuggucauuccgggccagaggcauagacuguagugacuuccacaugcagauuugggaaagugacaaacuugaauuuuaauucaucuaauugugguguguuucaaaccuaaacaauaccauuuugagggguuuggccucaucuuucuuuccuuaaacaaauagaauuuucagugaugucaacuucacuauucuagaccccaugagauggaauuuagcguuugggucaggcuagugaggucagcugaggagacacagugcaauugugccaugucuuccuuugcacuggaauuggggaugucuccaggcccacacagaggggcccucaggcauguuuaaggaaagcgcuaagcaacaggaucagacgaccucauuagggaaagugacuguaacuuguauuuuagagauuuuguuuaaaaugcccaaucucaaauucagccuuuuccaggcacauugccaaauuacagcaauggaccauuuuucaaaugcccauuuaaaauaagcggucuugaauguagcagugugacaaaagauccuuuuggcagaaagccacuuuagacaucagauuacuccaagcauuauuuuaaaauagugcccgggccuuuaaguaauucaggugcuguuuccuuugaacacagaaaaugucaguguaccgagagcagacauaaauggggcaggccuggccaacagcuggauuuccuuuuccacagauggauugagcccucauaguguauacugucccuuguccaucuguccgaauggaguuaucuuccucugauucacuccuuccccccauccccucccagauuuaaaugggggugagagaugggggaguuacgaggaaagaaacuuauugugagauauugagggugaaacuccuagaagaaaauagaagaacaauccugcuacgagguggauucugugcuugcucuucccuuuuuaucuggaauagcaauugggagguagugacaagggcugccagagguuugcuaaagagaguucugaaauaauagguuuuggucuugugcaaauaaagaccuguaguuuguuaggagcuuggggacaaaugguagcaaauggacaaauggccccaucucugauccugcaagucacugagguagcaguggguggcuugcuuucuguuucuagcucagaacuugggacuuucuaggagauucuaauauugcauaugaaccuugccagaggugcucggacaacacaaaauagagaagcugaaucaagcauuuauacuugugggagugguugcuugucuuucugaccauacccucucuucuuccagguuaauucuaggauuacuuucauugcuggcucuccauuuuuauaacuucuuauuaaacugguuuccacauucuguuaaaauaaucaaguguucaagaauguucagaagguccaauuucauuaggucaucugguccuuaaucaugaaccucacaugcgauuuuuuuuuuugacagggucuuccucugucaccuaggcugagugcaauggugggaacauggcucacugcagccucgaccuccugggcucaagcagucccccugccucagccuccuguguagcugggaccccaggcaugcgccaccaacccuggcuaauuuuuugauguuuuguagagacagagucucacuauguuguccagagacuggucucaaacuccugggcucaagugauccuccugccuuggccucccaaagugcugggauuacuggccugcggcacugcacccaacugugauuguuuuauaguacaauacaggcagcucuuguggcugagucacugcuuuaugcagaaagauuucuuaagccaggcacccugcauguaugcucuuacaugcaggguaucuggcauuucguauacagaacuguuauuuguauguccuuuauauauaaugucccuuuuaaaaacaaauccaguuaagcuuugaauaaaaaagauguuucucuaauucauuucuucgacuuugcacuaggcuuuuaggcucuucagauaguugcugaagucccuaacaacugcuguagaccagaacuaaggugguagcuaagccucagaauuuagcugguuuggugcaaauagguaccaaguaauauuuuauuuaggccuacauagauuagaugaccugccuucuagaucacacugguauuauaguauauuuuccaguuuauugagguguaguugacauacaaaaagcuguacauauuuaaugugugcaauuugaugaauuuggagauaaguauauacccuugaagccuucaucauaaucagugccauaaacauauccaucuucuccaagaguuuccucccauccucuuaauuuauuauuuucuuugugauaagaacacuugacauaagaucuaugcucuuggcgaaauuuuaaauauauacaguaucguugacuauagacacuauucuguaugguaaaucucuaggacuucaucuuguguaacugaaacuuuguaccaauugaaugaugauaccucucuguuuugcccucacccaggcucugaaaaccaccauuccucucucugcuuugaugaguuugacuauuuaagauucuucagauaaguaguaucauguaguauuuguccuucugugucuagcuuauuucauuuagcauaauguucuccagguuuauccauguuuuugcaaucagcaggauguucuucuuuuaaaaggcugaguaauauuccauuguguguacaugugagugugcaugugcaugugugugugcauaugugcguguaacauuuucuuuucuuucuuucuucuuucuuuuguuuuuuuuugagacagugucuugcucugucacccaggcuggagugcaguggcucaaucucggcucacugcagccucugccucccggguuccagugauucuccugccucaaccuccuggguagcugggauuacaggugcaugccaccacaccuggcuaguuuuuuguauuuuuaguagagacaggguuucaccauguuggucaggcuggucucgaacuccugaccucaggugauccacccaccuuggccuccaaaaguguugggauuacaggugugagccacugcgcccagcuguaacauuuucuuuguccauucaucugucaagggacacuuggguuguuaucuaugucuuggcuauuaugaauaaugcugcaaugaacaugggaguguggguaucucuuuuucuacugccucccuccauuuuagaugucaguaguacuggcucuuuauccaaaaauuaaggaggggagaaggggguacagugggguaugaaggaggagagucaucauagguaguguucagguauguauauacucuaguuuuggauacaugacaauaauuuucuuuuuaagcaaaggcaaugucaaaaagagguugcaaagaccugcuggaaaaaggagaaaaguuuugcuucaugaaaagguccauggagucaaucuuuacuuacucucgagcucuuccuggagagugaauucuuuacuuuaggcgcucgaugcucaguaaauugugaaacucuucccccucugcguauaggcauuagagacuuuuggagaugcauccagaauuuaucaaacuccucagcaaucaaauaaugauaaauuacaugguugcuuuagugccucgauggccuuguaagacaacugggggaaacagagacuaacgugcccagcuagacuaagaacuucauuagagcaacacggcuauuuuccuaccagcugacuuauuuugucagguuauaaccuuaauccuggagauuuacccccccaccccgccacccuauucucucacacagacucccuaacacacacguacauacaacucaguucuaauguggaugcaaaaaucauuuuauaauguuuauagaauauaagagcaguuggcugaaggugaaacauuccuucuuuugggcaggcucaggggaaagcugcaugguugaacuuugcuugugugccaccccugcccaccugccauugaauuuggcuggagucccugugguggugguuaccuuccuguuaagucuucgccugcuuccggagcccauugaguacaccugagcagcucucuuccccugaguuaacuaugccagccuucaacaguccccuggccuucauccucccuguguuucauguguuggaauacccugcaggaaacugaguccuaagaaacugucaagaucuuggcccuugagccuuguuucugccaguagcccuuugaacgaacugcgacucaagggagagccuggccuuuuugcaaaggcuagcuuuccaauuaaauagcagaguuuuaugguuagaguugagagcucugagauuucauaccuguaucaguaaucccuaggaaaugcacaauauugaccuuuuucacuuauuuucuuauaauuuccauuucaucaugacucuaaggcaacacagguaaugcauuucuggggaauuauuguuguugguaaguaguuggaaucauucauauuuuugcauaguucaucacaucuuacccaaguuguagaguuauuuuccugaaauauuuaguagacccaguguagccaaacagcugagguauuaaguuuacuuagagucaaaccaaaaggaaaagaaaaaagaaaaauagacaaacuaccuauaucuggaagcauugugacauaguaauuuaguagguaagcucuggauucaaacugcuuauauucaaaucuuggcuguucuacuuacugucuguauaaguuuucuaaguuacuucucugugccucaguuuucuuaucuguaaaaugaaaacaauacuauacucaccucacagggugguucugauaauuacauaaauuaauucacauaaaacgcuugaaacacugccuggcagaugguaaaugcuccaaggaugcuaguucuuauuauaccuaaagcuaaucuugaagugcucugcaauauuugcccuugaagaagauggacauaauggaaaaaauauuggacaaauaggaguucuguguuucauugcugccaccaucuacuacauagcuauaugauuuggagccagucuuaguuucgguuaccucgucugugaaauugggauaauaauguuucccuuagcgacuguucaaacacaugcaugcacgaguacacauacacacaugcucacauucaaugauagagaaagagaaaauuaaguuagaacacagauuuuuaaaaucugaaauuacaugaggcauuuugcagauauggugaucuguugccauguauacuauguauacuuaagcuauaaaagagucccagaacaaaauagauuaauacuuuuauaacuauaugguauuuuaugguuuucaaaugagauaggccaucuuguauuuaucacagcuggcuauagcuggcuauugcaagccuuuaggacccagggauaaguuguuugcauauuuuauucacagucuagcagagaguguacacucaguaaauauuaaauggaaaaaauguauuuacacaagugcagucaaucuaaugagacagcaaagaugccucaaaaauggucuuuaaguaguuuuucagcaagugguuaauguugcugacuuuaccuaaugucaggggccuaugauaauuuaggucccaaacaaguugaaauuuguauuggacacaucuuuagagacugugguaugagucaccaagggaagcaauagcccaagccuuuggggcuugggauugcuuaucucagaucuaccuuaucauuaacaagagaguaggcagugagucuuauggcucucuaucuguaaagagucaaaagaaaauuguuacaaugagugcucaguuaguacuuguuaaguauaugaaugacuaaggcuuugggaggggguauguguauaaauguuaagccaauucagauaugauacuucucauuaaugauggaaaggagggcuggaaugcaccuuccaauaacaacggguaagaggagucuguugcuuuuguaaucacugaagauuuggcuguaaagcacuugcagaaauaaaaagugcuauggaaaucuuuaauaacaguuacagacacagugcucucaacaacaaugguugcauacacuacuggcaauugaccuuucuuaggauauuaauuuagugucugagugguuuaagagggaaagaagagcauauaagagcaaggcuauguaaaaugcacacauuaauuguccuaauaauaacacaaaacguccccuagauguuuggcucuuucuuuucaaugacuacaggauauugaaaagaaauacagguuuuuuauuagauaaaggcacuaccagaauguuugcauuuaaaccuuuaaaugcagcuauuccuuuuuuaaggugcagaaucuuucauucaauacuuacucaaaagccuauuuuuauuuuccuaagcuaugguuaguaacaguaagugcuugagagaagaaacuccuuagccuugauuuguggaauuauggugauacgcuauuaaaaaauucacaaguugagaaaacaauagccagauguagaauauauguuagugauuuuuuuuggucuagcuaagauauaauccagucuucgcauggcuguuuggaguaauccauguccucuccucauaaacucuuuggagaaugaccuuuuuuaaaaaagaaaaguuuuuaauuaaauagaaugauuuggugaguccugggagccuuuuaacuacucaguauguggauuauuggaagaacuguaguagaacuuuacuucuuuggguaccaucaggcuuucuuuuguaaagaaugaacuaaaaaaucuaagagugugauccugauacuucuucguaggugucauuucuuagccgugagaauguugaauaaguaagacuauuuuccaaucaaccaagaauuagcugauccaaaugaaauccugggagacagagaagaaugaaaaaaggcuaaggaucaugacuuauaacagaaauaacucaucgagaugacagcacaaaaaauacugauccccaagauucuguuacaagauccagaguuauucuugguguguccacaguaaaacggguuucuaaaccccaguggcuuuuacaagacaaacuguucuuaaaguuuuaucuauuuaagaaacaaguuuucaugugggauucuccuacgcuguucuguuuagcuacuuuccugcuuuuucaagggugucuuuuuccugaacccagugugaaaccagacacauucugagcgaugaugaagguagccuuauuagcaacucccuaauuuuaacauuguuacauuugacucacauuuuuaagauguggaaaaaguaaaaaguuggaagauuuuggaagggucauauacauagauucaaccaagggcauuuuuucuaauuucagcuuuuauuuuagauucaggagauacaugugcaggcuuguuauauagauauauugugugaugcugagguuugggguaugauugaucucaucaccuacguaugaagcaugguauccaguaguuaauuuuuaaacccccaccccuguaguucccaguuucuauucuuaccaucuuuauuuccaugaguaccccauguuuagcucccacuuauaauugagaacaugugguauuugguuuucuguuccugcauuaguuugcuuaggauaaugaccuucaguugcauccauguugcugcaaaggaaaugauuucauucuuuucuauggcuguguaguauuccaugguauauaucuaccacauuuucuuuauccaguccaccauugaugggcaccuagguugguuccaugucuuugcuauugugaauagcgcugugaugaacaugugaguguaugugucuuuuugguagaaugauuuauuuuccuuuggguauauucccaguaaugagauuacuagguugaaugguaguucaacucuuaguucuuugagaaaucuccaaacugcuuuccacagugucugaacuaauuuacauucccaccaacagugcauaggcauucccuuuucucugcauccucaccaacaucuguuguuuuuugacuuuuuuuuuugaaacugauguuuauuuuuugucagccuuauuuccauguugcuuaagagcugauauaagaacagcuuaagacuaaccagugguugcuccuacccauucaguggccugagcaguggaagcggcagaccagucuuccguggcaggcugagcacuccagucuucaguagggaacugcugaauaggcacagagggcaccugcacgccuucagaccagucugucaccucaggcugaguagcagugaacucaggagcuggagcaguccauucacuuugaaauuccuccuucaucacagccuuuucagcagcagucugcuauucuuuuucagucucuucaggaucucuguagaaguagagaucaggcaugaccucccacaggcguuugcaggaaaugguaccacgcgugugcagaacuuccugagccagcauccaccacaucaaacccacugagugagcucccuuguuguugcaugggaugguaauguucacauagcacagaggagaaucugugugacacagagcaauggugggaagauuaacauaagaugccucugugagaggcugguggucagcccuggggucaguaaccacaagaagcugcggcuccugaaaggcugccuggaucugguuagugaagauuccaggagugaagcggccagcaauuggaguggcucccauggcagcagcaaacuuuagcacggcccucuggccaguauuccuggaggauaugacacugacaucagcaggguuuucaauggcaacaaugguacgagcugccagcagaagauucucccagguccucuucagauuuaggauguagaugccaucacuuuuccuuuuauagauguacuguuucauuuggaagucagggcuggugccaccuaaguggguuccugcugcaaggaacuuaaggacacccuucuauuucauuugcaggacaucaagggcuccggacguugugaaaguuuuccucugaguuaggacaggaaucccgaaaaacgcuguauggaccccucugugggcagggcggaaaggcuguuguuuuuugacuuuuuaauaauagucauucugacuggugugagaugguaucucaucgaaguuuugauuugcauuuaucugaugauuagugauguggagcauuuuuuuucguauguuuguuggcuacuuuuaugucuucuuuugagaaguguguguucauguauuuugcccauguuuuaacgggguugucuuuugcuuguucaaauguuuaagguccuaauagauucuggauauuagaccuuugucgaugcauaguuugcgaauauuuucuccuacucuguagguugucuguucacucugcugacaguuucuuuugcuuugcagaagcucuuuaguuuaauuaggucccacuugucaauuuuuguuuuugcugcaauggcuuuugaggacuuacucauaaauucuuucccaaggccaguguccagaaugucaaccaagagcuuugaccacugcuagggaagacaguguugaacugcuaaugagucccugacaagguguuugccauuuauaaacauaaacauuucuauaguugcuacucauacuugugagaaaacauuguugaaaugguauuuuuucuuuaagugguaggcauagcuccucucccuccuucuccuuauuuauuuaccuaccuauuuguuuuuauccuacuuuguccccagaggaauuuaaagugcucuacaaauaugugcauaauaaauguaagaugcaaugcaacugaaauacauaggaacuaucaggcaaaggggaauguaagauggagccagguguaagauuaugacacaaaguacauaaugaaguuuauuaugcuugauagaagcagaccauaaauuuggcccuaagcguucuaguaauaaaugugaagagggaaaaaugaugaguuacccaaauuaugguguccagaagguuaaaauaaacuaguuguucaggaaagcuaaugguggguaaacgagaagagcuaguugggcuaaugaguuggucaauuguugcagacucauacauuuucuaguaguuagagcuauucacuucucauuucugaggacccuuugacugaauuauuuuaauuguucucucugaucuauaauagccuuuagggaaauaucuguaucuaucuaucucuccaucuaucuaucaaaugauauauauaauagccugugaaaagcauauauuucuucuuucuuucacucauucuucuguuccucauugauguacauuguauuuagaagccuagugugugaaauuuaaaaagcaagacuguauauauuuacaggcuggucauggaucugcacaaauaaauugcuuauauuuaauagcaacuuauuucuaagcuuuguccauucuaguuaaauuaaugugaaacauaaaaugccagaaaaaucugacagaaauuggagcaacacuuuuagugucuucucuauuauuuaguuuuuaaaaugugaggcuuuucuuagcuugcaguuucuauguggcugauuucuaaaaaaucauuuaguauuuaaaaauaacauugaaauguguuaccuauuuggcuguuuggguccauuaaccuuuuccagugguuuuuuucaauuaaaauuacauugaugccauauggcaucuauuguaugugaaaacucccuaaaucaugaaagaaaugucaaagcagaucgagggggaaaaagagggagugauuuaacacucuucagugguucuagucacuaauuccaucaagggcuaauuuccaagaucuaguuuuuaaaaaaaaaaauuuaaaagauuaauagaccuuauuuguuuagaacaguuuuggauuuaaagaaaaauagagcaguuaguacagaguuucuguguacucccucuucccugcacaggacuuauucuauuauuaacauuauuagcauuaguuugguacauuuguuaugauuaaugaaccaauauugauacauuauuauuaaccaaagcccauauguuuacauuaagguucauucuuuguauugcaugguucuauaauuuuuuacaaaugcauaaugucuuguaucuuucauuacaguaucauacaguauaguuucaccacccuaaaaucccaugcuucacuuacuuucccauguucucuccccucucaaaucccugacaaccauugaucuuuuuagugucucuauaguuuugccuuuuccagaaugucauaugguuggaaucauauaguauguagccuuucagacuagcuucuuucacuuagcaauagacauuuagaguuccuucaugucuguuugugucuuaaucucucauuucuuuuuauuacugaauaguauuccaguguauagauguaccacagcuuauuuauccuauugaaggacaucuuguuugcuuccaguuuuggugauuauaaauaaaacugcuauaagcacuagguuuugcuguagacaugaguuuucaaauaaauuggguaaccaccaagggacacagcugcuggaucacaugguaagaguauguuuacuuuuguaagaaacugccaagcugcuuuauaaaguggcuguaccauuuguauuaacauucccuccagcaaugcaugagagugccuguugcucugccucuuugccaucauuuguuguuaguguuaugaauuuuaaccauucuaauggcuuugugaugguaucucauuguuauuuuaauuugcaguucccuaauaacauaugauauugaauaucuuuuucuaguuuuuuuuccccaucuguauaucuucuuuggugagaugucuguucagaucuucugcccauuuuuuaauuggguuguuuucuuacuguugaauugcaaguguucuuugaguguuuuggauacaaggccuuuaucagacauguguuuugcaaauauuuucucuuagucuguggcuugucuuuucauuuucuugacauaugcuuuacucuucauucucuuaacauugcagaauggauguuuuucugcuuagugccugauaagucugacuaaucaauuuucaacuucauagauugugcuuuuacuguuauaucuaaaaacuuacugcuaaacuuaaggucagucaccaagaacucccacuuuacauucuauaaguuuuauaguuuugcauuuuauguuuaugucuaugauauauuugacuuaauuuuaugaaaggugaaaagucuauaucuagauucauuuuuugcauguggauguccaauuguuucagcacuauuuguugcaaagauuauucuuucuccauugaauugucucugcucuuuugucaaagaucaguugauuauuguauuugugugggucuauuucugggcucuguauuuuguuccauggaucuguuuuucaauucuuucaccaauaccaagcugucuuuauuacuguaccuugaugggaauucuugaauucaggucaugccaguccuccaacuuuguucuuuugcagugcuguuacagcuauuuugagucuuuuauguuuccauauaaacuuuacuauugauguccacaaaauaaguugcagggauuuugauugggauucauugaauuuauagaucauguuggaaagaauugaaaacuuaauaauauugagucuuucuauccauaaacauggaguaucucuucauuuauuaagauauuuuuuauuucuuuuaccagaguuuuguaguuuucccaaucuguacaccuuuuauuuccuuuuauugucucauugcaguagcuaguacuuuaaguauaauguugaauaggagugcugaaauagggacauucuugccuaguuccugauguuaaggggaaagcaugcaguugcucaccguuaagcaugaugcuagcuguaaaauuuuuuguggacguucuuuaucaagugaagaaaguuauccucuguuucuaguuugcugagagauuuuaucaugaaugauguaggauauuggcaggaaaaacagcaaauguuuuuccugcauuuacucauaugaucauaugauuuuucuuauuuaggcuguugaugugauggauuacauuaacugauuuuuucccuaguuuucuuuauuuuuuaauuuuauuuuaaguuucaggguacaugugaaggauguguagguuuguuauauagguaaacgugugccauggugauuuacugugcuuagcaaccuaucaccuagguauuaagcucagcaugcauuagcuauuuuuccuaauguucucccucccucccugccucaacaagccccaguguguguuguuuacccccauguguccauguguucucauuguucaauucccacuuacaaaugagaacaugcgguguuagguuuucuguuccugcauuaauuuacugaggauaacagcuuccagcuccauucauguuccuggaaaggacaugaucuuguuuauuuuuauggcugcauaguauuccaagauguguauguaccacauuuucuuuaugcauucuaucacugauggccauuuggguugauuccaugucuuugcucuugugaauagugcugcagugaacauacaugugcauguaucuuuauaauagaaugauuuauauuccuuuggguguauaccaaguauuaggauugcugggucaaauaguauuucugccccuaggucuuugaggaaucaccacacugucguccacaaugguugaacuuauuuacauucucaccaacaguguaaaugccuuccuguuucuccacagccucaccagcaacuguuguuucuugacuuuuuaauaauugccauucugacuggugugagaugguaucucauugugguuuugauuugcauuucucuaaugaucaguaaucuugagcuauuuuuucauauguguuuuggcugcauaaaagugugcaaaggacauaaacagaaacuucaugugauaugaccaauuuuaccacagauccuggcauguaccuugcaguuacuucauaaauauuacuuuucuuccuuccguuaagguaccuaagcuugaaaacaaggaccauuuuuuauucuaacccauugugaggcauuuauaccaggaacauaaaaaguucuuaaguauuugccauucuuacagugcuggaaaaauugccuugaaaaaaaauaaccugcuucuauaaggacugccuuacccuaaagggcuugaaagagauuccaugguucauuuauuccucucuucuuccaaacacaaguauauucuccuuuuuuuaaauacccagcuacuacugaaaaggcccauaaaaacacauuucuuccugucugagucugaauacaggaacaucaguaucaaauacuaaagacagucauuuugcuacagugauagguuauauguccugggggguaguagaaguuauugaaccauuuaaagagagguaauacccugauuguacacuucaccaucaagccacaucuggagaauuguaucccuuuuugaacaccauaauuuaaggaggacauugacaacacuggagcauguccaaaggguggugaccagaaugauaauggggcaucuagauaucuagaaaccuugcuauauuaggacauguauuaacccgaauuuauuaagucuauuugccugcaccacuuauuuuucuuuauguuguaaaaaauuagaauauuuucuauccaaugccaaaauguucaugauagcucugauuuuacauuguuuguucaaauuuuuccuggauauaacccuugauuucuucccaggaaagaggcagagggaaaccuccccuaguugaaguguaccuuauuaucugaccaaaaaaaucagugagcugaacuucuuugcaguaauucuagcccuugauuucauuucaugaaaccuuaaguugccaagaaaagcugagcauugcuuuucgccuaguguugguuucuauaagucucccaggagccuuuaguugaccaguuauggcuugguuuguuguccugugauacagaaguaaguggguugggcaaagcccagagaugugcuaaguggauucugagcugcggaaguuggagcagggagcacauaugagcuugagguucaaaguaaaccccuagcccuuuuccccugcaacaugcauugugauuauucuuucugcagaagaguucaugaucuuuuauaauuuucuuuuucuauugauuuaggagugcuaguaacagaaacuuuuaaaaauguuaugacaguacagucaauggaaucuugcuguuguacaucuugcacauuggagaaugaaugcacuguacuugagauaaagcuugccuuguauagaauucauuuuagggaugcuuggaugauugagaucuacaggaguggcauauccacagcagucuuuucccuucucuucauucugcacaaaggcaaaggugaaaggugugacucugcuuuguuggucuuuggguugcaauuucuucuaguauguuuccauuugaagaugggaagccaaugggaaaauaaugaguuuaaaauagaacuguacuuucugcaaagguuuuugagacuauauguauuggcuguaggucgaaggcagcaagcguguaacuguuauggaagacacuaguuugugcugauugcuucuacuuuccugugugaccacgggaaaaugcuuuaacucuacugagccucaauuuugucgcauauaaaaugggaguuguaauaccaaacuuaaaagauuguuguaaaaaguagaugccauaauauacuugagaauauuuuguaaacucuaaaccauauagcuugugaauacuucugaaacaaggaugguuuaucauuuaucuccaucuacccagcauuuaugugccucuagcaccuaguacagagucugauauauaacaagugauugcuagcugaaauuaaaaugaaugaauaguuucaaaucuccaaauuucugaugauuuuaacgaauuuguugacugguccucuguauugggcuagauaaucucuuggccucauccagcuuuuagaaaacaaggauugagacuaaaguagcauguggaguuuggagaguuguuauaagauagagcaacuuucuaggaauugcuuaauguucuaaacaaacaaacaaacaaacaaacaaaaaaaccaagugaacauucaacaacuuacagaaaggcagauuuuuuuuccccagggacacacagcugcaaaguaaucagugcaagcuagugucccucagagacuguuacacucucacugcccucaguacacauauacucaaaaaccuuuuguaggaaguuaaguuuuguuuuaaacucauuauuuucucaagugagcuuggaaacccaauagaacuacacuggcaauuguucaacauugcugggcaugucauaagcccaagggaagaaucuagggagcauguucuacucugggagggaucuggggcagauggugguagcacaaccuagagcucacuucugccacagaugacugaaauguuggacuaagugaucccaaggaacuguuggaguauggucucucuaguagucuaaaagugguaauaauucgauuuuucaaggcucaugaacuggcaucauuuggaguacaucugucauggaccuuugcacuuuggaaggaaauggaaggaaggacuaaguuaauuuuaagugucucaggaaacuuggcuauuuuuguuuuuaaacucugucuuauuucuucaaaagccuauugugguuguuuuuccuucccucauguaaauguagacucugauuauuugaaauaauuugggucugggauguuucaguuuggagaaaaugagauggugacauuacuacuuucucuuucaaaccaaugacacugauugggcuuuaugcaaagggguuggggcagcagauguaaucaugaauuuguggucucuguagagcagauaaggcuuccaagccauguggaagcugaacuuagcaaggaagcuuaguaguuaucccuccggauguucagcuugcaaauaccagagguguuguuuucaauaccaaaugauagauaagcacauggauuauuuuuccacccagauacaaaugcauuggauagauuccauuuccaggucuggcaaucugucagaaagcucucuuuaaaguuaucaggagaaaaucuaccaaaaugauuaaauucgugauagcuuuuauucuuggcuaggaacuugccuccccuccagggcuaaacaggcuuaaauuguugugugaguuuauacaauguaugguuuguugucaaauauuuaucucugucuaaaaaugaaauguccugaaauacaauuucuuuuuaacugaauaaaucagugugagaaagagaaauaacuucucauuuagccaauuuuuaaucaauauuuucaugaaaggccgaaauguuaacugaaucuuggcuuuugucauuugaaauauaauuuguguguuuaagaauuuaugugcacaucagaaucuggacuucauguucagaaaggaaaauugauuuauaggagcaaacaacugcaagaguagaggcaaugccagaaaugaaugagagucaauuauuuaacgcaaaugggaccuuaaucaccacagcaauagagaagucucaaauucauuuucacacuggauuuucaugcuuuaauuuguacacauuuuugugucucuuuuuuuuuuuuuuuuacagaggccuuugaaauuguuguucgccaugccaagaacuacaccaaugccauguucaagaacaacuacccaagccugacuccacaagcuuuugaguuugugggugaauuuuucacagaugugucucucuacaucuuggguucugacaucaauguagaugacauggucaaugaauuguuugacagccuguuuccagucaucuauacccagcuaaugaacccaggccugccugauucagccuuggacaucaaugagugccuccgaggagcaagacgugaccugaaaguauuugggaauuuccccaagcuuauuaugacccagguuuccaagucacugcaagucacuaggaucuuccuucaggcucugaaucuuggaauugaagugaucaacacaacugaucaccugaaguucaguaaggacuguggccgaaugcucaccagaaugugguacugcucuuacugccagggacugaugaugguuaaacccuguggcgguuacugcaauguggucaugcaaggcuguauggcaggugugguggagauugacaaguacuggagagaauacauucugucccuugaagaacuugugaauggcauguacagaaucuaugacauggagaacguacugcuuggucucuuuucaacaauccaugauucuauccaguauguccagaagaaugcaggaaagcugaccaccacugugaguaccagucuacaguugucagaggauuugggccuuauuggggugagguggccaguagcagguacugauggagagaaaugagaacaaaauuggaagguggggaaggggugaugauggacugaaugaccucacagaguuaggcagcauauuaagaccacaggcuaugcaaucguaaagccuggcuccaccuacuuccuuacugugcgauguugggaagucauuuuaucuuuaugaguucauuuuucugauucaugaaauagaaauaaaaagaauaucgucuucauagggaaugacauuuguuaaagcacuuagcacgugucugguaugugguaagucuucgauaaauguuggcuauuauuagcauuauugucaguuaucauaauccucauuauugauacacaauagaugacaagccugugaagugggagcuauuaucuucauuuuauaaaugaggaaacugaagcuuaagugaaauugcaacuugccuaagagcacccacguaaaguuaguggaagagccaugcuucagaaauugaccaggucucccuuuaauuugguuaucaccaauuuuucugauucuaauuuccucuugguguuuucaaucauguauaucacauuagcauuuugaguagugacuucaaacacaaaagacccagcuagaguucacuaauuaaaccucacaagcacauaagcaaggcaaacaauccauguucuccaaugguuuuguuuauagccuugauuauaucagucuaagucugaugaaauucgugauggaggaagggaaguucugugagugaggcagcaguuuccuugguuucagucagauauuguuaguaacggaaucucgggagauaccaacuuccaauauauagcagaacauguagccaagaguuaccagucaguuucccuaagguaguaucugauuccugaaugcugccagcuuuguagaaggagguggcagaauaguauauuacacuaccauuguugagcuuccacuacaucucaagugcuaugcuggcuaguuuacauaauaucauuucauaguaacccaugaaaucagucuuaauaaaccuaaaagcuggguuuuguuuuauuuuucuguuuuagaaauauucuauuucugcuuucugcuaauuauuuuucauugauauacaauauguguacguauuuucaggggacaugugauaguuuaauacauucauacaauuuguaaaggucaaaucaauauaauugggguaucuaucaccuaaauauuugucuuuaugcuagaaacauucaaauucuucuuuucuagcuacuuugaaauauauguggccaggugcuguggcuuaagccuguaaucccaacacuuugggaugccuaggcgggaggguuguuugaggcugggaguucaagaccagucugggcaacguacagaccccaucucuaccaauaaauaaauaaauaaauacaaaaaauuagccaggcaugguggcaugcuacuggggggacugaagugggaggaucaacgcugcagugagccaugaucacgugacugcaccccagccugggcgaaagagugagacccugccucaaaaacaaaaacaaaaacaaaaacaaaaaaaacaagagagagaaagaaauauaugauagauuacuauacacuguagacacucuacugaucuaucaaacacugagucuuauuucuuccucaaagcuaguuaagucagaggagcugggauucaaacccagacuuuguuggcuugguugauagacacccuuagcaucuauacagugcaacugcugugcacucugaacuauugcuuauccaaaauguggaggguggauuaggcuauuucagcuugucuuuaaacucuaggaguaauuaguuucuuuggugaauuaaacuaggaaagaggacaaaaaugaugcaacccucagcauggcuacuuacggaguugcuguaauugccccauucacaauguuagucauuuaaaacacauuuccugugaaaauauuuuauaguaaaaugaacaaaaauguccuaucuaauuacgguguucuucaguggcuaauuauucccuugacugcuucacaauucaaggccagguucuggggccuucugcaaaaguaaauuuuacaaaacuagaaaaaguaaaugcauucauauguucauucaccuaauacugauugagagcccacuguguguaagacacaaagaaagcaugccaggggcuuggaaaugcuuucaguaagaggaaaauaaagagacaacauuaaagacaggguguaggaguguucaaagguugccucugauauuggucauuucauagcaacacaauugaucuggaaaacaaguauccuccuguggugcuuuuauuuauuuauuuauuuauuuauuuauuuauuuauuuauuuauuuauuuuugagacagagucucgcucugucgcccaggcuggagugcagugguguaaucucggcucacugcaaccuccaccuccuacuucuaaucaauucuccugccucagccucccgagaagcugggauugcaggcgcaugccaccaugccuggcuaauucuguauuuuuaguagagaugggauuucaccacauuggccaggcuagucucaaacuccugaccucaggugauccacccaccuaggccgcccaaagugcugagacuacaggcaugagccaccacgccuggccauguggugcuuuuaaacacaugaaaaaaggaggugaggaacuuguaaagaauuaagcgcacuguuuugaucaggcacuagacaugaagguucauuuaggaaacauuuauuaaacaucugcuuuguguauggcacuuugcuaggugcuggauauucaaaacuacccaagaaauaguucuuaagucuugaaaaggucacaguuuaguugguagacagacguguaacugaauacauuucaccauagugaacacuucaccauaaugugaauguugaaagggcugugagagauuagcuaguccaaucccauugauuuacaaaggaagaaauaaaguucagggaggcuuacccaaaguuauauaauuaauggaggaaccagaaguagaauccaaggucuucugcugcuacaauguaauacuuucuccauaauaccagucuguccccgcuuagaccccccuagacuuuuacucuaagagcuccauuaggauuuugcaaacacguagugaaccuaaauuggauagcaauuucuggcugccaauccugcuacauuuuaggugcaugcacaugcgugcagggggagugcauuucaugucauuaucauucaggaagaaaggcuuuggcugucaagaggugcucagugaugcaggcccuuucuguuuuggccuuuaagggccugauugcucccagcucccagcugguuaugagagugugaauucugccauccccggggaaugccugaacuaaaccagaaaacauauguaaacucugccuuguucauguuuuaugaucaccaacucuaaguaauacguaccaaaugguggggguaggggaaucacuggccagaugugauccaacccauacucaguacgggucaaaaagggacugggcauuuaugagggcgagggggagucggagcugcagaacucuauucacauuaacaaacccacagaaugccccaaagcaaaagcugguuuaaaacuaaagcuuuaaugagauucuccaguagcacccuaaccuuccuguugcgauaaaauguaaaacccugccauucaguccugcuugagguucaguuguggugagagacuucuuuaaaaauauccucuuccugagcucugcugggauauccuuucgagcuggcuuuaagccaugacaugaggucugccacacagagacuuugccuaguuguuuuuguggcugucaucuacccagauuaugaagauuguuuuggucuucuaagugagugugguacuguucguuuuuuuaaguguggcuuguuggugcuuuaguuuucucuagcauaguucucaauacuucagacuaccaagugaaggcaggcagacaaauacugggguguugucgcuggcagcaccacuggaggugguaaaggauccuguucucaaacucggcucaucaucacaaucaccuggguuacuuguuagacacauuccuggaguccaccccugcagagauucuaauaccaaaggugugugaagagaucagaugauuuuguuucguuuuguucucuuuuguuuuuugagacagggucucacucugucacccaggcuggagugcaguggcucgaucuuggcucacugcaaccuccgccuccugggcccaugcgauucucaugccucggccucccgaguagcuaggauuacaggcgcgugccauaauaccuggcuaauuuuuuguauuuuuuuuguagagacgggguuucacuauguuggccaggcuggucucgaacuccuggccucaagcaauccaccugccucagccucccaaagugcuaggauuacaggugugagccaccgugcccaaauuauuuuuuauuuaagaaaugucccaguugauucugaugcucccuugggagcaaauccagccaccucguuucgaagauaaagaaaauaagccccagagguuggaagugaauggccuaaguuccacaggcaauuaguggcaaagcuaggaccuugaauucuucaucuauaaaauggggucaagauauggcgauuaaaugcaguguuagguucaggaacauggcaaguauucacuaagucccaguccaguacucuuucuuacuacagugaucuaagugccaaaugaaaaaugaguuuuucuuaaacauauuuuuaggugccaagauaucuuaauguuauuuuagucuaaacgaaguaaauaaaaauaguaugugugagaauguaugugugugaauacauguguuggggggaagagagauggagggagggggaaagagaagauuugugcugaaaaguccaagaaaguauuaaugaugagacuauaaauagauccguuuugcaaacugagauaaauaucuauacaaacuaggauaaauaucuuggccccaagugagaauugaauagaucuuuaacaguauuugggugaaaguaucacuguuaaauuuaucagugcauuauugaauuccacaucuuauaccuuaaagcaacugcaaauauguaccauuuugcaauacauauauuuucaguguuguuacacccaaacugcugagugccacagcuucuuuuuaaaauaugacuguuuuuauccugaaaaccauuuugauugcuguuaccauauaccuauguguggacuauaugcauagccauugcccauuucauguauaauucauccauuuacuaaaugauuaauaauuagcauguuggauguuuaucccucuccuggaaacuuucccaaaacuuucuguaauuuuguuuacuuccuuuaauccccaaaauaacuacucacaugucuucacauggugguuugcacuuuuauuuuucuacuuguacacacauacauacuuuauugauucaucucagcauuucucagaguuagugcuuccucucccacaauuucauuaccuuggcuuguucuaugcuuccuugaauauuguguagaauugcaaccuuuucuaccaccauuacuucucccuuucuuuuuucguugugauauucauuuuagcacuaucugaaauacgauucguugcaggaagcauuuauugagcaucuaauaauggaagcacuaugauagccacuggggaucagagggaguagcuggaaagaugcacaugacucuguuguguugcccucagcggucacuuggcuaguagguggcagaacuaguauuuaaagcugaaccugucugacucaaaagcucaugcucuuaaccauuacucuauauugcucucucaagcaguuccauucucuucagcagaaucuuuuuuccccaaacacagacuaaguagguuuuuauuauauuauuuaauauccuguauuacucccuacuguuuuuccagcugcacaaucaguuucugaauucauucucccuccuuggagacuuuugcucuaguauuucccaaugaaguacuaaaaggcaugagauuuacaucuuccuaacacuuaaaggaacaguguaguuucauggaaaagaaggaauguuugugcaggugauggaagguccagucacacagucagaugacuuggccuagaaucuaugugagcagugccgguggugagaaagagguucucuuccacuugcaaaguuggaaaucugccgauuggaccaacacauaguuuuuaaugcaucugccuuugauuccggacaguagaagaacaucagaucuccaguacggaguguccuugguauuuaauaauaguaacauugccuacugagaaccuaacguauccaaauacauccauuuccuuugcuaggauuucugaggucaguauuuauuuuugugugccaggaagcucuggggaagauucucuguugauccucaauaauaauuaacuccaucaaacucuuauauuuugcugucagugugagugacuguaacucgucagaauuuccaagauuagccuuaccuuccucuccacuguugaaggcugagguuauuucucaggugucagaaugucaguguuuuucuccucaugcuaucacuuuggacuuucauuuuucagucucagauagagauaccuugucugaauucauacaagcuguuuucaguaccaagugauuugaaagugauaaaaagaaguaaauggcucacuaccuaauuagugucugcaggucagccucuagaacaaugguaagcaacuuuacuuacacaagguuuauuucuggaaagacaaaaacuguuuacagguugccaucauuuuuucauucacaaucaaaauagcuucagugauuuccauggagaaaauacguaguuuuaaaacacacauuaccuauuuauugcaagaauacaaaugaaaaaauuggcaccauguuuuaggcaauaaauguuaacuuuaugguagguuucaaaaagugguuacauaaggggagcuuuuuaaaaauguuucauccugaaauuauacguauauuacaggucauauuaagaaauuagauggguucuucauaaaucuagaauugcuugcccuugccuuggcauaaucgccaguugcuuauauguucugaauuuuuagagagaaauuuuacauccuuucuguggucaguggacugauguggcaggaacacauccucaagagcugugaaagaucugagauuuuuacccugauugcaagcaaacaagcuagccuacugcaguuucaucgauguuaguuaauggcauaagacuccugagucagagaugaaggacaguuuauugcuuacagcaauagcagcagccagaguauuagcauuugugccagaucccugagucccaauucccacaggguaaggcaaagagagcugaaugacuccuguacacauagugaguuguauuauaggagagaaacuuugaacuuagggaacucaaauauuuuauaauagaugguaagcccaccugcuguuuacucuaaagggaaacaucaucucuaucuuccaaggcuguuggcuauacaaagauacuugaaaaggauagucugaaacaaaggguagucaguucgucuguuccuaagacaugccaaagcacaagagauccauggagaauugucuuccaacacauggucccccacccuuggauggcuccaagaacuuuucaaguucucaaugcuuuuggaggaucuggcaaggaaauuagaaguuaguaaaagacaguuagcucaacccugacugauuggccaaaaagcaggcccaugugccaccuguuggaggguagcagaaggcauaucuaaauacugagaacaguggcaguuuucucagcucuucagagaauacuuuaaagagaaaguaucaaagaggcaccuguuuguugcuucucauuagcaguaaauucugcuacugugggccuccagcuacuccacugcucucuuucagucucuaagcugucauuuccuuucuugcucuguucaggcuauaggguugggaguuuuguguugcuaagugacuuggcugaauuaaguuuucucuuuuauugaacuucuagggugaagcauugugaugaccacagagugguaggcacaugcuuauccaugccugcuggcagugacacucagaguguauucagaaaggucagaaagccagggauauuugcccaaguaggcagaaguccaagaagaucucaccauggccugauauucugaguaccccugugguccugagacaacagugagggagccaacaaugccuuuuuuuaaauaaacuuuaaauucugggauacacgugcagaacaugcagguuuguuacauagguauacgugugccauggugguuugcugcacccaucaaccuguuaucuacauuagguauuucuccuaaugcuaucccuccccaaccccccacccaccgacaggccccggugugugauguuccccucccuguguccauguguucucauuguucaacuccuacuuaugaaugagaacauaugguguuugguuuucuguuccuguguuaguuugcugagaaugaugguuuccagcuucguccaugucccugcaaaggacaugaacuccuccuuuuuuauggcugcauaguauuacaugguguauauguaccacauuuucuuuauccagucuaacauugaugggcauuuggguugguuccaagucuuugcuauugugaacagugcagcaauaagcauacaugugcaugugucuuuauaguauaaugauuuauaauucuuuggguauauacccaguaaugggauugcuagaucaaaugguauuucugguucuagauccuugaggaaucgccacacugucuuccacgaugguugaacuaauuuacacucccaccaacaguguaaaaguguuccuauuucuccacauccucuccagcaucuguuguuuccugacuuuuaaaugauugccauucuaacugacgugagaugguaucucauugugguuuugauuugcauuucucuaaugacuacugaugaugagcuuuuucucauauguuuguuggccacauaaaugucuucuuuugagaaauaucuguucauaugcuuugcccacuuuuugauggguuauuuguuuuuuucuuguaaauuuguuuaaguuccuuguagauuccggauauuagcacuuugucagguggacagauugcaaaaauuucucccauucuguagguugccuguucacucugaugauaguuucuuuugcugugcagaagcucuuuaguuuaauuagaucccauaugucaauuuuggcuuuuguugucauugcuuuugguguuuuagucauuaagucuuugcccgugccuauguccugaaugguauugccuagguuuucuucuaggguuuuuaugguuuuagguuuuacguuuaagucuuuaaucuaccuugaguuaauuuuuauauaagguguaaggaagggguccaguuucaguuuucuacauauggcuagccaguuuuccgaacaccauuuauuaaauagggaaucauuuccccauugcuuguuguugucagguuugucaaagaucagaugguuguagauguguggcguuauuucugaggccucuguucuguuccauuggucuguauaucuguuuuggcaucacacugccugacuucaaacuauauacuacaaggcuacaguaaccacaaugccuuuuuaaaaagaugucgaguggcuagggaaucagaguacagugaaaguagccuccuaccuugugggggcagaaaagccccuggauacuugcucccuucauuagaaaagcugaaaugccacacaaaacagagucauauacacugugauuucccugugauuaaauuucccccacuuggagcaagguuccucuuggcgaguguaguucugcauuauccacucacaauggcaccacaaguaaccuuggcucacugaccucuuaugcccaugcauuuugcuaucuugcucagguaucuggcagaaaaauguuuucuaacuugacuguuucuuaaaaggaccauucguccugccccuaccuuaaaaauggaaaacauauucgaauaucacagaagcauuuuuuaaugaaguugcacuguccuauaguaauuuccucaagggagguggcaauuuuaauacuugcuguaauaaagaauuuuacaaagucaaagauaagggaauucugagcagaugucuuccagcauguugcagccuuuggaagauaaaauacaaauuucaucauuaccagcaaccacaauuuucugagugcugagugcugagcacuguucuaggucuuacaguuuaccuuucccuuccuuguccgggggacuguuaaugggguaaaacaaauagccuuuguuuuggugaaauuacagauuucuuaauguccuuuuaaaaugccccuuugggaaguacauaauccagcaaggcugcuuucuuauuucauacggggggugaggggaggguuguugcugccuccuuauuacccaauucaaauucauucugaagaauauucagaaagugaauuaauuuuucccuuuuucguuccacucagaaugccuaaaacagauaaaguaggaagcagagucauuauauuugggugcugucuauuaucauuuacugagaaucuaucuaagccuuucugcuuuuugcagauaauuaauuuuguuccuaaauguagggaagagugauuguaaucaguguguuuguacuuucagccacaaauagagcccaucaaagauaugcaguacaaauaaaccucauaaaauaugcagcccaaguacugcucaaaguuaauguucuaucuuuuuuuccaaagaaaaaauuuuauacacguuauaugauuuuuaaaagucauucuugguauuuucauauaguuaauagaugggccccucuuuuucaaacucaaaccuaugcugugaauuauuuuuuaucauuaaaucucauguaguggagcugaaggagacugauuuggcuuagaaaucaucucagcaacauauacacauuacugaguucuggguguggguuucucuuaugcuuccagaaaauaaugaaugaucagaucuaaguuacaggcucaguuucauggaugaaaccccacacuaagagcaugguguuugugaaugaguuccucugaacucuuuuggaaagcuuuugcccuucuaucccagcugccuguccccaaccucuggccaaugccuacacuaagcccaucccuuuuccuucugcuucagauuuguaccuugcucuguucuguucauucaaacccuguacuuuauuuagaguggugaugugugauuaugguuuagucaucacaggaagcccauuucugcuucuacuaguucucuaaugcauuccuucucuugagaagcaaacuucauuagcaaaguuaucgcuagaaaacucuuaaaaaggauuauugaaaaagguagaucucagucacugugaugcaguuguagggagaaauauuuaaguguaugugggaccuuaugaaauuaccuacuauacauuguaaguuauaaagaacauucauucagaauuuugauacaggaucuuugccuugugcugccacaggcaaguggccugcgaaaagcaacuucuuagugucuguuccuuaaucuauacaacgaggaagaugaugacaagagugauuauuuaauaagcacuugcuaugugccucacacaauucuaagcucuuuacauggaucagcucauuuaaaguuuacaauacuaaugagacggggauuaucauuaccuuuuuccuaguuaaagaacugagacagagagacuuggaagcaggugccagcaacaaggcagcuucagcuaauugcucucuacugcagcaacuuuugagguacaucucuugcccagaaccagacccagucuuagaauauaugggcauggcuuggccuugucugcagauggauauaagcugacucaguugucuggaaugaggcaggauggggagccagaaguuauuaagggucuuucauucuugccuacucuuucaguuacuauucauccuguuuucuacguguggccuugagaauugcauggaaacuuccaaugggcuuagcuuuucuucucugcuuuucuucauauuuguauuaauuaauccuaauuaaaguuuucuuucuuuuuuuuuuuuuuuuggcuuaaacaacagaaguuuauuuucccacaaauccagggguugaaaguccaagaucaagguucuggcagauucagucucuggcaagggcuuucuucuuggcuugcagauggcugccaucucauucugucuuaacauggcuuucccuuggugcaugugaacccuguggggaaagaggaggacauagagagagacagagagagagagcauaaccucucugguaucacuucuuaugaagacacuaauccuauuagaucagggccccacacuuauucagagaugaggccucuaaugaagugauuaagauuaaaugagcuaacuaaauuuuucuaaauuugcuuggaguucaggccucccccagaaucagggccuauuucauuuacguuuuuuuaaaacaaacaaacaaacaaacaaacaaaaaacccacacauucauucuugaugagcuuuuugaaaaaauacuuuaaaaaaguauuuuaaaaaguauuuaaaaguauuuaaaaaauacuuuaaaagauauagggcuucuacauuuucucucuuucagaucagaaauccuaagaauugugaaauaccaagcucugugucuuucuuauucuguuuuaaacccuguaaugaucucuuuccauacauggaaggaguucccuauuaacuaaguuucugauuuacucaacugcuuauuccucuuaacaaauuauuaaugcaaaaugaaugaguuucuugacuguagcaaccugcuagcauauuuuuuuaaaaaauugugaacccuuuaaauaaucuuugagcaguuucuucacaaguucuagacaaaaaagcagggaacuaaacuaauguccuuacucugguuaaaaauaaagcaauaauugugacaaauugguauaaucagacuugacagauagaagcuauagaauucauguuagauuucuaucagucugaaaaggauguuaacaauucccagaucacagagagugaaagaauacacagugguggaaacguuuuccucacacaucuguguuuaucaaguuuuaaagucuguuuccuccccuaccauuucuccugaaucuguaauacauugauuuaaaaacaauuaaugcaugacucaaacugcucugcucugaaaggccccauucagaauugucucgguucugguuagcauugaccgaaaacucuaugagauaccaggaauaauaaauuacaacaaacauucauuuuuaauggcaccauagagauuuuuaagagcaaaccuuucuagauggaaagcugagucaauacccugcacaggaauggaucggcuuggcauugcaaggagcagaggaagaaaagguugugugaugcagugaaaagaacaugggcuucaggaguuaaaaugugacuuucucucucucuguuuuuuaauuuauugagacaaagucucacugugcugcccaggcuggagugcaguggcgccgucucggcucacugcaaccucuuccaccugggcucaagugauccucccaccucaccccuugccccaugccauaagugggacuacaggugugcaccaccaugccuggcuaauuuuuguuuuguuuuguuuuguuuuuguuuuuguuuuuuuuuuaguagagacagggucuugcuauguugcccaggcuggucucaaacuccugggcucaagugauccucccaccucagccucccaaagugcugggauuacaggcaugagccacuacaucuggccagacugugaauuucuauucagcuguucuuuuucuuagugaccugaacauguaguauaaucucugagccuugguugcuucaacuauagaauggggauaaaaauaccaaccucgcagaacuacuaugaaaauuuugcaacaaugccuaccacguggcagcacuauaaaaucugacauguaacaugaucuauuuaaucugcugugaggcaaaauagccuuuucuuccuaggccuucucucacauggaggcacucaucuuugggguacucucauuaguagcaccaucauugauaaauauuuacccgacuucugugacaaaggcccuaugucaggagcugccaacacaaauacacuaauauccccauguccacagagagauauguuccaagacacccaguggaugccugacucccaguggaugccugaaaccacagauaguuccaaacccuauauauacuguggguuuuuuuucccuauacauaccuaccugugauaaagcuuauuauaaauuaggcacacuaagacaguaaugacaauaacuaaugaugauaaauagaacaacuccacccuuuccuacugaaguuccugcuagucuuugcauucagaaauugcugugucucugaacaaguuuauucagcauguauggcuguaguccucugcuucuauuugcccagccuuugccacuaauaaccaggagaaucaaucauaucccccagauguucggauaaauugauucacagccaagcagaccaaguugaacacacagguuuuguaacuacucacaguggucuucacagaagacucaugaauaaagggcagugugauauaucuggauucccuauggggauuuuuagcauucaucuucuuuugcucggauuuagugcugaaaucccugggaauagagggaagacucaagcuguguuuauggcuccuuuguuuuggagugugaauugugcaguauaaugcuaaauugcuuuugcuggguaccacuguuaaaugaugauuaaauuuagguuggguauaaaaaugaauagaugucuauuacaaaucuuugggauaauuuaaugauaucuccuuguuuuagauauuuuccuuuuauuggguccuuaaauuuacuugucuguucuuaucuauccugccuacuaagagucuuuccucuuuuauaaugaaucacaacuaccuuucugacucuugggauuacggguuaucacuguuucuuugauggaaggaaagggagaaagcaaugacagugggagugaagggaguuuaacaggaguacaaggaagaugaaaggugaaucacaggccuggugcaauggcucacgccuguaaucccagcacuuugggaggcugaggcgggaggaucccuugagcccaggaguucgagaccaguggcaacauagcgagaccuugucucuacaaauaacaacaacaaaaaguagcugguguucuggugcaugccuguggucucagcuacucgggagccugagcggggaggauugcuugagccugggagguugagacugcagugaauugugaucacaccacuguacuccagccugggcaacagagugagacccugucugaaaagaacaaaaagugaaucagaucauuuugaaaaugauuuuuuuuccagacauaugucuucugcaguauuuacuuaauguuaucauugccccacucaugcugccacaacacaaaugucacaaauucuagauuuuaaaaauauagaaaaacauuaugucucaacuaugauauauuugccauuuucuuaaaucaaacagcaguuuuaguaugugagacuacuauucucucuucauccccuaguauaccucaucuuacacguaauagguauuuaauuuuucucuuaaaucaagaaaucaagcuaaagggguguggaguucauccuugggagagugaggagccauugagaccauauggaauguggaucuccaccuacaaaaucagaaguauaagaaagagugcucuuuuauuuauguuuuugcccuucuuuuuuuguuuguuugcuaauagacuuucuuuuuuacagugcuuucagauuuguagcaaaauugagcagaaauuacagagcguuuguuuauaccucuuaccuccuccacacacacacccucccucacuagcaauaucccucaccagagugguacauuuguuacaauggauggaccuacauugacacaucauuaucacccaaagccugucauuuacauuagguuucacucuugguguggcacauucuuuggguuuugacaaauguauaauggcauguauccaccauucuaguaucaugcaaaauugguucacuguuauaaaaauguucugugcuucaccuguucaucccucccucuccacuaaccucugauaaccaccgaccuuuuuacugucuccaugcuuuugccuuuuccagaaugucacauaguuggaauuauacuauuuucacauuagcuucuuucacuuaguaauaugcuuuuaaguuuacuccaugucuuuucguggcuagauaguucaucucuuuuuaguguugaauaauauuuguuuggagcaucuuuuacuuuuauauuaauugaauuucaaguccuaaucauuauucccauugcauuagugguaaauuauaccucauuacuucuuuuuaaaaacagcuuuauugagauguaauucauauagaauacaauucaucaauucaacuauuucaaaugugcaauucauugguuuuuaguauauucauggagcugugcaaccauuaccauaaucaauauuagaagauuugcaucaccccaaaaggaacuuaguaccaguuagcuauuacuccccuauuacucuccaucuccccugucccccauaccuggcaaaaacuaaucuggcuaucugucucuauagauuagucuguucugaacauuuuacauaaauggaaucauaaaauauauggccuuuugcaucugccucuuucaguuagcauguuuucaagguucagucacauuguagcauggaucaccacauuacuuuuuauggaugaauaauauuccauuguauguauauaccacauuuuguuugucuauuaucaguugauggacauuuggguuucuuccacuucuugguuauuaugaauaguguugcuaugaacauuugugcacagaucuuuguguggauguauguuucaucucucuugggaauauaccuagcaguagaaucaugggucauaugguaacucuauauuuaccuuuuugaagaacugccaaacuguuuuccagugaagcugagcaauuuaacuuucccaccaacaaugugaggguuccaauuucuccacauccacaccaacaauuguuauuaucuaccuuuuucuauuacagccauuguaguggauuuuaagugguaucucauuguaguuuuaauuugaauuucccuuaugauuaaugauguugggugauuuucaugugcuuauuggccagaucuuuuuugguaaaacgucuauugaaaucuuaaauuuuaaacugggcuauuugucauuucauuguucaauuguaaggauuauuuacauauucuggauacuagacccuuaucacauacaugauuuacuuuuuuuuuuuuuuuaaacagggucucacuaugucaugcaggcuagaaugcaguggugugaucacaucucacugcagccucaaacuccugggcucaagcaauccucccaccucagucucccaaguagcugggacuacaggcacacaccaccacaccaggcuaauuuuuguauuuuuuguagagaugagguuuuaccauguugcccaggcuggucuugaacucaugggcucaagcaauccaccccccucagccucccaaaguguugggauuacaggugugagccacugcccccagccuauaauuauuuucuccuauauucugggaugucuuuucacuuuccugauaaugucuuuuuaacucaaaaauuaugauuuugaugaaguucaauuuauauauuucuuuaugugucauaucuaagaaaucacugccuaauccaagggcauaaagauuuauaccuaugauuucuucuaagaauuuuauagaaucagcccuuaaauauaggucuaugauucauuugagcuaauuuuuguauaugguaugagguaguggcacaacuucauucuucuauauguggauauccuuuugucccaaguuccauuuguugaaaagacuguucuuucccccaugaauugucuuggcacuaucaucaaaauucaauugaccauaaauguauguaggguuuuuuuugacucucaauucuauuuuauugaucucuaugucuaucauuaugccagugccaugcugcuuugaauacuuuguagcaaguuuugaaaaugggaagugugaguucuccaacuuugcucuucuuuucaagauuguuuuggcuauuuggggcccccugcaauuccauaugaauuuuaugagcaacuugucaauuuaugcaaagaagucagcugagauuuugauagcgauuguguuaaaucuguagauaauuuaggagguauugccaucuugacauuaagucuucuaauauauuaaugucuuuucacuuauuuauaucuuuaauuucuuucaaugauguuuuguaguuuucaguauaaaagccuugcacuucuuuugcuaaauuuauuccuaaauauuaucaucuucaaguuauuguaaauggaauuguuuucuuaauuucauuuuggguuauuuauugcuagaguacauaaauugauuuuugcauacugaucuuguacccacuagcauuacugaacuuguuuauuaguuuuaauuguguguguguguaagugagugagagagagagagagagagauugucagucuuugguguuuucuauacacaagauaacauuaucugcaaauacagaugcauauacaguuucauuucuaccuuucugaccuguaugcauuuucuuucuuuuucuuuccuucccuucuuccuuccuuccuucucucuuuuuuuuucuucuuuccuuuuccuuuccucauugcucuggcuugaaccuccaguacaaugucaaauagaacuagcaacaauggauaucccugucuuuuuccugauuuuaggugaaaagccucagucuuuucccauuaaguauaguauuagcugugacuuuuuuauaaauacucuuuuucaaguugaggaaguuccuuuguauucccaguuuuuugauuguuuuuauuaucaucaaagcauguuggauuuuauuaaaucccucuuuagaaacugaugagauaaucaugggaauguauccuuuauucuauugauaugauauauuacauugauuaccagauguuaaaccaaccuugcauuucugggauaaaucucgccuggucaugguauaugaugcuguuuauauuuugcuggauucaauuugcuaggauuuuguugaagauuuuuauaucuguccuuaugagaaauauuggucuauaguuugcuugugauuuuugucugcuuuugguaucaggguaauacuggcuucauagaaugacuugggauguauuccuuccucuucuaaagaucuucuauuuggaagaguuucagaaggauugguauuaacuguucuuuaaauguuuuguagaauuugccaguaaggccaucugauccuaugcuuuuuuuuguggaaaguuuuaaaaguauuaacucaaacucuuuguuauaggauuauucuaauuuuuuauuucuuccugagucaguuuugauaguuuuuagaaaucauuuuggaauuuguacauuucacaucugcuaucuaauuuguuggcauacaguuuuuuuuaauauucucuuauaauucuuuuuauguauauaaggccaguaguaauguccccccucuuucauuccugauuauaguaauuugaguauuuucucuuuuuuuguuggucagucuagcuaaagguuuaucaaaccuguugaucuauucauagaaccaacuuuugauuuugucaguguuucucuauuguuuuucuauucuagauuucacugauuuucacucuaauuuguuauuuccuuccuacugcuugauuuauguuuaaugugcucuucuuucuagugucuucaggcaacaauuuagauuuuuuaaaauuuuuauuucaauagcuuuugggguacaaguaguuuuuuguuacauggaugaaauauauaguggugaauucugagauuuuaguccaugaaucaccagaguaguguauauuguaccuaauguguaguuuucuuuuuugucucuggcuuuccuuucacccucccccuucugagucccuaaaguccauuauaucacuuugcaugccuuuguauauacucauagcuuagcucccacuuauaagugagaacauacaguuuuugguuuucuacuccuuuguuacuucacuuagaauaauggccuccagcuccauccaaguugcugcaaaagaucuuauuucguuccuuucaauggcugaguaguauacucagguugagaccaaccugggcaacauggucaaacucugucucuacaaaaauacaaaaauuagccaggugugguggugugcaccuguggucccagcuuuacgaggcugaggugggaguaucacuugaggcuggggggucgaggcugcagugagccgauugugccacugcacugcagccugggugacagagugagauccugucucaaaaaaacaaaaggaagaaagaaaugugaacucuugauaccaagguucuguaguggauugccuccaaagaacugaauuagaggcccaagcaaggggaaagcugcacagggaauggaggaauccauucacuuuagaugccaauuugggugauuuagauccucuacagaucucuuucuccugaacuguguauuuguuuuucuuuuucuuuuuggccagaaauuaggaggugguaggaugagugaagccaucuguauaucugcccuaaucucuccaucauuuugcuugacuagacuuaucauaaggaugauuaaagguuucucagcacuugagaauugcuuauuuuuuuaccucaccuuugccuuuuaaagaagaguuaguuaucauuuacuuucccauccaauucuucaguuuccuuagucaauuaauuccaugccuauccuguuuguuuaagguuuggggcagcccagacgaacuaaccuagaccucugauuuuucucagguuauaaaugcucuguguucccucauccauucucccaacuuugauuuccaccuauuacucuggcuuugucaguaaguggcuuaagauucaaguucccuuuuugcuccuuucaugagcccgccagucagacucuguguggaugcugcuuucuuuuuucccagauuuugugauugggucccugaucucauguuucauagauccuuaucugggucucugaaccuugcauccugauuguacaggacaucagucuucccaggaucuaaauuaccuaccuguuucuccuuuauuuccuucacacacuucucuuaauacagcauuuagacuucccagcuuaaguauuagccagaaacccuaucucacguccaccacagccaacuauccuggauccuggccuuggauuugaaagugacagcaaaagaggaagaacaaaauacucauugaaugcaauuuguaaggcaaugcauaguuuucaagaagcagcaagugaagacaucuauugggggagcucuacucugcagaaugaaagaggcuauuggaugaaaaaggaaacaaaccuaucagcccagcaacuaggaaggcuuaacguagacagggcagacauuuccuuguuuugucuuuucaaggcagaauagggagauuuaguugguuggguguaguagacaaaccagcaaaguagaaaagugaggguuagaaauauggcaaaguaaucaagugagauauggcugccuuuugugaagacaagaaaaacaaauacuaaguggguacuuuuguagcaucuacaaguucuaugaucaaagaaaaaauguaguagacaaaccagcaaaauagaaaagugaggguuagaaauauggcaaaguaagcaagugagauauggcugccuuuugugaagaaaggaaaaacaaauacuaaauggguauuuuuguagcaucuacaaguucuaugaucaaagaaaaaaaucuguaaauacuucaagaaguuugcuuuuguacuauauggcuaauuuaaaaaucaacuuacaggggaaagugaaaugcuuaagucuagaaauauagauaaauaguccaaagucacccaugcacacauguccaagaaaggccauaugaccuggaaauuuuuuuuggauuagccccauggcauuuauauaaaccaggguucuucucuguuagaggugccaugggagguauccucugaaauuacaagcuucccuuaauggucuguucuucaaaacauccuagagaaauacuguucuuggauuaggaccuuuguuucuguuaucaaaauuuucuccucaucucugauccuguaaaguauccucacuuauccuugucucuccuuccucuuaccuaaaguuugugguuuuuaaaaaaucauuucuucuuuacuuuccauuuagaaguagagaacgacaucuggaauggcccucaaauaucuaguuuuguuucuucauuuugaagacuagaaaacugaggcauaugauuuaaggcaaaggaauugccaaagaucaaccaguuaaugucaaaccagaacuaaaacauggcuucuggcaauaacaccaguauucuuucugccauaccuuccuuuuuuuuuauauaugacauuguaugcuucuaaggcuuauuuuuagacuuauuguaucuucugcuaccuaaaaauauucaaauuagcaucuaagaugcuucuugauuuucucugcuuuuugauuguaggauuccuagaaaucacaauagaugcaacauuaguauguauuucaaugcacagacuauuaugagcauuuuuaugugaaaaagagaaauaaaauaggcagaagaugacauuucuugccaagauauuuucggaucuguguuuuuacagguuaccugagaaauuguuuaugaugaaggaaucaaauauaaauacgcaguugagacuaggagaaccucugaaauacggcucacuauagaaauagugaauaaaaacuuucagucuuguuucucucagcuuugacuguugcauaagucuaagcaaaucaauauaaaaguguuucucaaaaugugcuucaguuauagccaauuaaaggucaacauauauaauuuacaugaaauggaugggcaggaacaaaagguaucuguugggccaugaggaaugauucuauuucauuugcagaugaguacuauaaaggucauugaaaaugugagaugcaaaucauuguuuuuuuaauaaagcauuuuuucuagguuuggucucucagccuguuuuauuuuguuguuugcaugcaugccacagucauuaguacaauugaauuauagaaugaccuacacuauuagacuguuagacugcuugauugaaauugucuuuauaauggaaaucagagaacacuuuuaaccuuguuagagcaucacuguaucguugauuaauauauaaagcaauucauaaauuucacagugagcuauuuauuuccagacaaucuugugaaagcacuuuggucuauauuacagaaacuuucuuuauaccuuugucaggcugacauuaaugauucugauuauuucuaggacuuucaaaguaucagcguuaauuaaacuaaugcuuaaaaauaugcguagaaaagaaccuuugaauguuacauuuaaauguuugacaauguguaugaagauucuuuuguuaccugguuaauuuuagagaacugacuucauuugauaagguuucuccccaguagcaaaugcuuagcuaaguagcaguagccaauacugccaaggucacagcuucgucuauauacucaauacauauuuguugaguacuuuugauauguucuucacuagauauguaauacagauagagagaugaaaaagccagcaccugcccucaagagaguucauagucuagugagagucacagaaacagagaucagccuaugcccaggcauuaugaucgcacagauuaagggaguauuauuuaacccagccuggguaggacagggaacuuguccuagaggaauucccccugaaugaaaacucuucuaaccacugaaggggugagggaagggucugugagaaauagaugacugcugggaaggaacaaaggaaacuuagggcuuggguggagacugaggaauaauggagggaauaggguccuuuuuacuccaguccggaacucauuugauggcccagauacauguucugagcaguaccaaaccacucaaauccugagaccuaacauugauccugggagcaaggaugcuguuauacugccuucccugaagccccacuaaagauggcucuggcagcaagaggguaacaugguggcuagagaagucaggccucccacacuggaccagccaccugcauauaugggagguuuggacacaggagcuuauaagucugggaggcccuggacuaguuccagaaaagaaaacaaaagguuugggagugaaaaaacugguccuuuuucuaaagaaacuguuuucuauaaaaguguaccuuugcuuuuagacuauuagggggauauagaacuaauuaagagaccugaacaucaucaauauuuuucuacuuaacuuuuaugaguaguuaauuuuauaaaagccucugugaagucacugguggaaaagcuaaugcacagcuuuucagcauauugcccuucaagacucagguuauauuuaaucauaaauugcauacaaauagcuaauugcuagcuucugcaguaaaauguauuuguugucucaaauuggauucauagccacaaaagucaagccauagccagucuuuguagaggacauugcuaaaggagauacuaagccaaaugaccugcauagauacagugcugagaggccacuaggccggacugguggacuuuaaguuagcaggaauagaguuggauaaacauauugaguaggggguguucuaaaucaacacuuugugacagcagagauucauaugaugacuucugguucauauuugagaauuacauauccuagaagguaacuguguuuccuaucuaaauucuccuccuucaucuucuccuucuuuccuucacuccuucuuuccuucccuccuccuuucuccuucuccuucucauucuucuucaagaaaaaugcacugguaagagcagauugcaauguccuuuuaagggaaaaccugcuacaggguguuuugucuccagaggccaaucuuuagcugaucugagaagugaagccaaaagggucuucauugacacguaggccacuggcauggguguguagcuguuugcauguggggagaacugaagccagccuugcaccuuucccuugccuuuaagauagguugcaggacucaaaguggaaacucaguaaaacuuucagaagcaaauaaauggaaccuagaaggcuuguuuccuugggcauggggaggcaccauaugucagcuucacguuuuuaaucaaaaggccaaggcuucaucuagauuguaguaauaaguauuugcuuuccagagauuuucauugaaaugacaaaugccuuuccuuuaacuauuucucaugcuguuuccggugaucagagacaaauucagaacaaaaaaaugccuuucagaauuuuguauaauuuccuuuaugaugugcuaucauuaucuaaccuauuuaugaggaaguaguuauaacauuugauugccuaagaaacauuggaacccaggcuguggccacaguggugcuacuugcaagauccuuagagauuauuuaguccaaucucauucuuuuaccagugaagaaacagauaaccagauggggagaugcauguagaggagaacagggaucuggaaauaaccauggcaaaggagucaaaaggaagaauaugaaguauguuaaaaguugccacauaucacuuuuuuuuuuuugagacaguguuucguucuuuuugcccaggcuggagugcaauggcgcaaucucggcccacugcaaccucuacuucccggguucaagugauucuccugccucagccucaugaguaggugggauuacaggcaccugccaccaugcccggcuaauuuuuuuauauauuuuuaguagagacgggguuucaccauguuugccaggcugguuucgaacuccugaccucaagugauccacccaccucagccucccgaagugcuaggauuacaggcgugagccaccgcacacagcccacauaucacuuuuuaaaauuuuagaagauggugugagaagguuggcaugucauaaagaugggggagaagggaacugcagcuuauuaagugccuuucauguaccaaacuuugugcuagacacuucauauauauucauucauuuaacccucaccacaaacacauaaaguggaacuucuuauuucccucauuuuacagaugaggaaacugaggcuuagaggaguaaaauauugccuuucccuuauugccuuucccuuugagaagaagcaggagaccuggaaacagaaacucaagucaagcaucuugcuuccuggcccauguugcugagucuguaaccuaggagcaaauacaaggaacauacaggugucagucaugaugucaauaugcagagaggagcaaaucagaaaguaggaaauccaggugcggagggaguuuccugauaggaagagcacaugggugcuccagcuuuuacaguggccaguguggccacucgguuuguuuuuuguuuguuuguuuuuguuuuguuuuguuuuguuuuuuggagaaaugagagccaacagaaagauuugugaaccuggaagcaggugggaagaaggggagaaggaauauuugagcacaugggaucaagaguaggaaggugagguaauaagagagugacugccugcugagagggacuccauaagaagagguugagagaguuggcagaugagugauuacggaagugaauaauuaggggacagcaaaaagacuccagggaauuccuaacaggcugguuugcuccuuagacauuuguacaagcaguauuuuuagagugaucgagacaacugaaugcuaacuucauguagucauugcuacuuccugugucuuuauuaucauuauuugcuuuuucaguguuuaugaugacucauuaaucuggauucccugucuuacaguugauauuugagacaauguccuaagggagcccuacccagcagccuuuugcagaggaguuguaaccugaaugcuagguuuuuuuguuacccagcugccaauguuuggaucaaaacaauccauuucugauucauguauguuauuagcucuggcaggauggcaggacgugaggcagauacuguuuuguauauuacagaaaccuagauaagcaaacagagaaugaagagauugccuuuauuagaaaagcaaucuuuugcgauauuucuuagcaccaagcaaugaguuuuuaauaaaaccuaggagauagagcguuuauguaucuagucucacuccccuucuuugaaucuagauauaugugauuucaugaugcuagcaagaggccugcugauuugucaguucaucaaaaguugcuaaaggaaagccaacacaaaagaagcuaaucaucaucuugucuuuucccagugacucuauuggacuucuagugucugagcugccuguucuccauggcaguguuaccaacaguaguaccugcgcccuaguuguaaagggugagaaucucauuuugucucucuuccucuugauaauaggcugggggccgauuccuuggaagagcuggaagaauuauuaacacaaguuauguguagccaaguguugcuuuuccucccuuguuuggucauauucacaauaacucauuuuuuaucacacuugcccuccucuagaccuaugucuuugaggcucuucucucacucccuguaagucaacuccaagaugaaguaauuugauuuucuucagguggaacaauguguuucaggugucccuaguccaaauggaauugugcagcugccaugcaaacuguggaaacagcauaauugugucuacuaauauuuuguaauaggaaucacugauauuguucaggcaauacccacaugggaagaaucugauguuacaacaggauuuuuuucuuuuuuuauaauaauagagacagggucucccuguguugcccagacgggucucgaacucgugggcucaagcgauccuccuaucuuggccuccccaaagugcugggauuauaggcaugagccacugugccuggccagaauuuuugccaaaagcaccuuuccuucuuagaaucaacuugcuuugagaauucucuuguguuaugugauuuguccacauugaaucaguagcagaacugagauuauuuauauuaacaauauucugggcaucauaaaagggcaucugaaaucaauggaagacucucuguugcuuuacugacccucaaaucuguucuggaccccaacugccugagguaauguguuguccuaacagacugcagccuuucugaccugauaauaccuaucaggagccccaugcaugaccuccaaacagcuauuucuuuauuuuucguuuaucuuauuacuaugcucaauuaugaagacuguuaaaagauuguggcacaaagagcaaagcucuuguccaaguauuaccuuuauuauggcuacugcaaauucuucaggaacaaaauggcagggugauaggaaaaggaggcauccucuauuuucaaagggaaauuacuucccauuccuuucacuaguccugcucuuagaucaauagaauuauaagauuccagaguugagagugauauuuaauucaaucccuuucauucuauaauugggggaacugagacccagagaagagaagggaccuuaccaauggcaugcaaucucaguagcaggcuagcacuguagacuuuguuauucacaucccaaauucggugucccagaaagaaugauuaguggcuuuuaaauuucaaacuggggcuccuaagauacauuucaagcaaagucuucauuauucuucagcauaaagaaaaauagagccuccuccuuagcccccauguccaacuggagauucuuauaauguagguaucacuugagacgauucauucuuaagguaggaauagagaaaacacuuggucaggucuguuucucuuucuguuaauuauuauuuccaucuuccugaagaccauagcuucuaaguaauuaccuucagcuaguugaaucuuugauccucaguuauucccaaaggguuuccucaaguaaagacugcgagcaaacgcauuaggcuuugaaguuguagauccugguuucagggcccuguuuuguccauuacuaguuguguggccuugggcaaucacuuaaccucuuggaaccuaagcugauaaaaauaggcaugauaucuuaccucacagggcugguuacaaagcuccaugugauaacguaauguggacaagugcuuuguaaagaauaaaggacuuugcccaaccuaaguguuaguuaugagaauaucuacuauauguauuucacgaaaguagucugggaugcccucaguuccuucugcacagcaauaaaacagcuaucucuugauuauucacacuaaugauaaggaaaucuguuaggccauuugcauugcuauaagggaauaccugagucugaguaauuuauaaagaaaagagguuuaauuggcucacgguucugcagacuguacaagaagcauggcaccugcaucugcuucugaugagggccucaggaagcuuccacucauggcagaaggcaaagagagagcaggagauuucacauagcaagggagggagcaagggagagagggagaaggugacacauucuuuuaaacaacgagaucuugcaugaacucagaacaagaacucacucauuaccucgaggagggcaccaagacauauaugaaagaucugcccucaugacccaaacaccuccuaucuggcuucacuuucaacaugggagaucacauuucaacaugagauuuggaggggacaaacauccaaaccauaucaggcgaggagcacagauaauacaaaacagaaacauucuaccauuuguguuuguguuuaaaauacauuuaguuuggggaagccucugaacucuguuugcugaaagugaaauucaacugaggaagaauuccagaagcaggccaugugcaagucccugcccuuuucugggccucaguucccuaccuguagaagggagaauugcccuaacuagucacacagucucugccagcuccgauguccaugugucugugagucuagacauauggaaggcaacaggggaaagccaguuuuagaugaugcacaaaguuuuauugggcagcugaaguugugcaaauacuaggggggaaaucacaagcugccaaaauagugucaccucauugauagaauggacaaagagagaagucaauucuaaguggaagaaaccaugacugacauuuuaggaacugaucaaaagaagcgaucggaggaaagugaaaauaacaucuguagacaggaaggcccgggacgauagcaauguguaaugcugcugucacagagggaaaugugcaagaugagucucuuugugcuguuuuuguucaggggucagacucuucucaauucaccugauuuuuuuuuccucuccuuucaaucauauccuuuucaaaauucaucucagaaguguuucucagccauucugauuacaacuuuugcuaaaaccaaucagcagaggucugcuuacagugcaaggcaaucaacagagacccaagguauuggucagagaugauaucuucauuuagauggacuguggcuaaucggauuggcugaaguuacaaucagagcaauuuugcaacagcacugcugccuaccagguacaaagcuuccuguacaauuuuaggaaugaugcccgguuaaauauaguguuuuauacuauuugcaugacaaaugaauuaugaaaacgacauauguugcacuuuaauauuuuccuuuauagccuguaauacuccuuuagccuuuaauaauugaaugacagugagaaaauaagaucaaaauuuggccucuucuaacauaccgugcuauguggugguauccuguacucugaaccuuguaaauuggaaaggcagugacauuguuuuaugugauuugggguucugugauagggugguauguaauguuccaugauagucaauccugguuuuauaugccauucccaugcauucccagaaaaaaacaucuuaaaucagacucaagucuuaauuguauaugauaaauaggaacagacaggugaauaguaacaaacuuugaaaaaugaaauacagguacauauuagucaauaucagauaaguuacagacuauaaaggggcucaucagacuguauccguaugcauaauaauauuaugauuuuauuguugagguguaaguguuccuuuuguauuuagaguacuagauccuuauuagauauaugauuugagaacguuaucucucauucuguagguugucuuuucauuuucuuaauaguuuccuuugaagccccaaagugcuuuaauuuuuaugaaguccauuucaucuauuuuuugcuuugguuauuugugcuuucauugucauaucuaagaggacauugucaaauccaggauuacaaaaauguacaaaauuuuuauuuaagaguuuuacagauuuagcacuuaauuuuuauuuaauuuugguauauggugugaaguagggguccaaauucagggguauguuacuggaauagccuugcuaggauucuguuggggauuuuuaagccuaucuucauaaaugauguuggucuguaguuuucuuuucuuaggaugucuuugucuaauuuugguaucaggguaauacuggccucagagaauggguugggaaguguucuaccuuuucuauuuuugggaagaguuuaugaaggauugguguuaauucuuugaauguuugcuaaaacucaccagugaagccucuggaccugggcuuuuuaaauuaauaauucagccucuuuauuuaugaaucuauucauuuucuauuucuucuugagucuuucuaggaauauguccauuucaucaaaguuaucuacuuuuuggcauaaaguuguucauaguauucucuuaugaucauuuuuuuuuuuuauuucugugaaguuacuaguaguguccucgcucucauuccugauuuuagugauuugggucuuuucucuuuuuucuuuaucaaucuaccuaaagguuuaucaguuuuguugaucuuuucaaagaaccagcuuuuacuuuuauucauuuucucuaauguuuuucuauuaucuauuucaguuauuuccauuuuagucuauauuucugucugcuugguuuggguguuuacuuugcuauuuuuuuuuuucuaguuucuuaagguagaagcuuaaguuacugaguugggaucucccuucucauuauuuuuuaaaaauuuuuauuucaauaguuuuuggggaacaggugguuuuugguuacauggagaaguucuuuaaugaugauuugugagauuuuggugcauccaucaccugagcaguguacacuguacccaauguguaguauuuuauuccuuaccccccucacccuucccccugaguccccaaaguccauuauaucauucuuaugccuuugcguccucauagcuuagcucccacuuauaagugagaacauacgcuauuugguuuuccauuccugaguuacuucacuuagaauaauggucuuuauuuccauccagcuugcugcaaaugucauuauuuuguuucuuuauauggcugaauaguauuccaugguguauauauaucauauuuucuuuauccacuuguuaguugaugagcauuguauuaguuuguuuucaugcugcugauaaagacauacccaagacugggcaauuuacaaaagaaagagguuuaauggauuuacaguuccauguggcuggagaagccucacaaucauagcagaaggaaaggaggagcaagucacaucuuacauggauggcggcaggcaaaaagagacagcuuguacagaggaacuccucuuuauaaaaccaucggaucucaugagacuuauucacuaucaggagaacagcaugggaaagacuugcccccaugauucaauuaccucccaccagggcccucccacaacaugugggaauucaagauaagauuucgguggggacacagugaaaccauaucaggcauuuagguugguuccauauuuuugcaauugcaaauuaugcugcuauaaacguguguacaagugucuuuuucauauauuggauagauacccaguagugggauugcuggaucaaaugguaguucuguaaggacucuccauacuguuuuccauaguggcuguacuaguuuacauucccaccagcaguguagaaguguucccuuuucaccacaucuacaccaacaucuauuauuuuuuuauuuuuaaauuauggccauucuugcaggaguaaggugguaucucaucgugguuugaauuugcauuucucugauauaauguugagcauuuuuucauauguuuguuggcuauuuguuugucuucuuuugagaauugucuauucauguucuuugcccaccuuuugaugggacuauuuguuuuuucuuucugauucgaguuccuuguagauucuggauguuaguccuuuguugaaugcagaguuugcaaauauuuucucccacucuguggguugucuauuuauucugcugauuauuuauuuugcuauacagaagcuuuucaguuuaauuaggucccauuuauuuauuuuguuuaaaguccuucucuuuaauauaggcauuuacagccauaaauuuccuuuuuuuuauuuuuuauuuuuuuuuauuauacuuuaaguuuuaggguacaugugcacauugugcagguuaguuacauauguauacaugugccaugcuggugcacugcacccacuaacucgucaucuagugggugaaggacaugaacagacacuucucaaaagaagacauuuaugcagccaaaaaacacaugaaaaaauacagccauaaauuucuaagcacugccuucucuacauaugauaauuuuuguuaaguuguguuuucauuuucauuuaccucauaggguuuucuaauuucccuuaucauuucaucuuuggcccauugguuauuuaggaguauguauguuuaauuuccacauauuugugaauuucccaaauuuucuucuguuauuguuuucuaauuuuauuccauuguggucagaaaauguaugauuucaaacuuuuuaaauuugagacucguuuuguggcccaacauguacccuguacugaagaacguuccacguguaguagagaauuguguuuuaccacuguuguauggaguguucuauagaugucuguuugaucuaguuggcuuauaguguuguuaaaaucuuccauuugcuuuauauucugccuaguuguuugaacuauccauuauugaaaguggggaauuggagacuccaaauauuguuuuuguaugaucuauuucucccuucaauucugguaguuuuacuucauauauuuugggcucauguacauauauguugauaauuauucuaucuuccugauagauugacacauuuaucuuuauaaaaugucuuucuuugucccuaguaacaaguuuugucucaaagucugguauuuuccccaacauuaguacagccacucuugaugucuauugauucuaguugguauaucuuuuucuauccuuuacuuucaacguauuugugucuuugaaucuaaagugugucucuuguagacagcauagacuugcaucauguugguuuaaaucuauuuugcccaucccugccuucugauuguaguguucaauccauuuguauuuaauguaauaaaacgaguaauaaugaauaaguaaugaaauaagguaagauuuauaucugucauuuucuacuugauuucuaaaugcuuuaugucuugcuucucaguuuguccaguauugccuucuuuuguguuaaauaguuauuuucuaggguaaugguuuuauucuccuaucauuuuuaaccauauuuuuaaaguuauuuucuuagggguugcccuggaaauugcaacuaacauuuuauaacaaucuaauuuggauuaauaccaacuugauuuuaauagcauguaaaucccuuuuuuucuguaaagcuuaauucccuucccccuucuugugcuguuacugucauacaaauuacauuuucaaacauuguauuccgaucaacacagauuuauaauuauugcuuaugcauuguguuuuaaaucagauagguggaaaaaagaguuauaaccaaaaauauauuuauacuguuuuccauauuaaccuauauaguaaacuuuguggauguuucuucuuucuuucucuuuuuuucuagagacagggucucacucuguugcccaggcuggagggcaguggcacaaucauggcucacugcagcuuccaccuccugguaucaagcaauccuuccaccucagccuuauuucuuugugugaauuacauuacaggaugcauacugaaggacuccuucuaguguuccuugugguauauauuugcuagugauaagcucucucaauuuuucuuuaucugggaaugccuuaauuucacuuucauuuuucauguauacuucugaugaucauagaguucuugggugauguuuuuuuccuuucagugcuuugaauauaucauccuguagcaggacaagccacagacaaaaccccucagacaccgaguuaaagaaggaagggcuuuauucagccaggagcuuuggcaagacucacgucuccaacaaccaagcuucccgagugagcaauuccagucccuuuuaagggcucacaacucuaaggggguccucgugagaggguugugauugauugagcaagcagggggugcaugacugggggcuucaugcacugguaauuagaacggaacagaacaggacagggauuuucacagugcuuuucuauauaaugucuguaaucuauagauaacauaaccaauuaggucagaggucgaucuuuaacuaccaggaccagggugugguaccgggcugucugcuuguggauuucauuucugccuuuuagcuuuuacuucuucuuucuuuggaggcagaaauugggcauaagacaauaugagggguggucuccucccuuaaucccauugccuucuuguguuuauacuuucugaagagaaagcaacuauagccaggugcgguggcucauaccuauaaucucagcauuuugggaggcugaggugggcagaucacuugaugccacgaguuugagaccagccuggccaacauggugaaaccccaucucuaccaaaaauacaaaaauuagccgaucuugguggcaugugccuuguaauuccagcuacucgugaggcugaggcacaagaauugcuugaacccuggaggaagagguugcaaugaguugagaucacgccacugcccuccagccugggcgacagagcaagauauugucucaaaaaauuaaaaaacaagaaaaaaaaagcaacuguuaaucuuauugagggcccuuugaaugcaaugaauuacuucucucuugcugcuuucaagauuaucuuugucuuuugacauuuugauuauuaugugucuacuuggaauucacugaguuucuuggauguguggauuaauauuuugcaucaaauuugggaagcuuuuagccauuauuucuucaaguacucuuucugccuuuuucuuucucucuucucucucugaaacuuccauuauauguauguuggcacacuuacugguguuccacaggauucugaggugcuacucauuuuccuuaauucuuuuuucuucaucuuccucagauaggaaaauuuaaauugaucuaucuucaaaugugauuauuguuucuuuugcaugcuaaaauuuccugcuaagccccauuaaugaacuuuuaauuuuaguuauuacaauuuucaauuccagaauuucuauuugguucuucuuaaaaaaaaguaauuucuaucuuuuugccuaucaaggcaucauucuccuaccaucuuuuaguucuuuaggcauuguuuccuuuaagugucugaacauauuuaaaauggcuaguuuaaaguuuuuugucuaauaaagcccauaucugggcuuccugagagacagugucuguugauugauuuuuuuccuguggaugggccaugcuuucuuauuucuuuacaucucuuguaauuuuuuuuugucaaaaacuagauauuuaaagaauauaauguaguaucucuggaaaucagauucuccccuauccucaggcauuguuguugguguuuguuauuguggugguaguucuuauuucuuugucacuuuucucaaccaauucuguaaagucuguauucuuugucauguguagccguugaagucuuuguucaguuagcuuagugguaguaaguuaaugauugaacaguguuuuccuuaacuuucuggaaccaguaagucucucagucuuugcugaagugcucuuuguguaugcugggcacaccuuuaacauucagccuagcaguugaagacccugccuuagccuucacuuccuugcacagaaccucaaggucagucaaaggugagggaauagggcuuucucagaucuuucuugaucuggcaugcacacagccuuaugcuugaguguaacccacuagauccccaggaauauguagcuuuuauagcacuuauggacaucucauuaccuggauuuuccugaaaauuuuuugguuagccuauuauuugcucuaacuauuguccccuugcuucaggcagcuacaaaguaaaauaauuaccucuaauugaguucagcagaugucuccagggaaaaggcuuuugcacaggugagcucaauaucaguucaaauaaaaacagccuugcaaaugggguauuuuagguaaccaucagacaggucaaauaauuacaguuuacugaguguagcuuugaaagaacuccaaccugucagaguucucuagagagacagaacuaauaggauagaugcauauaugaaagggaguuuauuaaggaguauugacucacacagucacaagaugaagucccacaauaggccaucugcaagcugaggagcaaggaagccaguccaagucccaaaaccucaaaaguagagaagcugacagugcagccuucagucuguggccaaaggcccaagugccccuggcaaaccacugguguuaaguccaagaguccaaaagcugaagaacuuggagucugauguucaagggcaggaagcauccagcacaggagaaagaugaagaccagaagacucagcuagucuggugccuuccacauucuucugccugcuuuauucuagucacacugacagcugauuaaauggugcccacagagauugagguugugucugccucucccaguccacugacugaaacguuaaucuccuuuggcaacacccucacagacacacccaggaacaauacuuugcacccuucaaucuaaucaaguugacauucaguauuaaccauuacaaaccccauucugcucccuccaguggcugccaggaugcuagauuucaccaugaaugugggcuguuaguuuucaaaaguacuucagaacuggagaggaggaaugagaauagggaaguuaaaaugccacaacgcucacuguuccuacugacauucagccauuuucuugaauaaaugcuucucggauugcugcaaauacuuuuauuaaauuccagagcuccaaagaaguugguucugaauguuuuugccaauuuucucauugcuuuuauggaggagcacuuaaaacacuguccagcacauaguaggugaugaauuaauauguuauucauuaaugccauuuuauuuauuuauaaauaauuuaauuuauaauguacuuauaaauuauuauuuucagauuauuuuggauguuaguguagagcagagauuaugguaucaggacccuuuacauucuuaaaagcuauacaggaccccaaagagaugucgauggaguuauaucuauuguuauuugcuguauuagacauuaaaacuaggaauauuaaaaguauuuacuuacuaauucauuuaaaguuaauaauaaaggaaucagacacucauauguguuuuuucaagauaugcuuuccaaaauaaaauacuuuaguggaaagaauaccauuguuuuacauuuuugcaaaucucuuuaauuuuuuccuuaaugguagacagcuggauucucguaucuucuucugcacucaaucugguuugacugaggaaaauuuggucucacaaauauauacaguuggaagaagaacuguguccuaauacccuuuuuugacaauuagggauauuuucucugauacuguacaagaaguuggcaagugauacuuucuuaaagguuaguuacaauauggaagcugcaaacguaucaauugacuuuucauuuucuguuauguuaaaaucuaucuuacacuuugggugaauuauuagucauugugugauuuuuccauuaugaugccuuggucauuugaaaaauuuuggcucacugaguuaugccgauuuuccaaauauuaacacacuucauuauauaacgucaaaacucauauucauuagugucaccucuguucucaucagaaaagccuucagguauugggaagcugucaaguuucauaguagaagauaacaaguuuucccaaauucuaauuuucaccugaaagugcaaauucuaucauuggcuaugaacacugucaguuguuuuccuugaaguaacaggcuugcuuuguucauuuccaagaaaaugccuacaaaauacuugaguuugaauaagaguuugucugucaguuuuucuuucaaguaaaaauaguguuacauuuaaaaaguguucaguucaucucacaagucaaucacacuugugcuuuuccucuagaugaccaucauacuuuaguauguaccagaaguacuuuaugcauacuucccauuucaucacacauaauaucaaaaaagacauguagucaagggugaagauuugaugaaauuaacuuuuacugccucuucaaguauauucuuaagugaaacuagcuuuuuuuaaaaugugugugcuuggcagugaaaacuacaaugacuacuauugcaguuuggugucacuacccugacuuaugauaaagugcaagcaguuuuacccaccauagcuuuugcaucagugcaaauuucaucacauuuguuugagggaaaaccaugaauuuuaacacugcuauuuaacauuuugaauauuucagcaccacucaugguuuuuuuucccaaagcuuucacauaauagaucuucuuuaaugauuaguuagugcuuaauacuggaugaauauaagcaaaacagcaauuccaccccaaaucuguagauuuguccauuuauaaggcaaaaacacauucugcagaagagacauuaacuaaagagggcuuuauguuugcaaguaaaccuuuuauuugaugaguuuguuucuccaucauuggagaguggcaugauuucuucuaugacuuuucacccagcaggcauucagcaaugucaaaucuacagggguuuauuuuuuauuuuuuauuuuuuuugagagggagucucgcucuuuuccccaggcuggagugcaguggugugaucucggcucaccgcaaccuccaccuccuggguucaagcaauucuccugccucagccucccaaguagcugggauuacaggugccugccaccaagccuggcuaauuuuuuuuuuguauuuuuaguagagacaggguuucaccauguuggccaagcugguuucaaacuccugaccucaagugauccgcccgccucagccucccaaagugcuagaauuacaagugugagccaucaugcaggccucuacagggguuuauuaguuuuuccacuauuguguguacuucuacagcuaauauaaugcaguaacuuacccuacaguauguuucagugcguuuuucguuucuauuuggaaaagccauaacaaacacuuuugacuuuuaaagagcucauaacauuuacuuuaaauguuuaauuucauuuucuuuaaacuccaaguaauuaauuucaagaugacucuacaauuuaacuuacacucuaauauccuauuccaaaauguucuuuugcaucagaaaaacaagauaaauuaugcaugucuauaaggucaaggaaaagacagcuuuuguuguauauuuguuucuuaauuacaguuguaaucuacagaguagaucccucucuuccaugagccagaacucugugauaaguuguuuugacauguuuuuaucaguuuuagacauagacauugcugcuguggguuggugaaguaagucuucuaaucuccuuuuucaaagccaaucauccauucuuaaauaucagaaaaacauguugcaaauaaauuuuaucuuauuguauaauacguccaauaaguuacagaaaaaauuuaaaauuuauauucuucaaaaaauauuuuaaaguguuauugcaaaacaagacuacaaaauuuuuucacuucauauauuuucacauagauacaaaacuucuagauuuccaaauaacaauuuauuaaaugauaagaagguuacaaagauuaugguuugcauaaccuagauagccaguaagagcacucaguucuggguauaagguaaacucugaaaaugcauguauuuuuacuugcucccuuagaacauucuagaaugcacaaauacauauuucagaacagugauaucacuuuacaucauguugccucuugaaauuuccccuguauacuugugagagaauaagaguaaaaaggacaaauaaagucuuaguauuauuaugaaaauagguuugcccuuuaggaccucccgagaggucucagagaacuggaaggaauggauuggaggaggucaaaacuggagcuuuggagaccaauuaagaggccguugggauggucuguguggcagugguucuccaacuuguaugcaucagaacccccugaagggcuuguuaaaagcugggcuccacucccaggauuucugauucaguaggucuaagucuggccccaaaaugcauuuccaacaagugcccagaugguauugaugcugcuuauuuuaggaccaugcuuugagaaccacuaugcuagggccuugcuaaucaucucagacuucaccccagaucuauugaagaugaaacucugugaauaagauuuucaggugauuuguauacacauuaaaguuugagaagcacugcucuaagagacaguugauggaauccuagaccuaaagguagagaaaaguucacaaauugaaugguuauuuauaagagacaauaaacaagacuucgugucuggauguagagaaguuagagggagggagaaaucaccagaaauuauuugguuucuucuggcuugagcaauugaguaggagguaauuccuuuucacugggacaaaggacacaaggagaugaguauauuugggggagugguauuugaauucaguauugaguugauuuacuacacaaaguucucuuuuaaucugcacauuaaugguuucacaugguuaaauaauaaugucaugaacuccuggugcugcaaagggauugguaaugcauaagaaguguuaggcacacaugcaggauucugcuuucagcucagacucuguuuguggcagauauaaauuagcaaaauauaagucucuucuacauaaggagcauuuaaaaccugucucccaucccuacagcauucagccccucagacaaaagcauguggguaugagacacaggguaaacagccaaagucacguaccaccuauugguaauucgagauuagaagaacagaagaggauauuccagauauuccagagcagaccggacccaauugugugacugccagacuugggcaaauuccaugugguucccuuucagggacauauagcuacccauguuccugaccagcugaaccaggauuaugacacacaaagcaggcugcagaaggaaguaguccccacuuaagaaugaaucaaauuucuaucugguugggggagacauuacacuuucaaccauuguuucgcuugaucuucacauuacagccagguccagcaggcauuuuaauuaucuucauuuugcagaugaggaggcugaguuucaaggaaaguaaaugacuugucuagaguuauugaaaugguaagaggaugaacugacacugggccccagguauccugacuccaaauuguguguuccuuucacgauaauaccaugcuguaguucaauuuagcagcaggcugaucuguaggacauuuguuccuuuuuuggauuccaauuuacuucaagaacuaacauguaugaaauguucaaauaauagcacuugauuucuuaaaauugcuugauuuauaauacauuacagauuauuagugagcuuuuaucuuaauggucaagcaauuaacaaugagucacagcaaaaugucugaaaggugaggaaagaaaaaaaugcuuacauugucaccaggucuguucauuauccucugugcuguauaucagaucaaucaauaguuaauuaauaaugauguucuuccugaaguacaagguuauaaauuaauuuaaugcucauaugcauauuuucuguaggaaaagugagaggaaaaugccugccaugcccaucucauuguaagaaaauguauguaaugauuacaagcauauaauaagaaugguuugcuuagccaaauguuuguucauuucuguuaaucaguauucauuugagcuaccuccaugcaguuuguggaagcagugcaaucaguugaguaguguggcagauuuaaaucaguaauaaaagcccuggggaaauuaacaagacaaaacauuaaccacagucuaaacauuaacauauauuagcauuuuuauuauaccuguagaauuguuaaaugggcacgguugcuacuauuaaaaaguuuauguuguauaucacauaauuucaauguauauauuguuuuuaaacuuuuaagauuuaauuaaaugaaauuguauagugguaugauagaugauucaagagaaugaacugaaauucaucauuuuauuuuaacugaaaaacugaaauucccacccaacuccaccuucagccccaagguaccacaaagcgaaugccacagguaauacucauccaaaguagacaacuagaucagaguugauaauuaaauugcauaacucccaaaggaaguuuuaguuuuaauucuuuaggguccugaugaauccaucaaugauccaagacuaaauuuaaaugguauuuggcaacauuucucagaaaagcacuuuuuuuucuaaguuggaugaacuuuuauuagcugaauucgagacauuauaauaacacuucaauuaagagaaugauauauuugcauaagcacaaacauuuaaauaaacagaauagaguucagaaauagauccacaaacauggccaauuaaguuuaaagaaauaaaaaauugaaguaacuaaaugagaaaugaucuuaacaaauuguacugaaacaaucugauaaauauuuggaaaaacauaaucauuauuucuugaguguuaaauaacuuggaaaguuugacaaguuaaucagauaaacaaauggauagcauucaugacagauaaacagagcauacacauuauuuuuaaauaccagagaaaaauauuuaaaggaaaagcauuaggccuaaaaaugucauuaacuuugugaaaguagaaauccaacaggucauaugauuuaagcacugugaaaugaaguagaaaugucagugaaagggaaaucaacaaguaauaucuagccauguacaaauuuuauuuaagauagauuucuuuuauuucuuuuuuaaauaguuucagcuuuuauuacagauuagaggguacacuugcagauuuguuacauggguauauuguacgacgcugaggcuucgggucccagugaucccaucgccuaggccaugaaaacagcaaucuuuacaucacacaauauacaaaaauuaacacaaaauggguuaaauaccucaucauaaauguacaaaugauaaagguucugaagaaaauaugucugugacauugccauauggaaaggcuucuuuggauggaaaacagcaucaaucauaaagcugcaaaaauauauaaaaucaggugcaucaaaaaauuuuaaaaaguguucugugcaaaaggcaucacuaagaaaagugaaaaaccagauaaugggaaggaguauuuacaaaacauauauuugaaaaugaaauggcaagauuugaguaaacagugcagcuuuauucacaaaagcaaaaauguggaaacuacccaaauguguaaacauauuugguauauuuauucagcaauuaaaagaaaaaaguacugguaaaccaccaacauagaguuccucaaagaaaaaauuauccugagcaaaaaagcagaaacaaagacauaaauaccgaaucuauccauauuuauuuucuauauuucuauucuuucuuucuguuaucaaucuaauccuaaaaaagacagaucucaucuguagugauuaaaaugucagucacuauaaaauuaugacaauauuuucuacauuaugagguaguguuuacacauguguauacauuuacaaaucucaucaaacuacaauuuagggaugcauuuuauguauauugggucucaaaacauuuaauuaaaaaaagaguacagcaaccaaaagagguaauguacugcagcauaaacucugcccccccauuaaaaaauuaucucggauaauuaacacacuauuaauuauauuaauuauacuuaauaagauacaugacauaaccuuuauguaaaauaacugccuaugcuuuccaucuauuugcuuacucuccauauauucuacaucuuaugauucuuauuuucagaacuucucugcugaagugacucaugucaucauuaucaaucaucuaaauuuacuaaacacaguacauacuagguccucaucuuguugaaucucucaucguuguuaaacccagaauauugaucuggguuuucucccuuuggauguuuuaauuacacugguguuacauaaggacaggauucuccuacaaaauauuaaauauauguuucagaaacauaaaaacaucacaguuucaaauaacuuuuuuugggauucagggaguacaugugcagguuugucauauggguauauugugugaugcugagguuugggguauggauggucccaucacccagguagugagcauaguacccaauagauaguuuuuuagcccaugccccuuuuccuccuucugcccucuuguaguucccagugucugugauucccaucuuuauguucauuaguguauucaacauuuagcucccacuaauaagugagaacaugcaguauuugauuuucugucccggcauuacuuugcuuaggaaaauagccuccagcugcauccauguugcugcaaggggcaauauuucaugcuuguuuauggcugaguaguauuccaugguguauauguacaacauuuucuuuauccaguccaccauugaugagcaccugaguugauagcaugucuuugcuauuguguauagugcugugaugaacauaugggugcaggugucuuuuugguagaaugauuuguuuuccuuuagcuauauacccaguaaugguauuguugaaucaaaugguaguucaccucuuaguucuuugaggaaucuccaaacuccccucugcaguggcuggacuaauuuacacucccaccagcaguguguaaauguuccccucucucugcauccucaccagcaucuguuguuuuuagacuauuuaacaaaagccauucuaaauucugugagaugauaucucauugugauuuugauuugcauuucucugaugauuagugaugauaagcauuuuuucauaucuuuauuggccacuuguaugucuucuuuuaagaagugucuguucauguccuuugcccacuuuuuaauggggcuauuuguuuuuugcuuguugauuuauuuaaguuccuuauagcuucuggguauuaggcuuuugucagaugcauaguuugcaaauauugucucccauucuguagguugucuguuuacucccuuaauaguuucucuugcugugcagaagcucuuuaguuuaauuagguuccacuugucaauuuuuguuuuuguugcaauugcuuuugaggauuuagccauaaaugcuuugccaagggugauaucaagaaguguauuuccuuaguuuucuuguaggauuuuuauaguucgaagucuaauauuuaagucuuuaaucuauccaucuugaguuaauuuuuguauaugguaaaagauaggaguccaguuucaaucuuuugcauauggcuagccauuuauccuagcaccauuuauugaauagggagucaacuuugccaaagaucagaugguuagacaucagaauuuuuuuaaauguaggaauuaccgaagauuuuguagccaacccaauaaucugaauucuggagccagggucaagggacauccugcaggcagcaaguggcaagcuagaccuacuugggagccuccuuuuccauagaauuugacaugcagugcuuucguaugguuacuaauucacucuuacuuggcagaccaaagaauuuaaaucaucccacuauuggcuuacugccacuugaaauacuaccugaaacuuagguuaaaauugaaugucaguuuucuguugaacaacuuuagccauuucuuggaauauguuuagagaauuuuucaucauuauuacuguccuccaauuauagguaagguguccacauaaccacagaccugggucacacccaauacugggaagccccagagccuaugccugugacagaacuccaugacacgggaaaaucgaaaacaaaaacauagguuuuagaaucagacagaccagcauucaagccucagcucuaccauuuacuaacauugugaccuugcuuuuaaguuccccaacuuuugugagcuucaguuuccuuauaucuaaaaauggggcuaauaauacccauucuguguaaucccagugcuuugggagaccaaggugggcagaucacuugaguccaggaguucaagaccagucugggcaacaugcugagaucccgugucuagcuacauuagcuaggcaugguguugugugccuguagucccagcugcucaggaggcuuaagugggaggauuaccugagccuggggagaucaaggcugcauugagccgugaccacaccauggcacuccagccugggcaacagagcaagacccugucucaauaaauaaauaaauaaauaaguaauaccugcucuguauaccucagaggguuguugguaggacugagugaagagaauggagaauggauguagaaguuaucugugaagcacuagguuggaauaggguauuguguaagaaacgugaaguguugguauuguugagaagcuuuugauacaggcucucuuucucuguucuggagugaaagaucaaaucugaauuuuuuugucacuugagaguucccagaaccaacagugaauaggggccugagaaugacaguuagauuuuaaccaauagaguagccgcauuucuugacauguucauuauagaguauaggagugaauuguaucagaucaaauuuuugcaugauuucagaauguuugguaauaaugggauucaggacacaccaccccaaaauauggcaccuuugcauuuaagaaaacuucaaaaacaagaaagucacucucaccuuccccucaccccuucucccaugaagcaggucauaaaaccuaacugacccucuucuaaaguaugucguaagaccgucauguggaggugcccacccuauaccaagaagaaagaaacaucuuuaccuccaaaguuacagggacacagagaaaaaucugaagaaacugcccuggcuaaguuucccccaguuuauuuccauucaguuauaaccucuuuguccaaucacacuucaccacucuccauuuccuuaacaaacuuagcauaaaaauccacagcuuuccucauuucuuugggucuuccuuucuaaaggaucucgugugacguaaaacuuauauuaaacauauuuguauggauuucucuuuuuaaucugucuuuuauuacagguuccucaggcauaggucaagaaaauaaaauuuucccugcccuacaauaacauacuccauucagaaaguaauuuucaccuuuuuuuuuuuuucaaggaaacugagaagaaaauauggcacuucaaauauccuaucuucuuccuguguauagggcuagacuuacagguagagugaagcuaugggaccaggucacagugaaguccugcugugggugagagguggaaguggggugguaggccagguuuccugaugcccagccuacugggcucugcaugaucuagaccaagcuuguccaaccugcagcuugcaggcugcaugcagcccaagauggcuuugaauguggcccaacacaaauucauaaacuuucuuaaaacauuaugauauuuuuuggugauuuuucuucuaucucaucagcuaucauuaguauuuuauguguggcccaagacaauucuucuucuuccaauguggcccagggaagccaaaagauuggacaccccugaucuauaccuugcugggucccagcaguguauuuuccuuauguagguacaaggacggugcuucuggauccuggcagaaaagaaugaugcuaagguuacuaaaaugucuuccuggcugggcgcgguggcucacgccuguaaucccagcacuuugggaggccaagguggguggaucacgaggucaggagaucaagaccauccuagcuaacacggugaaacacugucucuacuaaaaauacaaaaaauuagcugggcgugguagugggcaccuguagucccagcuacucgggaggcugaagcaggagaauggcgugaacccaggaggcagagcuugcagugagccgagauugcaccacugcacuccagccugggugacugagugagacucugucuuaaaaaaaaaaaaaaaaaacuuccuggccuggauauggucagaggcccugccuucuucuuauguuucaggacuuguaacccugcagagcacuauugcuuuccuugucaaaagucuagcacauaaauaaaaacaccuuuaggaaucauggucuauggaaaacaaaaagguuuuauauuccagucuuuugguagagacacucaccuauccaauaaauucccuccaacuaaccaaauuuaaagguagcagcauccuugacuagauacauuagucagcgaaaggaaauuggauuccacuucuuauuuaagagccuaaaacuccugggcaggauacugauuucuaaaaugccacuugggaggcuggcuucuucaguaagggcugcugaagaauaagacucaagucucccagcauagccugauguuucccaagugugaagcugaaaggacuucuuuaaugugaaugcugcaucucuuuguaaguuauguuuucuuuuaguguccacuucucaaaauaagcucauaauauucaccuauagcucacauaguguggaggugaaagauguagggagaagggcccaaaggagggaauauauuugacaaaugcuuuguauaugagaagaauuugcuucaugguagauuuguggaggaaaaugcagccugucugauaagauguggcacauuucagauggaggaguaggguuauuggcaggacaccauuguuugcgccuuaccccacacagagccuuggaaaguuggcuugauaauacuauauuggguggcuugggaagaaagaucagacugcagaguggcgacauuaucauuuguucuuaaccuuccuacuuuugccucagcugcaccccuuuccaguagguugggguuggugaggggggaggggguuaaaaacuuuaaagucuuucuguggaccaauuaguauucauugauacaaagggcugacuuucaauggggagggagauuucacagcuguggguugcaaguagacaaguuacugugaaagaugugugaaagauuugauuuuggugcuggacugggaacagguguaggucaagagaauguguacuaugcucuugaaugugcuaagaauacuuugauccuacugaaauaaguucucacaugaauguuuauucacagaauaauagauauuuauggaacaaacaucaagguuuuguuccaugaaauuuuaccugcauuuucacaaaguaaacauguauaugucuucagacagaaagugguaauacacagucugcccucauuuauuuggcaucugcauuauaugcuuugaaaaugauuggaacuuaacuccccaguccagcuaggcagccccugaccuaaagcacccuaccagacugcuacuaguuaaggcauauucauggaaugcacacgcuucguuugaaguuaauauuagcucaagucacauagcauuacauaagcacaucugaaaaauucaguaucaugcauuccaaagccaaauugaaugucuuuaagugucuucggcuuuuguuuuauucccauuaagauaaacuauugaguauagcucaucugaauaucaaacuauagaugcuaucuuuuauaaaugaaggugaugcuacucugauucuagauuuuuuuuucuaauucgagaauuuauuuauaugaaaagccuuccaaagcuguauaaauagauaacuuaguaaaugcugucagggccaucuugagaaauccagaagcugggauuaccacacagagcccauggcuuauaaguagagugcugaacugaggcugauaauagaagauucuuucaauucacuucaauuaauucaccuaacuuagacgcacaaaauccauucugaauagcguggaaauacaaaagugacaaacauacaacccuucuccuugccagauauuucuaauauuuuuccugaaguuuacaguccauauauucaccuuggcuacguuggauggcuauguuuuugaggacugguaguucuuuauauuuuucuacaauggagaauguaagccacuggaaggucaagcauuaucugcuagggaggcaauguugcauaaucuuugaagucagauaaauggguucuaagucagacaagugaguccacuguuuuucugccucaugcaagucacuuaacucccuaagccucaauuuccucaucucuaaaauggggaugauaauaguuggcauagugucuggcacaagggagauauauaagaauguuaauauucauauuucuuuauauggagguucauuuaggcuuuugcuugaaagugaaaaaaguagcaaaucuacuaagaauuaaaccaaaaaaaucaaguagaauggagcuaaguaagaaagauuaugccauuuuaaaaaaaguauugcuauaugaguguaaaagaggucagcuuuagcgagagauauccaauaaauauuuuugaaugaaugaaugagaaaagauggaaggaagaaagggaggaaagaaggagacagggaggaaggaagaaagggagacuguugagcaccuauguuuuuaaaauacuuuuaauccugggcuuauuuaaugauauaugauucauaggugaugacacuggcuugcuuauuuauuuauuuauuuauuagaaacaggaucucccucuaucacucaggcuggagugcaguggcacaaucauggcucacugcagccgugaccucccaggcucaaacgauccucccaccucagccuccugaguagcugggacuacagguguacgccaccaugccuggcuaauuuuuuauuuuuugcagagacugggucuugcuguguugcccaggcuggcuuugaacuccuggccacaagugauccucuugccucagccucccgaagugcuggaauuacaggugugagcugccugucacuggcuacugauugguugacuugccuucuucccuuggguauuuuuaggaaauccagaugagcaaucauacuuuuuaucagaguaccuuaucuugggucuuauaaaaaaauacucauagaaauugggagcacucugugcuugggaggcuggucuucuauuaacugacuacacaacccccaucuucugcaccaguucuuccuaaauuuugcaauucccuuuugugaacuucuucauacauauuaauacuaagugccauugaaagguaucaauagcgugaggccugcguugacaguccucucaaauguauacuucacuguagaaaaaaagccauuuuuuaucuuaggaaaucucugaauaggcuguacuuagaauggggcccccauuccccgucuccagccuucuuuccaccagugguucuuugucuuacaagcuuaucaccuuuuuugacucuagucauagcuuuguucugcuauuuaaaauugggggaagaaauugaagugccuuucagaauuuguuucuacuaucauaucugcacaaguaucauauaauuauauugcauuucuuuuuucagauuggcaaguuaugugcccauucucaacaacgccaauauagaucugcuuauuauccugaagaucucuuuauugacaagaaaguauuaaaaguugcucauguagaacaugaagaaaccuuauccagccgaagaaggugagagguuucuuuuuucuuuauuccacaauacaauuaacaauuguauuuuaaggucaaaaaccacuagagugaaacuucuuaaauacauguuauuuaguucuucugaguagagugcuugauuaauuaaauuuuaucaucugucaauguuuaaaaaaagaugguauuauauccaaggcauauuuaaauguaaauuuacuguucauaaauaucuaguacagcaacauguguggaaaggacuucccuauucaagaucuuuuauugauuaagcaaaauuguuucugcuuacaaucuggucucgcgauuccuuggcuugcuuuguagcuuuucccauuauuaacagugagucagaguuaaauucaccagagagaagcuggugagacacauucauguguauacacagacacugcacacuuuacacaccuuuuaaaaaugauaaaaugaaggaucugguuccugguucuuaaaacaacagucaggggacaaaauccacguuuguuucuuauucucuucauccauucuccccugauccagguucccucuauccccauucuauuuuuuugauuacaauaaagggguagaaauuggaucaaaagcccaauacaauucuagaagaagugcccuaccugaaaagacugcacauguagccagcccugccacuggcucaagaauagcuagacaugaguuguuccuauugaccuugaggggggagugcaguggcgcgaucucagcucacugugaccuaugccucccagguuaaagccauucucgugagccaccacacguggccuagauucauccuccaaggaaaagaaaggauaguaagaaaaacugacaaagccuguagaguugaguaaaugauggucaggcagagcuucuuugguguuaggagaucgagacugcccaaugauguuacucacuuuuuuugaaacugaagcauuagaaucugagauggagccuuucuuugugaauucucuggcagaagaagaaaacgaaacaacaggagaguaucugauuuuauuuaacucccucaaauaggcauuguaaccccuuuuagggagagaggagaagugggaauuaagauaaucucuugcuaaaugcacugcccccugcaaucugauguuauuaagaggguuuguuuuugcaguguuaguaccucuauaaaucucucaguauguucugcacagcauuucacacuguccagaaaaauauaugugccucuagcacuccucaugcccaugcccaagcuccguccucugugguuaaaaauaugauaauugcaaaggaacccuauuguaguauucagucuguggagguugugagcaagcugucugaaucugaucaugaguugaaaagcccuuugccuuauuaaaauaacaacacacaaugaauuccuuugguaguauucagaagucaucuguuuguuuugucugcccccaacuggguaguuugcaacacacagcuaaucuuagaaauagcuuaguucaauuucaaggcgauuugauacucaacugguggucuaugugugggacucaguguuccuuuaagggauaaguauugaaaauaucugucauagauuuaaaacagugaguggagaacaagaugcacaacuaguacaaucagaauagaagaaaucagaucuucacugccccuucuagcuuucauauuuuuggcacaucucaguugccagcuucucccuucuuugcccuuccgaaugucuacuucacugcuucccuuaugauacuguuuaccuugccacaauauacuguuugguugaguacaugaacaauauuuuuccauuguucaaaugccgaaucuaugguugaauaguccaucuugcaucuacagauaccaagcuucuggcccaacugcuaacuugugagaaagucacacaguucccuccacccuugugaaauuauaucuacauauuccagccuucuccuuccugugcucccccuccucuccuuccccucugacuuggucuaaagcggcaacggaucaggugacacuaguaaaugaucuagaaagaaaagaacaaaagcugaccucagcuccccuaguccaaaaucaaugccuacucccacccacucugaacaaaacaacaaaguauguccugagugaaucaacgaguucuggaucugguacaagucauucugcccuaaauaggccucuacuucuuucaacauuugucaacaccaucucuaugcuucacauuguguaaggguuaggcucugaggaauggaggagcaccuagcuuaguuagggagggagacaugcaaaugaauaauuuccauacauuggggggugagugccaaaucagagcuaggugcaaaagaguggcagugucacagauggggaagauagccccucuccuuggagcauuaagaaagacuucuuggaaaagguaacuuuugagcucagccugaaggauaaguucaaacaagcucagcagauugaggaaggaaaggagggcguucugggcaaagggaacacuaugagaaaaaguaugggcaagucuuuagaaugguagaaagcucuaguuugggauuaaacugugaaaggcucucuccagcagaauuaggcaugaucuuacaucauuccaauuuucguuauuuuaguuuagguacuuuuuugcauugccaacuuuuaaaaauaauaagcucauauuacuuuacaugaagagaaaaaaacgaaccuuaauaauaaaggaaaaaguuccaggucugcagucagggaugaaaggcuguuuuuacuugcagugauuuccaauuagugcugcuuugaugccugcccaagcaaaucauugcaagaaagcaaaggcaaucuccuccccugcaaccaaagaagggaagggaugauccucuucaggaugauggaagcccuccagggaugaucacgugcacccagcugccauauuugaaaauggcucaugcgugcaaaggggcccuauccuuuaguuccacauuuaacacauugaauggaaaccucuaugaagagacuuuuuccugagcaggcugucguaagcaaauguuggauuugucuaacugagagcuguaggcaucagaauuuuuguaugucaaugcuauguuugacauuuauguauuagaauaaaguggaauuacaaucaaagaacauucccuucaaucacauuguuuuucccaucccaggcaacgaauuguccaaacuuucuauccucuuuuuuuuccccuaggaacaauucaguugagcagacugucuuaguucauagguggagauucuuuuguugucugucaugggcuacuagcacaaaggaaaaaaaucuggacugugucauacauggguaauuaacaugucacuuaguuucaugugucuuucuuuaaagagaaaaauagaaauauucaacuccucuuuuacaacuauaagcagaggaauauaaaccuuuauuuaagaaaagauuaaaauacgcuuaauuccugugcuggaacaaguuuagaaaggaaugacaggaagagacaaagaagaggagagaugagagaggcccaguaaacuugguaggagguaaacuacucuuguaacucugcugcuguagugucagaggacauuaucaccuguuguugcuguccuuugaaaaacucauuaacucuccaacaguuucugaagucuucuucccuacccucgaaaacaguaugucugcacuuauuuucaauaaucaguuucuuuuagagaccaagauguauuuucucacaguaauucagaagguuuuccauaaaggaauggucuucaccguaacacuguccuuugggacucuaagauauugaccaguuugagaacugugcuggagaucuacucuuuguucucccugucucaucccacagggccugggaauuaguugagaaccaggauuuauuuaauucugagguucuuguagucaaaucuaccuuggauucuaaguggauucuaauggagauaauacacacuaagaaccaaaaagaacucagagaacaagccuaucaagaagaauagguuuuaaagaaauaaauguaaaacuuuacucaagagaaaaaucuagaacaaacuacauugaaauauuaacagugauuaucugugucuggugggaccaugaauuuuuuucccuuucuaucuuucuuuauuuucuaaauucuccauagugaacauauauuucuuuuacaaugagaaagaaaacaaaauacuuuauuuuagaagauggaggaagaaauauauuugaacuguuuacagcuggugcggcacugaagcugcagcuuuuacaaauuucucuuuucuucccucaccaccuauguguuuauuuuauuugcauccagccuggcuguucccaacucuccucccugucuguuuucauucuuccaaggggcgucccuccccauacuagagaacccucucuuucucuaagacauauuucucaccucuucucuacccuuucuuuuuaggggcagggguaacagcuuuauugagauuuaauccacauaccauacaaucuauccauuuaaaguguauaauucaauuguucuuaguauauccacagaguuaugcaaccaucaucacaguagauuuuggaacauuuucaucacuucaggaagaaacucuguacccuuuagcuaucauuccccaaccagguggagauaauugaaucauggaggugguucccccauccuguucucaugauaguaaauuaguucucacaagauccgauggauucauaaggggcuucccccuuugcuuggcacucauuuuucuccuuccugccaccaugugaagaaggacacguuugcuuccacuucugccauaauugugaguuuccugaggccuccccagccaugcagagcuggcuuuucuuuauaaauuacccagucggguauuucuucauagugaugugagaacagacuaauauauucacauucuuugugguuuucuuagacuuuuaucuugacccuuccagguaauaucuuucuauacuaaagugggaggucuuauguuuauugcagccccucaugcucuugacauuuagaucgaaccucaucuugaucuucuucaaauugucaauaaucuuuaugauccaccaagaaaacugcaaggguugggagaaguucagggugguuuuuuuuuuguuuguuuuuugguuuuuuuuuuaacuucuauggaaaucaaaauggaaggccuugcauggguucaauuuuucuugccaugugugguguuagugagaggggguuuggagguagggagaggccuaagggaaacucuuuccuuuaagagagggccauuguuucccguagacuaauggccauauuccauuuccuuauggaguggggggaauuacuuagacucagccuuuacucuuucagcuuccacucuugggaacuguauuauuaccuuguaaaacagaacaucucuccuauuagcuguuaauugaacccaucuuuuuccucugugaggaacuauaauguugacuuuuauuuucagagcucuguauugagccucuucuuuuuggagauugauggugcucagacaccagggguaggcugugggguaggggguacaggcauaacaggaagugacuuguggguaucagaaguuaaauaugucccaacaaccuuucuugaguuguucuguccaucaccuuggcuuugcagugacccaagccuuugugaaucuaugcugagagcccuuucucucccucccccgccucuuaaaucauuaguugaaaugaagaguuuuaugguaauuguccuaguuuguuuuauguugcuguaacagaauuccuaagacuggaugauuuaucaagaaaagagguuuauuuauuaggcugggaaguucaagauuaggcggccucaucuugugaggccuucauuuagaaggccucauacugugugaaaacaugguggagaaaaggaaagggaacugagcacaagugaaaaggacaaauaugaaaggcagucucacuuuauaacaaccgcucuccugguaacuaauccaaucccuggagaaccaacccaggcuugcaaggcagacauaaguccauuuucaccucuaaaaggcaccaccucccaacacugccaccuuggggaccacaccuccacaugaguuuugguaaggacaagccaucuuaaaccauagaguaauaaaaugaagaaucggauuaaguccaagaggauauuuucaccagucuuccucauuuggccagaucugagaacaacucccagaaggcauuucugggcuaaggacuuccaccaguguccaaaugauauucaggccucugguuccuauagaggccuguacaucaggccaguccauucuuagccuggagacaauauugaauaauuacuccacugccagaaaauucccugaauagagucuccaaaaacuuaguauagacauaagguacauuuggaugugaaggaugcuuuaauuuucuaccaguaacauugcuuuagaaaauaaaguguguuuuauuuuuguuuauuuaccacuguacaucuauuacauagauauuuuaauauuucuuuuuaaacauauccacuucucuccagucuaaggcauauuacuuuguguauccauguacaucugaaaugagauaacagaccugaaauuuuucugguauauguguguguguuuacauacaauugcagacauaauauauucucucucugugucacucucucuuucucucucucucugucucacacacacacacacacacacacacacacacacacacacacacacuugucuuauuauauguagcacaaaaacaaaagcaaauaaauaauaaaauauacuagaauugucccccacccugcucccucucccucacaggagccacaauauacaaauaacaaagaaaccuuccucuucuggcagaugugaguugcucugacuguauugccaggagaauuucauagagcuuauacuguucugagcacccugcaauucugaucugcaaccauuagccagagccuauauggaaacggaccaucucuaggguaauagcauuguaaauuacaaucaaugcacccaauuacacucagaaaccaaaagauauguagugcuccaguguaccuuguaaucagcaccuuugaaaauguagguaacagcauucugaauaagaaaaauggaaguggaacgucuuagaaaaugaauguuggaauuaaaucauccuucugauagaaacagcaccuuauauggcagucaacuuuuuuucuaauaucauuuuauugauuuuuaaaaaaaaacuaaacuguggccuuguagccaagaaugucuuuaaaagucauuuauugcucuaaucagccuggcagagccuuucugucaugcugauaaggaaauuaaacuuuucucauacugaguuuacuugccucuuaugcacagauguuuuguuuuucuuuuagggaacuaauucagaaguugaagucuuucaucagcuucuauagugcuuugccuggcuacaucugcagccauagcccuguggcggaaaacgacacccuuugcuggaauggacaagaacucguggagaggugaucuuuuuugaaaguuacauauagcaauauuugaggaauaauugucauauguuuauauaaaaguuaauuaugucuucuaucuccauuaauugcaccagaaaaauucuagagaaaucuaugaggcuggaugcgguggcucaugccuguaaucccagcaguuugggaggcugaggugggcagaucaccugaggucaggaguucgagaccagccuaacacagugaaaccccaacucuacuaaaaauacaaaaguuagccaggcaugauggcgcaagccuguagucccagcuacuggggaggcugaggcagaaggaucauuugaaccugggagguggagguugcaaugagcugagaucgcaucacugcacuccagccugggugacagagcaagacucuccaagaaaaagagaaaacaucuaugacauuccagaugaugucuauaauuuauagcccuccuagaaguugcaaaguuugaaacacauagagaacugugucugaaggcaauuuuacagaguuuaaagcauaaaacaacuuucuuuugucuucgauucuuccaucuccucauuauguggguccuuauuuauuugauuugaagaaaucacauucaucuugaaagcuaucauuuauugagaguuaauuguauauuaaguaccaugcuaagugcuuuguauguauuauuuaucuuuauaaaaauccuaugaaaugaauacuguuauuuucccccauuauacagaugaagauagagaaaggaagaaaagggagggaaagaggaauaccauuucacugagcaauuuuacugaaauauuuuauggagcauuuguggguuuuguuuguuugcuuguuuuguuuuuuuguuuguuuuuuuuuuugagacagagucucacuuugucgcccaggcuggaguacaauggugcgaucuuggcucacugcaaccuccgccucccaggaucaagugauucucccaccucagccucccgaguagcugugauuacaggcaccugccaucaugccuggcuaacuuuuguauuuuuaguauagaugggguuucaccauguuggccaggcuggucucaaacuccugaucuugggugauccaccugccucggccucccaaagugcugaaauuacaggugugagccacuccacccagccgaguauuuguuaauauaaucuaugcuaucauuaugugugaagaauuugcucaucacugaaaaggaaaucauauauauucauuauauucauuuauucagcagguauuuacugagcaccuucuaagugccaagccuguugaaaugaacaaaacagacauaauuuccuguccucgcagagcuuucauucuggugcgcuagugguauuccuaaucuccauugcuuuccaugugggaggaauagcuugcgauuaaaaaauuaaaucaagaggacagaaugcuuaggaaaccacaaagaguugaugaacaugcuuuagaaaauguuuguacaaguagcauguuauagaggagaauacagaagagacccaaaaucgagucugaaucuuucacuaauuaguuguuuaaccaaaggcaagugacuuaaucucucuaggccuugguuucccccaucuaaaaaaggaggugguuggauuagagccccuccaggucugacaaucuguauuuuuuucuuauuaauuuauucacucauucauaccuucaacauuuauguuuugagauauuauguguuaggcaccaagcuaggugcuagguaggggugcaagggcgaaaaaggcaaguuagcugcuuugaagagcuuacauucuagugggacccaauaccaggacauggaaugcugaauggaauuuauuaacaguauaauggagugcaaagaggaaggcuuuggagccagaugaauuuggauuugccucucaguucugcuacuaacuguggccuugggugagucacuuaaccuaaaaagucuuaagguccuccuccucuguaagggaagggcaucucacaggauuguuguaacuguuaggagaggucauaaaugaaaagccccuagcaaacuggcacaugcuggaagcucaauuuauauuacuucucuauuuuucccccuuuccccuucacuccuccucuuuccaacacaaaacaaaagacaugucagaaaauagcuuguuccucaucuaugcuauuuuacugacaugggacaaugagaauaagguugcgugccacccugaaugaggcacugaaauuguauggagauacacuucucucuggcaaauguaaaucagccuggaaggauuaauggcuccaugcacuggagaaauaauguauauuugucauccuaaaagcucaucagguacuaagaagaaucaugaacauuuuuuuuuaauuuucagaaaaaaacaguugguauuuggcuuuauaaaaagcugaugcuuuaaaacugauacaaacaauaacuauuugaaaaagaauauauccacaggucaaauaugugcuucuuacauaaacuugaugacaaaccauuccagugccuuguccaguguuauguuacuuuagcgaaaaaugaacaacuccugaauauuuguuuuaagcagcuuaucuucuaaccaugguuucuuauuaaaaaggaaauuuuacuuuacaaauauauuuauuuacugauguguucauucauucacguauucauucuaacaaauauuugagcacuuauccaauaucaagcacuaauauuuguuucuucauugugauuguuugaagcaaauauuauaacccugcuggauuuaucuucuauuguuuauggugaaaaaucagaucgauccaguuuuaguuaauuguaaaauaauuuauuccuaggccuauguauuuugaauuaguggaauuuuuauugaauuuugcucauacugacuacuucauguuugguacacuuuggugaagaaugaugcccuggaaccaagaaauuucucuucuaucaaaugguggauuccgaagccugcuaaauuugaaugaguccaaaaguuagccaaauguacuuuuauaucauuaaaagaacuaugguaacugaaauauuuuuguuucauuugcuagcuuuaagccuuaggguauugaacaaaauaauaaaauaaauauuguaguauggagaaaagcuaauauuccaaacuccuauuuauauuucugauuucugaaaaaucuuuauuuucaaaacgacuuuuauuguuaauauauacuauccaggaaagaaagaaaggaaagaagggagguaagaaggaaggaaggaugaaggcaaggaagggaggaagaaaauaaacauauuuucagagagaauaaggguaguguaauccaggaagugacuccuucuugguuaguaaccucagguuauaauuaacuuguacuuguauuacugaccuaaugcaaugaucaaacuagggaauaaugucaaacuaaauuuuuuuaaaaauuacucaggaauauaccuuuaauaauaugaaguucuuuagccugaagacauguauggcuucuauuuguaccauuuauaaagauuagcuuugcacucgugucucaucuauagugaaaaccucuuucuagagcuuuucaauaaauuucucauuuaauuuagucuuaaguaacaguuaccacuuccuauuguccaguggguuguaacuuuguuaucuuucuaggucaaguuugugugccugugaaaaauuuuacuuuuagucaagaaaaauuaugaaaaucaaggauccugauagggaaugagacuugucaguggagacacuugaucaaaaggaaaauauugauguugagggaaauacugagcaauauucaugucaguuggguuauuagagcuguuuguagccuacuauggauguaucgaucacucaacuuuuaaagaguuaauuccuuaucucucugaauaaggucauauuuuccauccuuuccuuuuuuaucucuuaugaaugcaaucaauugaaauaugaaugaagagaauguuuucaccgauccagucuuagagaguaccacauaagccuaucauucuuccuucucagcuucccaccaccacccuaucugggcuugagauaaacauugguuugucuaccaggacuuagcugagaaaccuucaaauuagcaaacugggcccaugugagauauccucuuuuaugugagccacuagcauauccuacaggcaaagauuuccuaaaauugccaaaggcagaaagauccuccagcuucugccuuugucaaacuacagagaauuucaauuagagaguccuugagaccaagagaaagauaaaggaacccagauugcugaguuaacacugggcuucacaauaaguaaaugucuuugcccugauaacacccaaaugaacagugaacauuuuuguaaaucauucucaaacacccuuuuugcuaggccaaauaucuggauaauugacugaauuuucauucauuuucuggauaguuugauacuuuauaaauuaguauaacagagcaacuauaaauuaguuuuaguuucuauaaauuaguuuagaaucuauaaauuaguaaacagaguuugacacuuguuuaaauuaguauaacacaggaacuguuuaaacuauauauguucaaaaaccccuaguuugugagaaaaaaaauaaacguauuuugucuuuacauuuaauaucugauaggccaggcgugguggcucacgccuguaaucccagcacucugggaggccgaggcaggcagaucacaaguucaggaguucgagaccagccuggccaauauagugaaaccccaucucuacuaaaaauauuuuuuaaaaaaauuauccgggugucguggcagguacccguagucccagcuacuugggaggcugagguaggagaaucacuuuccaggagguggagguugcagugagcugagaacccaggaggcagagguugcagugagcugagaucaugccacugcacuccagccugggcgacagaguaagauuccaucucaaaaaaaaaaaaaaaaaaaaaaaaaacucugauaauucaggcucauuccacacagauugagcacuuaauauauaauagggcauaccuugauaaguagaauccagcuccugcgccugcuaaggaguucacaaccuagagaaggaugaggaaagaaaaucaagccaucucugccgggcacgguggcucacgccuguaaucccagcacuuugggaggccgaggcaggcggaucacgaggucaggagaucgagaccauccuggcuaacacggugaaaccucgucucuacuaaaaauacaaaaaaaaaaaaaaaaaaaaaaauuagccggccaugguggcaggugcccguaaucccagcuacuugggaggcugagguaggagaauggcgugaacccaggaggcagagcuugcagugagccgagaucgcaccacugcacuccagccugggugacaaagcgagaguccauccgucuccaaaacaaacaaacaaacaaacaaaaaaagaaaaucaaccccaucucuuccccagcaguccagggagagcuccucuuagagguaucacaacagaggccccauccauguguauugugugugugugugcaggcgcaaguguguguguguguguguguguguguguguguguguugagguaaaauuugcaugacaaaauuaccauuuuaggguauacgauucaguggcauuuaguccauucacaauguuguacaaccaccaucucucucuaguuccaagacauuucaucacuccaaaaggaaaccuuguuguacauuaaugggcacuccccauuuccccuuuccuccagccccuggcaagcaacaaucugcuuucugucacaacagauuuacuuauucuaaggguuucauauaaauggaaucauucacuuagcauuauguucuuaagguuuauccaaguuguagcacauaucaguacuuuaucauuuuauggccaaauaauauuucauuguagguauauaacauauuuuguuuauccauucaucaguuuuuauucauuuuuauauaaacucugagcaacuacuucucugucagaucucucucacuaccucugcauucagcuuagcucacccuuauccuugaagacaggucagccaaaccuauaggccucccauccccaucauccuugagcaccaucuaaaugcuagccuaucaccagaccucaucucuguaauccuuugcaaugauucuccccugagucuuugucucagccuucuguuuguagucagcuggccucuccuacaauuagcacaccucccauagggguuuauauuucccuagugacuuugaggcuuaucaacucugcauagacaacugcuuuacuuuguggcacgaugccuuaguucccuuugugauucagcuggagcugcuaaugcuaccccuuuaucauguugcugggccagaugggccuagcuccagaugucagcuccaggauauugcuguuuucuggcugacaguuucuacauagccacuucuguucauuaugaauuggagcugggcguggugacacgugcuuguugucccagcuacucagaaggcuaaggcaggaggacuauuugagcccaggaguuucaguccugccugggcacacagcaagaccccaucucuuaaaaaaaaaaaaaaaaaacuauguuaugaaugcauguucaucuuuaauucucucaugaugacucugagacugucacauggggcagcuggccuuacuaaauaaacucccuaagaucugcaggggaaaauuguggugaaucugccuccucuuuaucuuaugcaaucuuaccucucauuucaccugagaaauuuuauauauauauauauacacacacacacacacuuugaauucucuuauuuccauuaaccagacaagucuuccaauguuucuaaugccucuucaggauuucucugcuuaauugagaaggcagaagugggaauaugcaaagcaauuauguuaauucucagaguuuuguccguugucucaaaaccuucuggauguuucagaaaaguacaguaaggaaacauuuuucucucucuucugcuggguuggaaggauagacuguggcaugucagcaaguugaagugaauaugagagaaccaugaacacccaauucaugagauguguaaaaucauacaaacaauuaaaugaccgaaauagcuucuuuuuuccccuaugaucuaggaaaggcaagggagaauaguugauucugcuuuuauaaugcaauuauuuuaagaacacgguauauuuugagaaauuugguugggggcacaguucuuucuuuucuuuaguuuuuauuucuauagcuuuuggaguacaaguggguuuuuguuacauggaucaauuauauaguggugaauucugagauuuuagugcaucuaucacccaaguaguguauguuguaccuaaaaauuucuaacacgaaaaagucuuucacugguuuacauggaaacaaggaaagaccuucagaaucuucaaucuaguaguaaagagauuaaguaaaaaaaaaaaaagaccuauaugccaaagugcauauauacucacacauacauauaaaacaugcacaucucauucuagucaugucagaacaggccagugguacgcagcaguugcuauacaucgcuuccaugcucucgugcuaaaauaaguuauuauuuguuguuguuguuguuguuuuuuaauuuauaggguggcuuuucuccaaagugcccaaggcaguaugcauacaauuuuaaauauagaauagccaaugcaaacaucaauggggaaauaaauaaauaaaauacagagccaagaggaagaggguacagaaaaacauaaacaauggacaauggaaauaauauucaguagcauugagucagguccgaaaguccauugauucaggcauaagucagacuaaagucaugcugaaggugagacucaguagcucuucucagccacuguuguggugauuugaggguuagaaacugagguauagucuucaacuucccagcucucucuucucauagcuaguucuuccuuugccccuauauuggaggaggcucugcuuaugaaaggcuggugggagggacagagggacaaauagggcuuugguauuugauuuaucacuaucuaucuccacaguuccuggucccccuaagacauuuuuggauuucauuucuacuuuaguuuucccaggagcagaaacaugacacuucauuuuuuccgauuuggggaacugcuauguuagccugagugugugcccaagaaugaacauacugaaguauaaugaugcuuugcuaguauggcaguuuacauauucuaccuugccuuagauaagucaagauugcucuuggaaagccuuugaaggagaaauggauuaugcagaaagugacuuaauuugguauagcaugaaauauuuauggcagcuaagaauuuuuuuaaauccugguaaggcagaacagaucaguuuggagaguacccccauguaauaaucucucuauggacuuagauuggcauauuuuucagcagcgauuuaucuuagauguagucuuuaaugacagauauuuaucaggacauacucucguggcaauacaguaacauuuaucccuuaagauuauggugucauauacaguagcuuuaccuucagaauugagugagaaaaacacagcuuaugcugcugacggauggcuuaauacagugugcuccauucaggauguguuagacuugguugacugucaugucuuaaguagcaggaagagacauuuucauggcucaacauugauaugucuauagacaaccuguugaauacuggauagcuuauuacuuuaagcagauuguguccuauuaguauacaauucuagccucuguugagcucaguuggaucauuuugugauacaaagagcauuugggggccuccaaagcaggucccagcauauccacacccucaacaaauaaacaucaccuccuaauuuccucuuggaaaugugauucugaugguuggauaaggccugucuccuuuuacuaucacugcuccaugaaucagaaaucuucuauuuuagccuggaaggcuuaggagauggaaccaggaagaaacauaucugcuuuuaagaaauggguaaauuaacauacuagagcuucucugccccuuaacuauuauugccuccuucaaagguagugccuugguaagugacagauggacuccacugaugcugccagucuuccaaauaauuuuucuaccuccuuuuuggaaaaagccuuguggguuuauggcugaucccugccgucuacaaguuguugauucucaaccaguugauuaucgguggugcaggcugaggucuucagugagaagacccugaaacguuaggaaacauacacuaggugauuaauacauacugggaagagugcagucuuuagaaugauccagauggauuuuuuuuuuuuuuuuuuugagucagagucuagcucugucacccaggcuggagugcaguggcacaauuuugacucaccacaaccucagccucccggauucaagcgauucuccugccucagccucccaaguagcugggauuauaggcacgugccaccaugccuggccaauuuuuguauuuuuaguagagacaggguuucaccauguuggucaggcuggucucgaacuccugaccucaagugaucugcccuccuuggcuuccuaaagugcugggauuacaggcgugagccaccgcgcccggccccagauggauauuuuaauccuaguucagacaccagcugugugcuuugggcaggacauuuaauaugacauucuguuaccuuauuuauaagaugggaguaaugauaccuacucugcagggcuguugugaagauaaguucuggcacauaggcacuuaaauaauugauagcugguguugauguugucauuacuauuauaccaugguugagcagcccauguaaauguccagaguaaaggugaagaggugugggccauguuucuucccauaaagguaaacuggauuuuuuuugggaaauaaugugagucuuugggaacgaaacugcuaaaugagguggcugaucaagcaggcucauaccauuugggguucauuuggagugagaggauaaaauaauagggcuguuuccuucuucuaacauuuauauuggcuuuaaaugggguuuccaaagaggaguuccaggaauuuuucuguagagacugggucucgcuguguugcucaggcuggucuggaacuccuggguuuaagcgauccuccugccucaggcuccuagguagccgagauuaugggcauguaccaccacgcccagcaagaaguguuuugagugaugucagcauaauuguugcaacaacguuugggcugcauacauucugguagauuuauacaaguuugaaaucugucaugacuuuauauucaccccucagagagcauguaaguugaauacugauugaaacaaggcugcugagugugauagguguccugacguuucccugguaaauuucuuuuaguguuaucagugucacuucaucagaacaccucugaccucuacaaacaguaacacccgccugaaacauuuuuguccaauuucucugacucaggaaguuucuuucugauagucaaucacugagcaucagugaaaguggacucuugggacuuggagugugaagcacagggaaagguauguuagggaagccucuuucuugggagcuuccugcuagcggcccugcucuuagaacaccucuggcaguugucauuguuguggcugugaucguuggauugugguggugguuuuucuguuccacaggccacaggaaauggcuggcaggugccacuuucuuugcugcuacuggcacaguucuuucccuaggguacaagcucuuggugacuucuuugaaagaaauuuagcucuccuauuuuuuugcucuuucuuccuauacuucagcaaguacaaaaucuuguuugaguuucuccgaugauuuuuuacugauagaaauguagccaaacaguugagggauuaacaaaaagcacacagaguuauguggcaaccuaaggcaguguaguagaguguuuaaacuuacaaccuuagagucagcaaagccuggguuugaaugccuuuuccauuaccuauuagcuccuuuucuucucugauccucagcuuccccacacguaaaauggaguuaauaguuucucccuuaacagauuguugaaaagauuccaggagauugcgaagugcagaguauagugccuggaacacaguuagucucucaaaaaugguagcuauuauugcuguucuucaaaaaaaccuauaaaaaagcccuugaagaucuuuacugggagauagauggaguuaggccugauauuggcucccuucaauaacccauucuuaacuuuucaggaacaccuaccccccucucauuuuuauguuauuuccucuuuuuucugcaaaaacaucaaaaucccaauccuuggucaugguugguucaaauggugggcauuugaguccacuggggaucaagugagaguuauuugcaucuaagggugugcgcuaggcuggccuucuuaccuucagcaucuuguuucacagcaaagacaucuuaaaccauuucuccuaugacugcuuuauagagauuaacucgggcaaucuuccuaaauuacauuaaaaaccaugaugagucuaguugcaggucaaaaauaguuguucagugcucuaaaguccuuucugucacccuugaguuagccuuuguagaaaaggagaaagaucauuaaaaucagucaugauuucccaauuucucaagccaaugaauuuuauucuuuuacgugaguauggcuuugauccauggguuugucucauuuagaauguaguuucauuucccuggaaaagaaauuuguuuuaauuuguaacuccagugucacaggagcuuccuauuuuuugcccgcugagaucuuagugauccacauggucagauggaucuuaaaaacuacccaaaugaacuuuuucuugguuugagccacuuguuggcccauuuugucauuguucucuuugcuucuaaucacagcuucgggccuagagcugggaugaguacuuguucagcaggagccagaguaagguguucccaccugggguagggauacagcaguugggguuggagggaugcauagaggauugcacuauguaagaacucaugcugaaaagcuaauuuccaaauacuauuagggagcacuaagacaaggaccaucuuagaaugggcuagaaaaagagccauuggcuagcuuaccccuacuuauccuuaacauuaucucuucugaggacccuggauccuccuguccacaccuuugucuggguuaaggcuugcuggcaccuuaucuucucucuagcauguccccagcgacacuauauugagagcuuuuacaugucugucuguaaucuucuaguagcuccuucgugacugguacugugggccgggcacaguggcucaugccuguaaucccagcacuuugggaggccaagguggguggauugccugagcucaggaauuggagaccagucugggcaacaugucgaaaccccgucucuaccaaaaauacaaaaaauuagccgggcgugguggcaugugccucuaguuucaauuauccgagagggugaggcgggaagauugcuugaacccgagaggucgaggcugcagugagcuaugaucgcaccacugcacucuaaccugggugacauagugauccccugucucaaaaaauaaaauaaaauaaaauaaaaaauaaauaguaguacugugucuuccaucuauagaaccucauugcuuagcugugccugccauagaguaaacucucuauacauguuuauugaauucguaggaugaaccaacaaacauaguuguggguaacagaccuuaguacuaggccuagcuucccaugguaucacuguaccauuaagcagauuacuuaaacucuauuuuguuuucuccuuuugugaaauuaauaccuccccugccuaccucaaaggguugcugugagccuccaauaagaaaacgcauaugagauguuuuugaaaauuauaaauuacccuccauuuacuagauguuaguguagaagaguagaucagauguaaggggaaguuuuacccugaauaaauggaacauuggguaaucaacacagcauuacugggcucucuuuacaaacauggauccuuuaguagcuuccugaguaucucucucuguacaucucucaaggacuugaggaaugucacuuaaaaaaaauuuuaagcaaauccaccuauccccaugaauuuuauuuuuaaacaagucagcccguggugcugaauuaaaccaguuggcccucgauaaggaaauacuuugagagauugguagcaucaguuuaaauuaaugaaaagucugagugacagaucauuuuaaaguaaaugcaguuuuauuacuuucaaacacauauaauaacaaugcugggaauugaauuuggagaaagacagccugugucagagaaucgaagcauacaaauaagaaucauugauaaugaggcuauugcuguguggcuauccugcuaaagaccauccuccucaaauuggcuaauguuccccuggagaagcuuaucuauuuaagaaaccccuauuuuuuucauuuauaggcaugaagaaaguaccauuacaaauuccuauacauggcuucuggauaacccagcuuuuucaaaccccaguggauagcaucuagcagcagugcccugcucucugguuauaacaaauaguaaucucgaacagcaaauacccucuggccccuacagugaucaacuuuuuccagguugccuaggacuuuccagguuuagcacagaaggucccaaguccuaggaaaccccucagucccagcaaacuggagugguugguuaccuauugguaccuaugacucuuacagcuacuaaauauagggaaaagaugcagucguggggguuuacauugaagggguggaggagagcugggagagcugcagcucacccauucuguugguuucucugccuucacuuuuuaacuccucuuaccuuuuccucccugaugcauuuugaucauugcccucuucccuuugcucucucaaauucuaaggguacagugggacuucagaaagcaggacugagacaguaaaguggcuaauaauaguaauaacuaaccauucuauggagcuucccaagugccacacaauaugcuaggcaguuuguaugcauugacuaauucucaacaacagccuuuugaagcagacaguauuauuaccuacauuuuacugauucuacugaugacauugaguaaauuaccaaaggccacagcaagaugggcuucaaacccauccaauccaucccuuacccacaguacuguccugccugucaaaugccugacuucucuccugcaagguuuaaagccuucucaccuucuuccuauucuugguggaaauccugacgucagcuugcuuuaaucugucauccagcagaccuggaaugaguguucugugcagcuuuucucuggucuguacugcuauacccuguccuuuccuuguucccugcccagucuugcuccuugagaguagaaguacauuuccugccucucauaccaugcuucucugcucucauguccucucaagucuauaaggcgccauccccuggaagaaggaguucuuagagauauuucagccccuugcuagaaaauggcacucaccugccucugaggcuagcucuccauuuaaucuccucuacucacaugccucugauaauaaagccauugccugugcauccccuguggcgcuuuggaguccaugcaaacaaacaaacaaaaaaccuuugcccuaggcugagacuccagccugaguccuagcucuacugugaacuuguugcaugaccuuggacaagucacugcacuucuguuuuuucuuuuacuuauaaaauaaaggaauuugacaaaaucaccucuaaagcacuuuccaccuauaacaggcuaugagauccuauaacaaagauauuugaugggggagggaauaugaaaggaaagggaacaccauaaagcuaccuuaaugacuuugaauuugaugccuucccaaguagaccaaagugaaagugauucgaaaggaaccccaggguauaaucauucuccugacgacagcagugagcucuucauuuuacuccuccagguauuauuggagcuacaggggagcagguagguuggcuguuugagaugucagaguuguucucgauuucuaauguuggagaguuugggguacaacucacauaauuaaaccuuaaagaaaauguuucccccauagcacugcauaacuccaauggggcuucugagcaggaaaaagaaaauggaauucaaugucuguugcucccaauaauauuugacacaacuguccagaaugaaaauuagaagcccucuaaccacagagauauauaagugacaggagagagacauugggggagugccaagggcugaagggcagguuaagagcaaaggaauacaaaguggcuaagaaaaccagagggagagagacaauuuccacccuuuccaagacccuccaggcuagagggcuuggguaaauuuugaccuaguuguccuugugugcauggcugugagcuuuuauuaaguauuuaugcagcaguuuauauuuuaccaagugcuuuacaaucacuuuuauuuggcuuaguaaaguuuuccuggaaucccaucuacuuuaugaucagaagagucauuucuuguuugcuuagcaccuccauguguacagccucacacaauaggccacuuguuccagcaggagagcaggugcaaagaguugagcaguggagggcaccugcagcuaccagggcaguuggaguggguguaguuuacacuucagcucaccuuuucucccccuuuguuauucuuucauguuauguuauugcuggcaacuugagaguggcaggguaaggcuugggccugucgagugcagagcuguccugcauauggacacuggcaaagguaggcucuuuccccugugccagugucucugcccaugcccaccauggccaugcacuuccaccaggcaaagacuugcugaguguguuucuuucugcugcuucaggguucuugcugcagccuugguccuagaucucuggacaugaguuuaggaagacuauagaaagagcaguucuacucucugcagacaagaccagccaguguucuuggacaaaucuaacacuuagcuaccuuauucuugguagucccuucucccuuccagcaaccacggcagccccccugcaccagcacucuggauuuugugauguaggaugguguggcuguauagauggcucaugaagcaauauggcuacacacucucaaucaccgguuugcagugggaauccaacacagucaucaguuggauguuuccuuuucugaagaccagauuugccaaggcagaaacuaaaugcugguucgugaaguccagaccggaauuaguaggccagaacauuggaaaauucaggaccuccaacaacuaaaguucuguggcugagaacagggcuauguagaugcuuaauagguaaguguagaauagaugaugacacucaguggagcauagaaaaggaacucugcuguucucuagguugccacugguuucuaaaauggugugaucuggcaggugggacacauugacagguuuaccucgaagggcccaguguaacauagguccucagucaguggcugcagauuugggggaaaggccccaggggcaacagguugacaaggguuaggcagaguagcuuagagucuccaucacacaaacugagcauuggauggggccuuuuaucucaggucaguucaguagacauuuauugaguggguacugggugccagguacuggguaagggagugggccuagaaaugaauacagacaagagccccaggacagaguuuugcucaggaaaacacagcuggcaagaggaagucauaccugaacacccggggcucacucaaaaaaacaugaaauacuggcuuggaggaacaaaacgaauuccagagccuggggccugacaagugagucaguuaaacuaacaccuuccugcccuugucacuacuggcucaggaucuggguagggcuaauucugcagguugaagguuugaggccuggaagugacugugacuaaggccagaggagcugacggaaaacaguggcaggaauguuuagcuuucuuuucaaguguaucaguagcaccuauuugcaugaaaacaguuuguucuuugaggcugaucuuuggcaauuuauuaaccacaguucagccagacauccaaaagaacacugaggagccuuuccucccucuguuuacuacauauucuagagaugccacacaagagaaaaauccaccaggcacacuuuuuccuguuucagacuugccucucucccaaacgugucuggagucaguuaagagugauuguuuagguggacuuugagaguccuguucuucauuuugaagaucaccacauuaaagaauggauguuuguugugggcccugcagcgacuggagacaaacaaagcaguguucugagcagagagauuugaaaaagcgugugggcauuuucaagagucaucuaauucauuacuugugacaguauccaaaguggaagcagaauauuuucuaucacugagaggaggaauaugaacugugggagaaggagggaggggaacaggcuucugacacccaaagcuggucacucaggaaacuuuggaggguugcccugggccacaggugaaugauuaguucuucugugaacuaaaauuaauuuugagccguuugaagcccuuucuggucauuucccccucagaugaugcccugucuccuggaagguuugggagggcaccucugcuaaaaaguuccucucagcuaggcuuaaaugcucagagccagccauucacacaucauugcucaaucgcgauggcaaagaaaguuccagugcuuuuucccuugcccauuuucccugaugauaagccauuccuacucaugccuugacccauacuuuaccgaggaccaaaauaagagaacugagacucuuccacuucuuaaguucucaauguggggaugaagggauuugaagcuucccuuggcuauucauugcaagguuuauuucuucucucucaggaagcucuuuuuuauuuuuuuuagagacugguucuccuguacuccacccaggcuggaguacagugacaccaucauaacuaacugcagucucaaccuccugggcucaagugcuccucuugccucaaccucccaaguagcugggaccacaggcaugcaccaccaugccuggcuaauuuguuuuuaaguuuuguagagaugaggucucccuauguugcccaggcuggucucgaacuccugggcucaagcaauccgcccaccucugccucccaaagugcuggaauuacaggugugagccaccaugccuagcaggggauucuuuucaaauaaccuuuauugaacaucuacugcauuugagaugcuguguuuggugcuuucacgugauaaaaauaauaacagcagcccucauauagaacuuucuaugugccuggcauugucuuaagcacguuaucucaauuugcuaacauucauuauaucaaauaauucucaaaacagugcagguggcauuauuccuauuuuauagaugaggaaacucaaguucggcaagguuucacuauuuaucaaaagucacacagcaggugggggcaccagcuuugaacccaugucucugacuccaaggccagugcucuuuccaccacgugacucuuccucccuaaaauguauuauguacuugcugccucaguaaacuaugacugccaaaccgaacuuaaucucuuacaacaauuauugaucauuauuuugaacgucaguuaccuucacacaaugcccucauguuguugagguaugugacuaguuccuugcccccuuguucuuugcuauucuauuugggggagguaacagcuucauuccugucucacuagcagugaugccaauaauaacuuuaguugcuguuauuuggccucugggccucaguuugccccucuguaagaggagaacauugggcugaaugacuuugaagguccuuucuaacccugauauuuucaucaauuaaaaucuaacuuaaaaauagguaaagaggcugggugcaguggcucacgccuguaaucccagcacuuugggaggccgaggcagguggaucacgaggucggaguucaagaccagccuagccaagauggugaaaccccgucucuacuaaaaauacaaaaauuagccaggcaugguggugugcgccuguaaucccagcuacuugggaggcugaggcagagaauugcuugaacccaggaggcagagguugcagggagccgagauugcgccauugcacuccagccugggcaacagagcaagacuccaucuuaaaaacaaacagucgggugcaguggcucacgccuauaauccuagcacuuugggaggccgaggcaggcggaucacgaggucaggagaucgagaccauccuggcuaacccggugaaaccccgucucuacuaaaaauacaaaaaauuagccaggcaugguggcgggcgccuguagucccagcuacucgggaggcugaggcaggagaauggcgugaacccaggaggcagagcuugcagugagcggagaucgcgccacugcacuccagccugggcgacagagcaagacuccgucucaaaaacaaacaaacaaacaaacacaccagguaaagaucguguccuuuugguuuagcuugaguaggacaagaaaaugucugguccuaguucucuggacuagaaggacuugguaaacgaguuuggggugauugaauaagaagucucuaccacacuccuuguucuguuauuccccacccccgauuacugagcuuugaauuacaccuuuuucuuucucuguuuuuaaacacaguuggaguccucuccucauuuguguguuccccucaaggacagccaucagagagacacugcucuggccuaguguccugaccgccauguuuaguucucaccagcuugcuuacacuuugggcucugccuagcuugcgauucucacaagaaucacuuuugcugugcuuauuuacuuuucucucucuuuaucucuagccucuucugcaaaguugguuucuucagacuaacauucaggugaccucaucucaagcauuuucucauuaccuuccccuuucugcugggggacuguucccuacagccacagacucuucuccuuguaguggguaauacuaaccucucacucuuuccucaccaucugaaaaauauucuuugcuucucuggguuucaguggcuuccugauuauguaccaagacaaaucuuuuagucccuccucaaaguaagguuggagacugcacuguaaacagauucuaaugcaguuauucccucauauagcuaauggcuacuaacggaaauauagaaauagguuuauaucaccaaacaccgcauguucucacucauaggugggaauugaacaaugagaacacuuggacacagggcagggaacaucacacaccggggccuggcgugggaugggggaaugggggaaggauagcauuaggagaaauaccuaauguaaaugacaaguuaaugggugcagcaaaccaauauggcacauguauacauauguaacaaaccugcacacuuaaaguauaauaaaaaaagaaaagaaaaagaaagagaaacagauuuacaugcccuggguuucuuuccuagauuuugcuuccucucuacugaaaucuacuuguaauuucugaaaggcuguuguuggagaacacagguacuucuuggaguaaaguggauauaucuguuucuagcacccucguagcuuaacauuggcucugaaguaguacugcuaugcaaacaauuaugaaagacauuuuuuucacaugaaaguuuuuaguuuauaaauccucucaugaaaaauccacaauggccgcagauaacauauugcagcccuuuacuucuucgacuuuuugccagcaccaacauuggccuuugcggucccccugacuuucuuuauuggguucuugcauuccuuucguugcuuucuugaggucuuuuucuucucauacaggccaugucuugcaagucuauguuuggguucauuuuucuuugcauaauccagggaaucauaaaucaugccaaagccaguugucuugccaccaccaaaaugaguucugaauccaaauacaaagaugacaucugguguggucuuguacauuuuggcuaguuuuuccugucuuaggcacucuaaauuucugucuuaggcacuguugccuuccuggggucaaggacaucaaugaccauuuguuuccccugaaguagucgguuggucaugaacuuuguaguuuggauaguuaccgugucguucaugauggcugucuauccucagacagccagggaggagaaagacauuuuuauuuagauaugugcauaaauaaagaagaagcuaauuguuucugucuuuauuaagcacauuuacaaaucucagcucuuuucaccuuugcuuuauuuuacugugcauuuauguaaauuaacacuguaucauggauaaagaaaaggacguuuucuuaggccucuuaauaggaugguuuuucuacccuguuuucugguuugucuuuaaagcuauuuaugcucuuuaaauuauccaguuuuucccacagugauuguuguggccagaaugcguuccaaggaaacagauaaaucacugaguuagggauuacaugcaauacugaaucguguccauaagauggcgcucugagaaugugagaucucuaacauuuuuagccauacauagcugggcagcauauuaaacuuuugugaaaucaaauuuuuuuugguggggaccuaguccuucugauuggcucucaagcacuuggaaccauucugauacuuaagggaagaaggaaagugaauuuucuagcaguucccuuguccuaaaucaguacuagcaagugucaaaaaucagcaagaucuguuugagagaccuuuuaaagaaaggcauuucuucuaaaugugggacuugugauacuaacccuauguguuguuacaaaugucccugucuggguaucagauucuuccucuacacagugaguggauuggaccagaugaucgcugagagugcuuccauuucaaaugaucuacauuugaauuuguugauuucccuccacuacaacauugcugccucagccagaacagaaaugagaagaaaagaucgccuauuuuacgcuuguuugacucuauuccucuucuacaagugcucucuuugcuucaacugucccaagacaagcaugcccagauguccuguuuuaaugagguuccuuuucuguuuauggcuuuugcgcagguuuuucccugcucuccccaacccccuccgcaaucccuaaccaaucugccugaacagaagcaugucccccuuuucacuucacaaauaggauuuucuuaguauuaugacagucaucuuugugcuaaacaguuaccaaacuggauaaagaagaagacgccgcauguaagguaacacuucuaacauccaacauagcauguccaguuaagaaaacauuagauuugggagguaggaacaucucucaguuuauuuuuccuccuccacuugcuaguauucauugccagaaccaugucaaagccucaguagagaagcagcauuuugcagaggaggacaauuuaauuacagaugaguauuacuaaguagcuaacccauuguuacaaucccccauggccaacaguguccccauuccugacauccucugggcagucuguggauaagaagaauuggggccacgcuggcucauccucauucaaggccugucgugaaccacgugcuccaguggcacagagcuagccugaggaaaugaaaugcugaauuaaugaauuaaugcaaagcugcagaggcacccuucaucgauugacuucccucugggcuugaagcucagagcacacauguuacaugaaauuccccaggggcacaucacacauguugccuugcuguagccaagaugacaaaggcaggggaugcacuaagacauuguuaugcugcauuuguuuuccuauuguccuuagacaguugaaaucuucaaauagucuuucguaugugucuaguggcauggauggugguggugguggauuauuuauuucucuaacuucaacaccuugucucccaagaacacaaguaugucacugaauggcuuugaccugcccacccuggccucccaaaguauggcuauuaaauagccauacugucguaucucuguguaagagaagaaacccuauacacagggcucucuccaggggcucuuaaagggcaaguccaagaaucuugcugaguaggccaagagagcuuuguggcgaugcugcugggagccuuguagaccaauauaagcagcucauccauuguuuccuacaaggaagcaauguagcaggguggugaggaaaugucaaauauuuagucaacaucauuucucucuaagaaagcaagaccagcauagugguuaagaacccacacagcuggagauggaacccacacagcuggagauggauucucaaaguucacacuccagcucugcugcagacaagcugugugacuuuaggcaagugaccuaccuucucugugccucagcagcagcaaaaacaggcugccaauaggguagucaggaggauuaaguucauguuuucuuuuucuucagugcuucgaacaguaucuggcacagagaaagcacucaguaacugacagcuaguauaaguaccaugaggugcuuugggugauuuaaaaaaaaaaaaaacuaaccaagccucugccuucaaagaccucacagaguacaugggguggcaaauggaauauacauaaaaggagcacuagcaacucagggcagugcccacaguacauuucaaugcgagagcagugaggucagcaugacucagggugguucagggaggcccucaauucucaucaggugaggacuucaggcaucuacaggaaaagguagugagaacuugaauauguucuuugccucuguuuugagggaggguacaacugauaauuuacauucauguucacauccucacuaauauacuaucuuuuugaaauaggcaggucggaguuaccucauugaagaguagaaaauagggccgggcaugguggcucaugccuauaaucccagcauuuugggaggccgaggugggcgggcggaucaugaagucaggagaucaagaccauucuggcuaacagggugaaaaccccgucucuacuaaaaauacgaaaaauuagccaggugugguggcagggcgccuguacucccagcuacucgggaggcugaggcaggagaaugacgugaacccaggaggcggagguugcagugagccgagaucgcaccauugcacuccagccugggcaacagagcgagacuccaucucaaaaagaaaaaaaaagaaaagaaaauauauauacauauacauauauagagagagagagcaagagagagaagguuucacucugucauccaggcuggagugcaguggugugaucucggcucacugcaacccccaccucccaggcuuaagugaucuucccaccugagccuccuggguagcugggacugggacuacaugcacacggcaacaugccuggcucauuuuugugucuuuuguggagaugaggcuucaccauguugcccaggcgggucucaaacuccuggacucagacgaucugcccaccuugaccucccaaaaguacugggauuauaggcaugagccaccacacccagccaauaugggcuauauuuaaccuaacaaaguugacuuggugaccugaugucaaccaccuaagguuugaaggaacucaagggugacauugugaacauugccccaaauauguguucugucauaagaaagcaccuuuaaggaaggacauuggugauugccaacauaacucuuauuaacaggaaggauuucccagaggcccugagaugugcaucugagucaggcccacuuuuuguuuuucuuuuguuuuguucucuuuugccuuuaaaacaacuaaugccuaggaauauaauguauaauauggugacuauauuaaagaauacuauauuguauauuucagauucacuaaaagaguaguucuuaaauguucucaccacaaaaauaaagauaauuaugugaggugaugaauagguuaauuagcugguuuggcauaaucguuuaacaaugaguacauauaucaaaacaucacaucggaaguguacauguauuuaacuuuuaucgauucuaccucaagaaagcuggaaaaacauuuuaauuaacugcuauauaaaaucucauucguuauauauuaaacuauuauaaagauuaaaaauggucaugguaaaaaauauuuuaaaauauagaaggauauaaaaaaauaagauuucacuagcaucucccuauucucacucacugaaagugacugcucuuauccuuuucuuauauauccaucuaaaauuuuucugggcauauuugaacauguauagaguauauaagaguaaugcaaauguagacccauuuucacugcagaugcugcuauuuguaucuguuauaauguaucucguacuugauuccauaucaacacauacagaucuacuuugcccuauuaaugugcucauaguauuucauucuaacacugauuacuuuuaaaauuugguucaauauuuugucuggcuaaggagcaaaggauagagacaugagaaacagaaaaaaguauugagagcugugggagagguaucaagauaccuaaaggauagugcaagaacacagaguuuuuaaauagugccacuaaacuuaagcaacuauaggcaucaguuggaccaggacuuuugguuacugccuugugaaguagaugcaaaaauggcaagcuuuaggccuaagccacagggcagcuauucccaacacuucuguaaccagaaaccaugcuuaauuugcuagaguccuuugaggauuuaaauagcacauggauagagcagaacaguagaugcuauuucaacuuucaaaaaguuuggcaagcuucuaaacccaaaacugucuuuuaaaaauggagucacugugggaucagggagcaguguuuaguccuggcacuuuauccauggcugcgagauaagaaauuuaaaaaaauacauagcuaaaggggcacuuuucugaaugacagaaaauaauacaguaggaccacaaaggaucagcugugggauuaauuugauuuaauauuuauaaugguuuuggaagcuggaguacggggcaaaaucgcuaaguuggcagaugucuuuacacuauuccaaugaggauaagaagcuuugggaagacgcuuguuuuauagaaguggacauaaaagugguuggcaagcuuugauaugaaaaagaccaaggauaugucucuagggacacauuccugaaguucauuucagaagauuuauaaugagccuuaccucuuuaucugcaaauagggucucugcuucaggcaucaguaggaguuaaagaagagaagauggaguugguaguaucaucagaagaugaaugauauuuaaacagaccgcauuauaugaacauaaaagaggaggcuaguagugagcugauacccaccagauaaagaauguuccuuuaugucucuuuaacacagcccccaaaggcaauugguauuugaugauuggugaucuguguauucaugaguuaacuuuuaaaguuaaauaaucugaauguguuaagcuaucauuuuagaagaaaugcaaucaaaugugcucuucagcaucuuugcuacaaaauauuuuccuucucagaggaugacuuuuaauuaugaaugucagaacuagauuuccugaccuccucuguuagcaugcauguuuuucuaaguauguccuuaauauuggcagauauauuguaucauggacggggacaucuaauagaaugagauuaguauguucugaaguugugaaauuuuuaguaauaaagaaauaaugcccuaucuaauuuucaguaauaaagagcuaaugcccuaucuaccucucaacuucacagugugguugagaagcucaaaugagcugagugauaugaaacugcuuuguaaagugcuguacaaaaauaugguaauguuaauuauucuuuguacuucauaacuugggauuagaaauauaaauugacucaaaaucuauaaauuuauccuuuauagauauaaaugccagugugugaaaaucaguauacaaggauguucucugcagcauuguuuauauuaacaaaauauuacaaauuacuguuaaucaguaaggcauuggauaaagaaguugcuacugagccauacagaggaauaagaacaaggcauuuccauguguucuaacaugaaaauauguccaaaguauuuauuuaguuuuaauuuuuguuuugagacagggucucacucugucacccaggcuagagcacagcucacugcagccuugaccucccgggcucaacacugcagcauccaaaggugugcaccaccacgcccggcuauuuuuuuuuuuuuuuuugagugguucgguuucuuaauuguuuuauuuuaagcaguucuguuuuuuuguauuaaaauacugcaacucaauauuuuugucaaaguuuccacuuucuuaucagagacaaaagccagaaaaauacaaaaaguguuccuuucccucauuucucaagcauaacauccaacaauuuggcagcugguagcuguuuuugacaguugugacuuguaucuggugauauaaacaagauuacagaagcacuaaaccauaaauguaguuucauuuuuuuggucauuacuaucauuuuacaaaauauugaaucuacuuuugaacauuaaaauguaguccagcuuuuuaaagccgcaauuaaccaccauauuuuuuauaggaccaaaacaguuugauugugcuuuaaaaaaugaucauuuagaaucaauuaauuagaauuagaaaugcuuaaugccuaccuuaaguggauagcuaauugauuccuaaaauaaaauuuuggucucuuuaaagauguucaaguugcaacauugaagcugcuuuggugguacuaucuaaaugauaaucuguuugcaaaugccaaaugaaaacucuuuguugguagauugagcuaugugccgaauuaaacacaaaucaguuuaggcaucuucacuuuucauuaucuuaucucauuggaaauuauacauaauguaaacaguagaacccgauucacugauuuuuuuuccuuaguuuaauacaagugugccucacuuuaagcaaaauauacuaaaugauuucugaaacaggaguuuccuuauuuuuucaguuaaaaagauuugcuuacagaauuucuuuaaauaacaaggcuucuuuggccuguuuagaguauucagaucacagaaauucauuucacacacaacuucuuugaaauaccuacauugcauaaaaugaggcacacaaguacaugugcccauuccaucgagauugccucauuauuuugugguuauuuuauauuuuucaguuugucguuauuaacacuuuaguaugccagguucauucacucccuauuuuaguugagaugaguuaguguuucuaaggaguguuucauaaucucuugucccaaacuaggcugguuugggaacccagugagagugacugaaaauugaaauucaaguccuaaacauacuuccagagcacagccuaucacccuguggagauaacacacaaacuaucucagaggacccccaccuguggaagugaaaaucaugugagagucauaguucaaaagaaaaaagugcugggcaccguggcucaugcccguaaucucagcacuuugggaugcugaggcaggaggaucacuugagcccagguguuugagaccagucugggcaacacagggagacccugccucuacggaaaauuggccaggcucgguggcucacaccuguaaucccagcacuuugggaggccgagguggacggaucaccugaggucaggaguucaagaccagccuggccaacauggcgaaaccccgucucuacuaaaacgcccagcuaauuuuuuguauuuuuuguagagaugggguuucaccauguugcccaggcuguucucaaacuccugggcucaaguaauccuccugccuuggccuaccaaagugcugggauuacaaguccaguccaaaguauguauauuaagugauacaaaguugcaaaucaguaugaguaguaucauuccaauuuugguuaaaauuaccuauuaguauauguaggugaaaaccucuacauguauaucaaacuguugaccaugguccacucuuggaaagacagauugauggggcaacuuuuacuuuaugccuuguuuauuuuuguacuucuuaaauuguuuacaaugaacauuauuauuuuguaauuaaaaauaugaguuacagauaucaauuuugcccuuauaacccuggcuacccuauuguaauugaaaaaaaaaaguauauaaugagagagcaaaagcccugggaaucuuuucauuucuuuaagaaagcauuccauuaucaggaucaggagcaaguaaaaaagagcucaaaaccuuuuucucucuuuggcaaugguguucugguauuuccacaugaugaaagcaaaaggaauaaaugaaaucuguuucuuguuugcuuuguuucgcaaaaugaggaauacuucuauguagaggucuggaaccaacaaggaaaccaccucauuugugaaucacugucccaguugaaguuggcaaaaccccacacuggaaggcagaauugccuaguacuuuaaauaguuacccuucucaugauggugaggauguccauugcuaccuugaaacuucaauucuggaguaaagccuaugguuuauccuacaggagcacauuaaaaucuucccuugggcugguguucucuccucucauggagaacgcagagggaagcugacagguauaauuuauggugaaagugauuugagaaagucuccugaauagauacccagcuccagagccuacaggaaauggugggaggaggaagaagaggagaaggaagagguaaagaacauggaagaaucuuucuccuucaaaugaguagaaggcucacacacagugaagguucauucugugugcuucacugucaugaccuugaaccuccccuagcacagcucuaaucacucugccuggucauuggcccuuacucuucuagacuccccacuggacugagagcacaauaagggcacacagaccuugucugucuuguucauuguuguauucccaacaucuaggggaaaaaaagcauguuguauauauuuguugauuguugaacgaauuuuuuuuuacuguaaauagacacuauguggaguggucuacuuuugcaccaugaggucgucucaugagcuuguggucagucugacuguugaugccaaauacagucagcuuuuccuuuguuugggacuuucuuugacaaaccuuuucuuuaccuucaccuuuacagauacagccaaaaggcagcaaggaauggaaugaaaaaccaguucaaucuccaugagcugaaaaugaagggcccugagccaguggucagucaaauuauugacaaacugaagcacauuaaccagguauguggaauauaaaaaauaauaauaauaaaaaguagaaauaaccgagagagaggaggagggggagagagagagggggagagagaggggggggggagagagagagagagagagagagagagagagagagagagagagagagagagagagagagagagagaaagagagauauagccagcuuccacuguucaaacuauauucuugggcuuuuaggaaagacgcuauuauuucuucaaauagucugucugcuagaaaggacuucuggccuuauuuuucaccccacuuuuaaauuauaaagacaauauugcaauuugagggguagcuuggaaaauagagggaaaaauauuucucacaaucccacuauuuuaucccaacuguuuucauuuuuacauguucucuucuaauauuuguccagaaaggcacacucacacagacuuuuuccauaauuagaaauccacaagugauuuguaguucugaaaauuaacacuaucuuggaaacacuuuucuuuuccauguugucacaaaucuuuuuguuauuguuguuuuguuuuguauuguuuugagacauggucuugcucuguugcccaggcuggaggucaguggcacagucauggcuuacugcagucuugaccuccugggcucaagauauucucgugucucagccucccgaguagcugguacuauaggcaugcaccaccauaccuggcuaauguuuaauuuuuuuguagagaugaggucucacuauguugcccaggcuggucucaaacuccugggcucaagcaauccuccugcaucagccccgcaaagugcuaggacuacaggugugagccaccaugccugguccccacaaaucuuuauauuaauuauuugucauggcugcauaauauucuguugaguauucaucauaauuaaucagcaugcuuuugcuggauauacagguugcuucaaauuuuuugccaucauaaauaaagguaccuccucauacauagugcuuuauccugaucuuagcuuauuuucuuaacaugcuaaaguuauugggucaaaggauaugagcaauuaaaaugcauguguccaaauuugcuuuucaaugagaauguaucaguuuucacugccaccagcaagacaggagagguccaauuucacugcauccuugccagcuucugacucacugccaugcacagagacacccacagauucccuugaccuguacacauaguuuuuccucucauaagaaguuuaguaacaagacacaaauagaaguuaguuguaccaucugcuuaugauugcuuuguggccacaauaaaaaugccaccaaaaaggcauauaccagagugacaguguuccugccccaugauccaugggugggaggacuguggcaucacugacuucuauuuguaguuuaggaagaacuuaaugaaacugaaauccuuaugcaagaacagagguuuuaauacaaagacauugguaugaguuuuuaaaauauggauuuuagcagugaaauuuuuguggguccuagaaaauacuuagaagggcuuucuaagaguaguauauuuuucacugcaauuggcauugugaaaguauugacaacaugcuuggguauaaacuccucuggugccugauaaggugcucuguacucagugagcacuuaauaaauagcuguuagugcugcugagcacaugguaauggcagugucuaccuaacugagccauuuuugugugugaaaguacaacuucacuaaguucuaucaagccuugcuagauauagugugaugauuucaaaaugcaucucugaggggaucagagcacaaacgauguaaaacacuuacugcugaguugagggcaugauaugcuucacuuggggacagugguacaaauuaucucaaaccaaaaugugucuagguggcuauguucaacugguuagaccccaacacuggugaggccaaaaucucaguuuccaucacugugucccuaauucuaaaugaggaauauugucaacaggucccuugugucaacagaccuuaaggauuaccuacuauguacucagccaggugccagggacuuuggggauucaaaggaagucuaguccucuguccucacagccuccuugagggaggaagcauaagcauaagaagugguuaaauaaagauaaagggcagccugugaugcagagucugaagaggagugcugcucaucgguuuugggugguaugauuaggcuagugggaagauugcagagaggggcaaguguuaagaucugccauaagcaaugaguaggguuugaguagguaaagacaagcaagggaggggcagucauaagaaagaucgagugaagaccugugggcggaccccacccuagaaaaugggaaagcugcaucagacaugggcuucuauaugaucaggcagucacuaaaaaauauuuauagcaaguccuuucagcaaaggcuuugggcacaguagaaagaauuugggcuuuguauccaaauggaucugaauucaguuauagauuuugcuaggcgcauaacuuuggguaaaucaguuaaccucucugagcuuuaguucucucaucuguauuaugguaaagauaucaaaaacuccaguguauaucuaucauauacauauauauaauauguacacauagauauauguaauugcaugugcaugacaggcacuuaauauauggcaguuaguugugaggacuguguuuaggauuuucucuauaggcaggacuugaguuugaaagggaguuccaguacuuucugcgagucuaauucuucucccccaguuuuguauguuuguagaucccuuugaugcaucucuucuuucucucccauauugucuccuucuuuuccucuccucuaacuuucagccacaaaagcugaaaccagcugacagguagggagauguacauagagugagaaaagucgcuauuacaauuccuuuuuccuaccucuggccaugaauaugugcaugaacauuuucaguuucuauacaaauaccauugagcagccaauuaauucucauugauaaaccaguuuuaccuguuucaguugagcuguuaaaauugguuggacuccaaacacccacauugauuuuuuuucucaucuguguugcuuuauauagccaaaacacauuuuuucaguccuuaaauaaaauuuauauuuuggccaugauucgaucugaaagugagacacuucagggaagucauaaagaagaaagucaugaugaugaugaugaugucgaugaugaugauaaugauaauguguucucuuuguauagcauuuacccauauuucaaagugaugucauguucuaaagucuaacugcuuaggaaaaaaauccaacuuggaauuauauaagguauaaaacugugacagaaucuuuucaagaacucauuauuacucuuaaaccuuaucucauuuucacuguuuuucagaagguaagggauaaauaauguuuguccuuuuuauaguuagagaaacugaggcagaaagccauuaauggcuguauagacauacugccaaaagauccagugaguucaguuuaaaacucaaucaaucauccagauguuuccuauacacugccaaacaucuggauucacugaaugccugacuaaaucggccuaaagauuuggugauagggaggaagaaucaaguuaacuuucuaaguucacauguaauugaguggugaaucugagaaugugauguuauuuuccuaagccccuugcucggugcugcaucuauuaaaacuacaauagcaugcuccaacauacauauuuauaaauacagaaauacuucuccucucucucucucucucucucucucucucucucucucugcauguaugccccaugugcguccauccagaugaacuauagcuaggccauuuaugagcacaucccaaaauagcuuuucacuuuguuuccugggaauucucagcugccuccuugcagguuaugguuacuguugauagcgcuggaaagaauauacccacuaagggaauaaaguaacauuauuuucauauugauagucccaugguauaaccuugaggggauggguucagagccaggcucaggccccuuuccugggaaggccuacagguguggaauguucuccccuccuccuuccaaggcagaguucauguguaacauucccacgaucagaaaugaggaccuuuuuauuuccuuuucaguuucuaauuugugugaggacuuauuuucuuguguuaggaaaagaauugaacucuuuuauguccucagugucaguccuggaauuugcuaggccauguugcuuuaaaacaacaacaacuaaguuuuguuuuuguuaguaucauucugcuccaggcuccugcauggagagaagacuccacaauuaccaaaaacgaucacaacacaucguuacucauauaauacuaugggccauuuauccccuaaccuaguuuuguuguuaacuuuuucucucucuuuaagaguaguuauguaguuagugcuaauuuaguagucccuaaacugcuacaggacuuauuguucccaaggaaaaaucuauccauuuauuguuuccccauuucaguucagguucaaacgaaauaccagaaauuguuuuccugcccguuguaaacaguugaagccagaguagucaauaccugcccacuuggugucagagcuuuucauucaaaguuagauaaagucucaucuguuugggaucguugaaauguccugcugaauggugggggaguggacgagauggccucuuaagauuccuuccagccgugugauuccaugauuuguggcucaaggucaggcuuuaacccagcacccucuugugaacaagucuugugacuuuauucucugcucugccacucuuuuuaaaacacccuguucccaggucaccccuuuccacuuuguaaccucucaucuuuucaaagguuguucccuucccaccagucuuccagccugggcagauggaacuuaaacuugcccuuccccccacccaauucuucuguucugccuuguucucauuaggcuaugaaaacauuaaacuauagaaacaguuuugcauuuaucaccccuaaguuucccuccuccagggccagauaggugaccuguuuucgaaucauguuaaccaugugauuccauaugaaugauaauucugccauauguuuacauagcacaauucaguuugcaaagcucuuuccuauccauuagauaacgugaucuuuauaaccacucagagaggaaagcaaggcaggcauuauuacuuacauuucccagaugaagaaacugugggcauuagaagucuacugaguuccauacaguaagugguagagcuagaccuagaauccagagcuacugauuucauucucugugcacuuuccuuuacuuguaccaagacauggcacaccuauuaggaagaucuauauagaaaagaugugcagaauacaaauaacaaaaacuccuuaauuuguggucugauaauuuucaagugccaaauaugguaauuucuauggccaaagcucuaaaaucagcagcaaugaaagauuaagcacauuguuuacaaaaucucaguuggugagauucuuggaaaacuaaccaccacauuguauggaaacagaggaacuuuguggcaugaguuugaguuauaaauagcagaagaacuuucuguuagugagcccuacuucauagaaugauguuaaauggucaaagauaauuaaaaaaucuagaacagaugcugaaaugucuccacuuccaucccccucuguaaacaccagaaaauuauuuuuaagaugccuggcagacucuagugcaaugaagaaacuaacuuuugaaauagaaaguuaaaauuuuuuaauaaguuaauuaguaaagcuguuaagugccaaaggagcacucaggacauuccuuagcaugugauuuuaauaaaauguuugaaaugaaucucagacaugauggaaaacacuccaaguaacuuguuuucauagucuucucacaauaacaccagugagaguuguaaaacacuggccuagugcagugguugcuagaaaagccaauauugagcuaaaauuucuaaauaaaaggagaaaccuuuugaaagucaacuuuaaauaaaagaccuucccaaauggaauuaugucccagugucugucuuacuuguucacaagugacauggcagaacucuaguaauugccauuuauuuccauacggagccagaaugugugugugugugugugugugggugugugugugugugugugugugugugugggugugugaaggacagaguaccuacaagacauguuagcaaaagccaaugaaugacuucugagucacaaaaggacaaugugaguuaguccuuaaauaccagacuuagacucuguggaguuaaacauuauuucaugaaguaaaagggaauucucugauauauuccaaaacggauuuaucauuaaaaaaucuucugucacuuugccuaauagccugaaaaauaaucacaaugucugguggcuuuggggagcauguguuuuuaauaucuuaauuacuauauacaguuuaauaacacugcaccaagaagaauucccaaguauuucauacuaaauuucuugaaaaugaacuauuugcuauauuuagaauacacaggauuaaagguacuuaaauuaggucauguauuuuaguccuugcauauuaaauuaaauuacucaaaaauggaagaugagucagaaauggugagccaaaauguuguugguauuaguguuguggucaucuugauugagcaauggagggaaauacaugaacuuuucugauuacauuauuguauucuuucauaggauauuuuuaacuggacauguuagcaauggaaagacaaguucuacauaugaaaagagaauucugucaaacaauauagacuaccagguuuaugaaguuuagaaauacauuucuaaauuuucuaugaaauucauagggucuccuauuguauuuacauuuacccacuggccaaaugcagcaucguuuuuuguuuuuuguuuuuuguuuuuugagacggagucucacucagucgcucaggcuggagugcaguggcgugaucuuggcucacugcaaccuccaccucccggguucaagcaauucuccugccucagccucccgaguagcugggauuacagguacccaccacugcgcccagcuaauuuuuguauuuuuaguagagacaggguuucaccauguuggccaggcuggucucgaacuccuaaccucaggugauccgccugccucggccucccaaagugcugggauuacaggugugagccaccgugccuggcugauauuuuuuaauaaacaguuacaaaugcucauucccuaaaacguuugcaguuacaaauauuugcuauaugagguauaucagucuguguguauguauguguguguguauucaaauacuauuucagaaauuaacccagauauauuuaugaauauguaucaugcuucuagacuguaaacucccuaaguguggaaucacacauuuaauucuuuguaucccauggcaccuaacacaauagcauauacaaaguagacccucaauauauauauaauuaauugacugaucagucaauucaaaggacuuaaccuuugcugcccuuauuucugaauuuagauuucauuuaagguacuuuucgcauucaauauuaaccagugucugugcuaaagggcagaauuauauaagugcaggaucauagggucuaacccuuugauuuuacagaggauguuaaagccaggagagggaaaugacuuguccaaagucauacuaccaguaaaugacaacacugggacugggaaaugaacagguuaauauucuauagugccauuugcucugcuuccaaaggcucuugaugcaaacaugcuugcaaauacacagacacauuuucuuauacaguaaguacuccaaaucauggcagaagcccauaguuaugaaguucaucuuuggaacaaauggcugcacaguaggaaucaugaacuugcuaauuauuuaucacuuauuuuggauauuaacuaaguuugggccuaacaaguauaccuuagugcccaacugccucauucaacucauugggcaguuguugcaccggguggggaggucucugcugggaucacugaaccaaaggaaggcagaaucagcaagaccuguugcucauggccuuuuacccacucacagagucugacucaggcuccuguucucauucagggucagucauccuuucagucucauccccuggaucucaacuccuccaccuuccuggacaucuuauaauaauuuaucucgugccuccuuccuccuuccagaaugacaaaauuagcaucauauuagucagugggcuuaugugccagauagcucaguuguuuagggcaguguauucagauuguguuccauagggaaugugggagaggugcuguggagguuguucuaagucccccauuccuauuuuaaccagagcagcuccguuuuuaaaaaucuucuucacauauuggucuucuaaguaagauuucacuuaaagggguccaacugcaaaaauaacagaaaucuuagaugcccuuaaagcuaacauuaaaggcuuaaucccacgugagccauuucguaauuugaguggucaaugaagguacuaaauaucuauaauacacaaggaagucacagcaugcccuccaguccccaucagccacuuucuaaaaugaacugugggucagaauggagaccaaaugggagaaugugaauggcuuggugguaacauuauugaagugauagcuaaaggcccaugcucuaguacuagugaaccagaaguggcuucuuugaagcugaugaccaacauauaugaguuuucuuugcccaugucauuaggauucuaacaaaauccgaugaaaacaaagugcugagcugagcucuuuugucuugaacuagcuugucuauauggugcagucuuguguuaauuggcccaaacaaauguuuggucuuaguccuuuaaucccauggcuauuugagaucuaguguucaacuguagauuuauuugacacauagcaaaaaauguuuccaaauucuguaugggcucaguguugguauauaguuaagguaaaaugguaauaaugagauuaauucuuuacuccuaacuaugugcuuuccuuagauagugagcacagugauuuuauguagcaacuguuaaguggagugucuccaacagaguucuaauuaauauccaaaauaaagaugacauuauuauuuauaugcacuggaucuuauuggauaauuucuuaaguauggucuucuuuuccuuguuuaauaaguugaucuagauauuuuuuucauagucccuauuuugcuaagucaucacuucugagaguaauaucuguucuguauuaugggcaagcagcugacgaaaccaaauaaaagcuaagagaauuacucuucugguaugucacaaaaaugagguccaaguucagguuaguuacauucaaggccacugaggauucuuaugguuauuaucaugguaucacuguuauuaaacuuugaagcaucacaaagaauuggugaagagccaaaagacugaagacuggcacaauuguuuaccaucaccuucaauaagggauggaaauuggauucuggaagccacaaaccagaaagucuggugucacaucuuaaugaaauucuagauuagauucuuggagagcaugagcucuuggaagcaaccauggugguuacaaguagccacuguggacuuacucagaacuaaucaggccauuuccccuuauaugugcguacaugcacaugccuuauugaucagaggaauggcauagacaugcugggucuagauuucagcaagguguuugacagagauuccuaugauuuguuuuaaaauaaguaaggagaaacauuggcuaacugaucaucuacuuggauaaauguguagcuaauuaauuaucauauaugaaauguaucaauaucagcccagagugaggccuuugguuauuaacuuugugcuuagccccuuauugccuaaaguuuuugcuagugacuuaacugaagauagagaaggcauacuucuaauauuuagugacugcaugaugcuagguggggguuagugaauacauagauaacacaauugggaugcaaaaauaucucaguaggcugcaaugacaggagaaaacuagcagaguaauauccccauggggauaaaugugaaguauuacauguagauucacaaacaugagugccuaagcaugauaggggaaauccaacuuagcacacauguuaguuuuuaguuaugauggaaacagcuaugaaaccuucacugacccaaaacaauaucccccaaauauugugauaauuuggcaacucucuugauguuguugccauuuuuggugggaagagagggauacguauuuacauguauguugaggugggagagggagagacauggaagugacuagaaaaguacucuccaccgcuugcagugagccgagaucgcgccacugcacuccagccugggcgacagagcgagacucugucucaaaaaaaaaagaaaaaaagaaaaaagaaaaauacucuccacccuguuuaaagguuaaaaaggacuguuuugggauugugauguucacugcuccacaugaguuuuuguuacaccaauacuaccuguuuuaguuguaaagcaucacugguaugugacugagagucucagugagacaucugagagccaaaacacuggauuauuuaguuugggggaaagaacaaaggcuuuagagccaaauagaucuauuuuuaauucucagauuugucauuuuguaguaacuuggcuuuagggcaaauuacuuaacuuuccuauacucaugcuuccuaaucugugaaauggguauacuaucaucuaucuugaaaaguuaagacaaauauuagggauaauauaugugguaggcacucaauacauucuagauacuguuuuucuucauauuauuacaauaugaagaguuagcauaagggcaagucaagagugaccuuuuaagugacuugagucucugugccucaguuuaucaauuucugaaauggagagacuacaacguuuccaguuuggaguguuguuuaaaugauuuaaaaauucuaaauauaauaaucuaaauucuaaagauucuuggaaaaauauaucuagccaaccuucaacagauuuuugaacuauuuaaagauuaguuuggcucaaagugacugaauggaaaaugaagacgauuuuuuauauguguguguguguguguguguguguguguguggguggguguguggguguguuuaaaucaaguucuucagauuuucccaaguuugaacucugcccugaaguagaggcucuauaaauaggcaggcugcccuuggaguacagcuuagagauuuuaccacaugauccagaagucccauuuuaaucuucagccccaccaggaccuuucauggaaggaugguaucaaguggagagacuucagagcuauaaagaucagggcaaguuaaucugcauuccuuuugcauuuugcucucugguugaagauggugagagguuccuauauuuaaaacccgguugacaugauauccuuauuggccgaugucucacaggagguauuuagaaugauuuugagcagcauauaauauguuugugaguguguguguauuucacaugccaacagagcagaaagaauucacagggcuuguggcuacugagcuuucuugagacaccaucacucucagcuguuggggugaugucacaguuacaagugacacugccuaggcccaaauucccaaagcucuuuuuugcauugcagagccuagggcagaccuacaccaugggcucuaccuucaaagaacuauggaauuuguuagccacagacugggaccagugaccacuuguugucaggcaaaaggaaagcugcccccugcugccugagccuuugugccugccugggauaccauggaaaauggggaaggaauccagacucauuaaugagcuaauacaaaagauuaagccaagcuagaggcaguuuguuauagcugcauauggaugcucgaaggcagucagagcugaaagaucuccagaccagaacccaguggugcugccgccuuuguuugccagacacaaauauaggauaaggguauccccauggggagcaauuuucguauugccaauuucuuuuuucaguuaugucauuccccgagcuguugugugacaaauugauugaucaguaauugcaaucugauaacccaugguccaaauuauuguuaaaacugcagguuucauuauaauauacugagauggaacucagaucugagcuuuuacuuggucuaauggucuuuguucuuguuuguuguucuuggaagucacuuaaagcaugauuacuucuauggcuccuuuucaaaaugaaauucacaaggcaaaauaaaaaguaaaauacacacacacacacacacacacacacauauauauauauccucgucauuuauuaggaguuauuuauugaaugcccauuuuuuauguagugcuggauuugauggggucuguugauaaggacauagagaaucccccccaccuacacacucaucacauaugcauauaucaucaccauuugcauucauuuauucaauauugagcaagcagcucucugugccaagcacugagcauaggggcugcagacaaagguacagagauaacuuaagcacuuucaaugagggugaugaaaacaugccuaccuuacuauacuccaaggcacagugugucauaaaagaaauauaaaccaaguacuaugcuagccuggagaagagaaggauuaauucuuaccgagggaauuagacaagacuuuaaaaauaggagguagccuuuaagccagccuuugaaagaugaggagaauuuugacagaucgagauuggaaggaaggaucuuccuggcagaggaauauggcaugagcaguggcucaaagacaugaaaguacaucgauagcauuauguggcuggggagcugaggccacaagccagauuggaagaggacguggacagugaaagaugagauggaaaaggugguaaaaaauuugggagggccaugaauagcauacuaaggaaucugagcuuuacucuguggcagugcagagcccaugaagggcuugaagcaugagagugacauggucagaucaguuaacaucaguaauguuaacucugccagcagcgugaaggauguuuuaaagaucagaaauuggaggcaaggaguccaguuaagugauagcauuuacaaggcaaagaaggaaaguuuguuauucaaauucauuacccuuccuuuccacugccugaugggaaaauggaagggguauccaaucuuuuggcuucccugggcuauauuggaagaggaagaauugucuugggccacacauaaaauacacuaacacuaacgauaacugaugagcuacaaauaaaaauugccaaaaaaaaaaaaaaaaccucauaguauuuuaagaaaguucacaaauuugcauugggcuucauucacugcuguccugagccguaugcagcccgugggcugcggguuggacaagcuugguuuaggagaugagaaccgcuuugucccuaaaguugacuuaaucaucuuuuggccauuagccaggacauaggagaggcuggagcaggcagugguuugggucuccgcagaagguaguagggugcggcccucccacaguagaccaguagcuucuccaggucccacaguagaaaaugaaaagaaauuucuaguaccugcagagauuugucccuuauugaaccuuuaguagaaguucucacaaugagguauuuagauucccugaugaauguguuaacuauuacuuuuaaucaauuuguuacacacuuuuuuuuagucagaauuccaauuaaauguagcuccuuggcuguugaauguugagugccauccauucacugaagucucaaaaauuaccaaaacugugagaaagaucgagagagauuauaguguuuuucuucagcugccacugugggugcuuagauguguuggagagacuacuguguuucgugacagccucacaaagaagagugggggccccagagggaagcagugacuguucgccuucuccauaccuucucagaacacauuuuccuguuuguuaucaacuccuaugucuuucuaauuauggcagcuccuuauagcuggugcuguuucacuagaacagucuccaagaacuuuacacauguuauauauaagaccucgcuuguucauuuuacucaagcaugugcugacaaggagcugaccugacauuucaccaagacgcucugccuuguacucgacagugccucuucucuccaccuuagcaccccugugcccuugcuggucagagcagaugcugagaagacagagcggaugucucgguuaggcuaaccuugccugucccacucaccaccguaucuucagcucuuugaacaaugccugguauagaauaaguggcugauaacuauuuauugcauaaauaaguaaaaaacucuguuccucuuuauccucaguuuagagcuguguggacagggugaauauauuuugcacauggaaaagauaugaauuucagggagaaaauguaguggcagguacagagagaaggcaagaaaguagggggauucuuuucgccaucaaaaaaguuacaaaauguuaccuugggguuuugcuuuucaaguauguacagaauauuuuauuucuucaagaagucaucuggaauagcccuuccucuauuuuauugagaaaugcaguggaauaauaccacagcuuccccauaagucuucauuacaucaguucagaagguccucaacuugcgaagaaccuggaaaauccaugaacucucuuccuguucagucgcccuuuucugaccuucacuugggggcuaugcuguggcuaucauacaguggaauuauuuuagacagagcccccaggcucuggccuacuccccaccuacucugccuauucaguugcuauaaaauauaguauugagcaaagaugggaaaccuacuuugucugucaaagccugaguaauagcaacuuucauuuucuuggcugccuccuuucaacuccaagcucagcuuguugaggccugaagagcugagccaaaacagcaauucaugugcguauuucuauuuagacuccagucucccuggguaguguaguccuguggugauucaugccucgaguauagauagcuagauauugggaaacuuccuuauuugcaggauauaaaagugaaugaagugaucaaaaucuuuggcauaccucccccuauugcauagcuuucucgugcuuucccuaagagaaucauuucuguaaggaaggacagaugggucugugauccucucuacuuucaguauauucccuggaccuacuauguccuacucacuucucugcugacaucacuaggccugaacucucuucuauguagccgauuaccagugcuuucaggucauucuuuguacaauucugucuaagauccuuuucuguccccaugucguugcccuaguccagaccugcuuugcuucaccaucaguccugugcugggcacaggaacuagaaaaaucaaugagauagucacugcccuuggcuucuagggacucacaaucuuuuuuuuuuuuuuuuugucuuuguuuucuuauaguacuauagucuucaacuucuauuuauauuuugcuuuauauauuuucuuuuguugauccagaaacaauuuuuuuuguguaacuuuuuucucugccacaaaaagacauguugccuuccuuuuauaagucccauauuucccugacucccacuuaugccaugccaccuucucugagggagagguacuucucuccccacaauuccucacuuuuuuuucuuccuauccacccacucucaucuuccacauaauuuaagaauuccucuuauagguugauuuauuuucuauggucuuagugacucugucuuaaagggaaaguaauagaagaaaugaccuggagaaagacagugaucaagaccaaguagcauuuaucugggacucgcugaguguuaguccuugucuggaugucucacaaccucuaauaaagaacaccauguuugcuaugugcucccuucuagaugaaaaaaaaacaguccauaaucuauaaaugcuuuuggcuagcaaugaugaacagcagcagcuuuuauuuuuuuucaaagcgaaagcaccagaaguuuggaaaggaauugcaaguuauguuguaaugcaacugaucuccuucuuccugagaaaguugguuucucgccagaguguucaauucaggcccacgcaaucuggguguauuuauagaggguccaacaaggaagagaacaugauaagcuuuccuccccaguaugguagacaacggcaaacaaucgccaggugaaugcuauggggagccaaaugccauuuagguaugugacagcagacaucugcuagacugagaggcccgccugccccucaaagcaguugaauccgguccgagaaguuagaaauauuauucuggaugauggcaagaucucagagaguuuugggggcccugucugugugggggacaucuaggagaugagacccacucuaaagcugccuaauucuuaacaacauaaaaauguuaauaagaaaauaagaauccagcuaggugugguggcucacaccuguaaucccagcauuuuaggaggccaaggcggguggaucacuugaggucagaaguucgagaccagcuugggcaacauggcaaaaccucaucucuacuaaaaauacagaaauuugcugggcaugguggcaggcgccuauaaucccagcuaccugggaggcugaggcacgagaaucacuugaaccugggaggcggagguugcagugagccaagaucgugccacugcacuccagccugggugacaaauugagacucugucucaaaaaacaaaaaaaaagagagaagaaagaaucccugcagcauuuaaguguuuuaacacuuuugagacccauaaauauaaauguuuuauuuacauuaucacauuuauuucacauauauauuuuaaaaauuaaugcauauauauguauguggaauaaagucuguaagaauuauaucaaaacauuagcaguauuacaguaauuuucauuuccuuuuuauaucucucugcacucugcccaaaugcuuuuuaaaauuauuuuuuaaaucagaaaaaacaauaaaucuauaggcucauacauguaaauguuuuauuuacauuaucacauuuuucaccacuauccucugauuaauaauauccacuguuaauuauaguuagcuaccauuaauauucucuuuuacagaugaggaaaauggcagucagauugugaguaacuaaaagguuaaacuuggacuugaacccacguccuauuacucuaaaauuuaugauuucuuuuuuauucuguugaagaaaugagagccauuagcacagucucauugucaaggaggucacuugaaguagccagaaacuagcagcuccaccucuaacaauuucucccaaggaaagaacaugacaaucuacaaagauguauguauaaggauauuucaguagcauuguuuaugaauaacaaaaaaauaaggccgggcucgguggcucacgucuguaaucccagcacuuugggaggcugaggcgggcagaucacgaggucaggaguucgagaccagccuggccaacauagcgaaaccccgucucuacuaaaaauacaaaaauuagcugggcaugguggugggcaccuguaaucccagcuacucgggagguugaggcacaagaaucgcuugaaaccggaaggcagagguugcacugagccaagaucgcgccacugcacuccagccugggcgaaagagcaaaaccccgucucaaaaaaaaaaaaaacauaaaaacaaaagcaauccaaauguccaucaacagcagauuuauuaugggaacuaugcuguuuccauacaauggaguaaucuguagacauuuaaaaauauuuuuuaaaacacaguugugcauagaaagauaccuaucauauauugcuaaguaaaaaacaacgcagacuaugagacaguaguaaaguacaauccaauuuuuuaaaaaauuaauguguauauauguauguggaauaaagucuguaagaauuauaucaaaacauuaguaguauuacaguaauuuucauuucuuuuuuuauaccucucuguacucugcccaaauacuuuuuaaaaauuauuuuuuuaaaucagaaaaaauaaaucaauuuucacuuaaauaaacuuuuugaaauagauaaagacagauguaagacugaaaccacgcuggaccaaagcaaagcucuuccuccuugguccccaacugagcuguauucaucucuacuggcugucucagaagcagccuagcuucugugaggaggcaacagcaguaucacuuggucugguggccuggugaccuccugaccagugcauacugacccaguguuccaagccuuauagccuagaagucauccccuuaauucugagggcagcaccaaggaccuuuuagagacauggucccagggacagcccccaugaucuacaccauccaggauucuagcugacaggcacacucagagaugugugcacagugagagguagcccccaugcaucugaacuucucagaauaacccaguaugauucugucauucacaaaugggcccaaacauuuuagaaucuauuucuauuuuuggccaguccaacuccuuagggaaauaaauuccuuaguauuugauaugcaaaguagggccucccuuuaucuaaccccaaaccaucucuuucaaguucaaggggauaccccucaaacuccaguauucuagaacuuaaauugugguuacucuaccuaucacauuguaugcacuucuuuucuuucuuuuucuuuuucuuuuccuuucuuucuuucuuuuuuuuuuuuuuuuuuuuugagacguaguuucacucuuguugcccaggcuggagugcaauggugcgaucucagcucaccgcaaccucugccuccuagguucaagcgauucuccugccucagccucccgaguagcugggauuacaggcaugcgccaccacgcccagcugauuuuuguauuuuuaguagagacgggguuucuccauguuggucagguuggucuugaacucccgaccucaggugauccgcccaccucagccucccaaagugcugggauuacaggcaugagccacugcgccuggccuguaugcauuuauuuucuuuuccccuucagucgucauauuuucagacucgagaagcuagugauuuuaguuugucccuauauagcuuugcuuuguucuccauucuucauuguuuuauuucaccuucucuggacauuuuccuguucuauuuugucuucuuuaaugugccaccagcagaacauaaccccaaauauucugggaauaagguacaguagcacauauaugguagugcuaaaaacaguuaccgcagcuugaaagcaacuucuuucuuaguggguugcuaggugcagacauucacaaguucagcuuucaaugggagaagagugaucauuaaagagcugugaaugcuggucuguuuuuccuuaccuuagagauguauauguggccuccguuuuacauuguacuaggaucuaauggaaccccaaacuagguuugauuguggggcagggugggugggggugcagugggaaaucccucaaaucagugaaacaaacgcugauuccaaauguagcaugcaggcucuauagaauaagacagcucuaaucucucaaagaccaaagauaaggccaucugacagcuuugcaacgucagagacuuucagucauuucuuuacacacauguaaaaccuuuagacguucuugagaaaauaaccuuuauuucaaaaaauagcuuugaaguuugaaaaucaaagcaggccagcuguuucucagcacagaaagaauuuuuccuaaacugcuagaaagcuaauaaggauuucaaagggcagugaucacuuacucuaaugcccacgguccaggaagcaccaggcgugggacaagcuguuuacugcaacuaacacaugaacuagggagugugccagaccuuccucuguguuuguccaucuuuuccugugucccaguaucuaguuuuucuccuuuucucucucaccauccccuggccucucucuuucuauucucuaccuuuuguuuucuuuuucuaaucucucugucuccucuuuccugacguuuuuuuuuucuuugagacagucuugcucugucacccaggcuggagugcaguggcaccaucucggcucacugcaaacucugccucccggguucaagcaauucucccaccucagccucucgaguagcugggauuacaggcgcgcgucaccacaccuggcuaauuucuguauuuuuaguagacacgggguuucgccauguuggccaggcuggucucaaacuccugaacucaagugaugcgccugccucggccucccaaagugcugagauuacaggcgugagccaccacaccuggccuggacaucuuuuuuuuuaaccuccucauuccccaaacuugguauagcauacaccuggaauuuuuuuaaaauuuacuacaccuauucaauggaguuuuccuuucccuguccuuauuuuucuuaaagaaaacaaggugaauguuuucuauuucuuccacaaacacaagcaaaaaaaaaaagcuaaacuaaaucaagcagcuucuuacuuguguguggccccaacugauuuuuuuuccucugugggucaguggcccuugauagaaaaaaagguccccacccuugcacuaaggggucuugccaauuuaauucuucuucagaaaaggggaugaauaacaguauggacaauuaguuacugugggugggagaaggaauuuggcuggaggcaauuuucuuuggaaagcgauaggacggcacaagagguugaaauaguucuacgugugaaaaauagaggguaugaaauaacuuggaaaguucagcugagaacaggagcaucuggggcuuauucaugguuuuucagaaguuuuugaagcuuuuuuauuagcuggguugaccucagauugaggaggagauuuuucaaauguuaaacaguuuuuucuuuugcauuccuaaagucauauuguguucagcuuguuaauaucugcacagggggccuucggcagaggcugccagagcggcgugcuuuugggacauaguucccuauagcugguauuucccuuucuuguugaggauuugcaugugucucuuucauccacgcauacagcagauuccuccacaaauaauugcauuugacaucacaguuguuagagaaaaugcaggggagggggaaaagccucccuuuccuccacacugagacagcuggagggaggaagcagguuagacagggaaauacauaaacauaccuggaauguagcagcagguaauucugucuguguuagucaugauaauaacuugcauguuggaauaucaauaguguagauuccaagaugucuaggauuuagaaaggaacaaagaaaccaccacauaucaacaccuagcaucucacugauuuacugugccuaagacaggaaauauuggcaaacauguuuaguuagaaucaauggaguauguuccaaggugccuuccccaaauauuuuuuacagaagaacuuuaggcaauuuauuuccagcuucuaguggcaggggcaagugcacccugcugggaaacugaaaucuggcucaugauagacuggcaggaguugggggccggugucagauuccauuugcacucccaguagaaguuacuggaacccucagaaaggcacacucuccaaaaaggaguguuuguucagggcaugacaguauugagaacagcaaaaaauaaucuauccacuaacacugugaccagcaguaacuuucuauguuagaaauuaaccaguacugccuaaacagaagcccucauucuuaauggucugcaaaauguuccguggcuaaaacuuuuggagguaagucagugauuugauuuuuuuuuuuccuauuaacugccaggccuacaaaguuuucaugcaagcaaaauaauuuaaacaaauuucccaaaauuugacauuuaaaaauguuuggagcuguucugacacagacauucuguguucuguauuugguuuauggacuaugccaggcuccuugauuaacagguagaggacauacccacaguucaauagaucaacacauaguauuugaguucuuacucuaaauguuuauuguuuauucagucacugagugucagguacuuggguaggcucugggagagacacaaagaugaaucagacacaguaccacccucaaaaagccuuuggccucauagaagagacagauacagacacaaauaauuacaauacaaggcagaaugugauugagauuuuaagacaaguccaaacaaaauguuuugugagcacagaugaaaugauuagauucaccugcaggaauuggggaagaauuuauggaagaaauuacauaugagaugguuccuggaagauaaucagaauuucaacagaggggggaucacucaaggcuaagagaacagcguggacaaagcacagaggugugaaacuguguggcauauuuagagaauguugauuagcgagaugugugcggugaauucugggagaugagguugggauaaugaaguggaaguauacagugggcaguuauaaauuugaauuaggagccugagggaaaagucuagacaacagaauuuuuacuuaaaacaagcuuguccaacccacggcccacgggacucaugugucccaggacagcuuugaaugcggcccaacauaaauuuguaaacuuucuuaaaacauuaugagauuucuuugcgauuuuuuucuuuuuuuuuuuuuuuagcucaucagcuauuguuaguguuaguguauuuuauguguggcccaagacaauucuucuuccaguguggcccagggaagccaaaagauuguacaccccugauuuaaaagucuaaaaaguaucauucccugugaaccacaugccuugaggaacaauauuagaacucagcaucuguucuuuggggauccacaacuaaauuugaggcaaggcauucauauacaucuacauuggaaaacagaacgaccuacguauuguaugaugcaguguacaugggcaccagccaagaguggaugcaggagagcacaauacauuauugguaacuugucauuuuugaggccaaccuggaguugguccaaguugcuuggcccccgcuccaacucaugugucacucccuuccuagacaaauacugacacaaaccacaaacagacuucauucaucagcacuaguguuugggaaggaaggggacagaggagaaaagacuggcaggcgagggaacaagcaauucauuuuuaggcuugagaauaagaaaauuaacuggucauaaauuccagguaaucgguuuuucucuuguuuuaucaugaauaaaggacguguucacauuuugaaaguaacaccucauaguacagaauggaauaagcaggcaagccaaauucauucuuugcuuuuguaaagugugagaaagggaaguuuuucugacccauacauagauucccuaaaggacgaaaacccuucucauuaugaacacauagguaccugacacuuugugcugcauugaaaauagauuuaauuaaaauauuuaguaaugacucauuuugagggccagguauuuacacaucaugauuuugccucuaagaauuucauagauuuaaaagauaaugugaccaggcacgguggcucacaccuguaaucccagcagucugggaggcugaggcgggaggaucaguugagcccaggaguuugggaccagccugggcaacauaccgaaacccugucucuaccaaaaauaagaaacuuagccaggcuugguggcaugcaucuguguucccagcuacucgagaggcugaagugggaagaucgcuucagccaaggaggucaaggcugcagugagccgugaucaagccacugcacucuagccugggugacagagagaaaccuaucucuaaaaaaauuuuauuuuaacaaauaaauaauacaaaagagaaucuuuggugaauuaauguuguccccaauagaauuuucuucuggacaacauuaugcaaguccccaugaaugacuuuauaggagaaguccuggaaaagagucuaauuucccacaagugaacuuccuagcucucccuuugaaucugguuggcuaaggcaucugcugccuuuuuuaaaauuauuuuuuauuuuuuauuuuuuuuuuugagauggagucucacucuguugcccaggcuggagugcaguggcacgaucuuggcucacugcaaccuccaccuuccggguucaagcgauuuccggcuaauuuuuguauuuuuaguagagacaggguuucaccauguuggccaggcugguaccaaacuccugaccugaagugauccgccugccucagccucccaaaguucuaggauuacaggcgugagccaccacgccgcacaucugcugccuuuuaaagcaucauucuucccacuugauuuucaucacccuauacuacaaggaccagugcaccugucuuguauuggaaaggaaauaaaugucaaagugagaacaaaauaaggacaauuggcucauuccaaguuugcgugggacuggagaacaauugcuuuucccagcguguugggcagggguggugggaaggcagcugcauggggaagaaguguuaaauuguggcuuguguucauauccauugcagcuaucaucccuuuaaaucacccccaaauaaugcuaaguucuuauuuagaaguaaguuuuucagagagccugccaucugaauagugaggggagaucugcuagugagaagccaugcaaaucacccuccccuaccacaaaacaagaucagugcaacagcagagguuuggggcuccaaaugauuccauuuugaauaagaugugaugccaagguugcaaugacuuuuaggugugaaagauacuguggcuauuuauuuauuuauuuacuuugagacagagucucgcucuguugcccaggcuggagugcaguggcgugaucuuggcucacugcaaccucugccuccuggguucaagcgauucuccugccucagucucccgaauaccugggacuacaugugcaugccaccauguccagcuaauuuuuguauuuuuaguagagacaggguuucgccauguuggccaggcuggucucgaacuccugaccucaggugauccaccugccuuggccucccaaagcguugggauuacaggugugagccauugugccuagccccuguggcacuucuuaaaggagaguuugcccugaucuccuuggccaaaguucacaucugguaaucgcaucuguugacacuggcuucccuuguccuuucagcuauguacaauauuggcucucucgcauccugucuuagacuguucuauaguguugcuaugugcuauuaaauagcaaucgcauuucaccgaguggagaaugcauguggaaauccuuugggagaagugugcuguagaaauguuggauugacaauguuuuuuuucuuuugugaaccaggaaguguaaguguaagaaacagaucuaaacacuguucggaauaauuguuaguguguacggcagaguaagcaaugaccauauaugcaagcccagguauuccagggcucaacagggcccauuagagauagggaaaugaaaacagaauguuuuuuaaaaguaauuuaagugagugggcuuauaguucagaauaacauauaaagaauuuuggaguuuucuggaaaguagacagccucuauuugaaugggccuuugcaauuuaugaaguguuuuuuuuuuuuuuauguacacacacugaauucccauaaccaugugagauagguauaacucuuauccugauuucacagcauaggaaacuaaggauuugugagguucagggaucugcauaaggucucacuucuggcaaguagaagaaacaaaauagaugggaauccagguuuucugaccuuaaauccuuugucuguucagcacaccauaacuagaugaguguguugguugugguuugaugaauggagugugagucuggcauacuuucuuagguauauuuuaaacacugaaugacuagaauuccuggagauucuggaaagcucaguuguuuuuugacaccugaagguuaggaccaaaauuucaaaauguuaaacuguuuuuuaaaauacaguuuaacauuucuaaaauagacuucccuacuuugucacaugauugcuuucuacuguagauggaggugcuuuaaguugucacucuuuuaaacugcuacuggccuuggcugugucccagagaccuccaggccucacagcauaacucaaauaagugcucuccuucugguccauuuucacuuucuugucauuuucguguuguuggauaaaaguauuuugcauagguaaaagaguuaguauaccuuagaaaugacuaauuucuacagagcaaggaguuuacucauuggauaggauccucucauagagauuuauuauuauuaaauauuggcugugggaugaaaaagagagauuucagaagagcaggaauuucauuuuaaaaagugucaacuugaacuucauggaguuaauguguuuccuggccgacggcaugauuauaggugguugaaugcuaggacaggggaggagucugguaagguacugcuggcugaaagauagcuagcuuucuacuggguuuuuacuccaagggcagguauuuuaauccaagcuugaguuccucacuuggcacacagacuagcauaaucucuccaucuugcaaagacauuuuugguuacuuuauugagguauaauuuacaucucauaaaauuuaccuauuguaaauguacaaugcaaaauguuuuccugaauuuauacaauugugcaaccaucaccccaacccaauuuggaacauuuccaucaccccaacaaguugccccauaggccuguuuuccgucacuucucauucccaccccagccccaggcaaccacuaaucuacuuucuguccuuauagauuugccuuuucugaauauuucauguaaauggaauucuacaagauguaaucuuuugugucaggcuucuuucauuuagcauauuguuuuucagguuaaucugugcuguagcaugugucuguacuuuguucuuuuuuguugcugaguagcauuccauuguacagguauacauuuuguuaagaauauucauucaccaguugauggacauuuggauuguuuucugauuuggaauguaugaauaaugccgcugugaacauacacauacaaaucuuuguguagauguaauauuugcacuucuuugagguagauaccuaagaguguaauggcuuggucauauaauaaauauauguuuaacuuuuucagaaacugcuaaacuauuuuugcaaaauggcuguaccauuuuacauucccauuaacaaugcaugaggguucuuuuuauccauauccuauucuacauaugguauugucauucguugauuauagacuuucugguggguguguagugguaucucauugugguuuuaauuugcauuucccuagcaagugaugauauuaaguaucuuuucauaagccuauuauccacugguacauauucuuucaugaaauaucuauucaaauaguuuuuaauggauauuuuauaguuucaauggagagaaaaaaguggaaagaauaugacuaugccaggagauuuuuugcauucuccccuccuaaguauucaucagucuuuguuuauuuuuguaguuggcuuugggaguuuuguuuguacuguuuugagcaaguaaagggcugacaugguccauagcaauucauugaacuaaacagaauuucuguauggaguaggaauagaguuucucuccucuagagcagagguaaaguuaccuuaaacugcuuugggugagauauuacaaagugcuuucauauguauuaucucauugacucucuguaguuguuucaugagguacaugcuuuuaugaucugcucuuuacagaugagacugauuggauaagugacuuauaccaggaucaucaguugguaaauugguagagccgacucuugaccccaggucuccaaauccucuacucuuuccacuauagcaggcaaucacacuuaagguccacuuuauuuucauguaucagaacucuggcaaagcccagaccagcaccuucaggauaucacaugugggaauggcugcuggguaaacuuugaggaaguguuuccucccauaccugaguaaauggcuuugcccauuuucccuuggcccagaugucuggaucucuguguuaugagcaaacugauuguaaucuggaaacaaugaggacucagaacaucuguugagagaaggaaaucuaauagaugagauggcauauucugauuggagauuauuuuagguacaaaucaguuuacauaaaaccaacuaaauaauguuuaauugacaaaaugcuaaggcauaggucaaaauauuguuuuaaaauuauuaaacauagaaaugagaauacuaauauauuuauuacuggagaaaugacauuaaaauauauuauauucagugcucccuaagguuuuaagaaaguuuuauugguguggggagugugugaguaacaguucuguaucacucaggggcacauuuuaaagcuuuuuaucuguuuggccucauaaaucauugaacaugcaugauaauuucaguauuuaauaugcauaugaaaauucacauacugccucacauacucaaauacagcaugcgugcacacacacagacacacacacacagagacauauacacauccuuuguuagaugguaugcuuugguugaguugaaaauaugguuauuauuacuggggcauauaagagaaauguaaagcacagucccuuccccuguaaagcuuacaaguuauggagcacugcauguucacacagaaagaacaauuagaaaauaguauaaggcagaaccuaagcaacugcuaauuugggcacaaaaacaguaagaauuacgaaaaggaagagaucacuggaagcuacgugcuguggccaaagcaacuagcauaguguuggacuaucuaucuauuuagcuauccauucauccaucaucaucuaucuuaaacuuuuaaaauuacauauguucauuggagaaauuuagaaauuauauauaaguaaaaauaaguuaaucuaccccuaauccuacuacacagagauaaccacucuuugagcacauauguuguguugcuuuuaaaguaacaaguguuggugggguaugcuggcucacaccuguaaucccagcacauugggagaccgaggcagaaggaucacauuaggucaggaguuugagaccaaccuggccaacauggcgaaaccccguuuuuacuaaaaauacaaaaacuagccagacaugguaguacacaucuauaauccuagcuacuugggaggcugagacaugagaaucaguugaacccaggagucagagguugcagugagcugagauugcaccacugcauuccagccugggcaacagagggagacacugucucaaaaaaauuuuuuaaaaaauuuuuaaagugguaaauguuaacuguuuuaaaaauaacccaaaauuccuguauccugaaaaaaaucauuaucacauacucaaauacagcaugcaugcacacacacacauucauucauucuggcaguauguccuaaacuguguuccacagaacuuuuguugguuugaguuuguuuuuuuuuuaauacgugcuccuucagcaagcacaugaaaaaugcucaucaucauugaacaauugguaaauguaaguuaaaaccacaaugaguuaucacgucauacccaauuagaauggcuacuauaaaaaaaaacaacaacagaaaauaacaaguguuggggaggauguggagaaauuagaacccuugugcacuguuggugggaaaguaaaaugguguagcugcuaugaaaaacaguauggugguuccucaaaaaauuaaaaauagaauuaucauaugauccagcaaucccacuucuggguguauuuaauauucaaaacaauugagagcaaggucugcaagagauauuugaacacucauguucauagcagcauuauucauaauagccaaaaguuauuggcauaauagcagcccaaguguuuaucaacagaugaauggauaagaaaaaauuugguauauacauacaauggaauauuauucagccuuaaaaagaagggaauccugucacauucuacaacauggaugaaccuuaaagacaucaugcuaaguuaaauaagcaccacaaaaggacaaauauuguuugacuucacuuauauaagauaucuagaguagucaaacucauagaaauaggaagcagaguuggugguugccagggacuauggggagaaggaaauaggcaguuguuuaacagguacagaguuuuaauuuugcaagaugaaaauguucuggagauugguuguacaguaaugcaaauauauuuaacacuacugaacuguacacugaaaaaugguuaauaugguauauuuuuguguguuuuacuacaaguaauguuuuaaaaaauguguuccaugugcucaaguaaggaaacaguggaccaaacaaaauuaauguaguuuguuuauagcaagacuucucagaaccuuuaauauacuaauguguauugugacucugcaugaggagauacaguguaauguguuuucccaacuuaucugaccaugggucucuuuuuccaauauauuaugggacuagcaaaauauauuaaggaacacacuuuaggaaauauuacuacaaaauguuggugauuuaaggucuuaccucucuaagagacauuugauuucaaggagacaccuggggugauuaauguuuauuccaaaggaaugugucucuagagauagaaugucaagucuuguaaauaccuaagaaggaaaaggucuggggcacaaggccacccagcaccucucagaucucugcuugucgacagccaaauauucggccugccuggaaggucagcccagcauuuuggcaauugagaggaagccuucaaauuuagaaacuacucuuaggaggcaacaaucuucagugucugauuauagaguuucguaauuucauuaaggcauccagucauuccaguacagacagcagccauuuccaagcaagaacuuuaaugcuguacuggaaacucuggauggacagaauucaggucaagggaaagauaauucucuagguugaauaucuucauguguaauucaaaacgagaguuugcuaguagauuuaaauguacuguaguugaguuaaaggaggaugucaugguuaaaagccaagcauuuccucuaggagcaggugaaaaaacagcugacauuccugauuguuuuucuaaguguuuaaaaugacuuuuccagaccugaagccuguaagcauuuuauuaacauuugauuagcaauuauuccuuacuguguugaaccugaaauuaggaucagguuuccuuacauuaccacaaacacacacacacaaaacacaaaccccaaguaacucaacucuuucuuuauucuuuuucuuuuccuuuuccuuuuuuucuuuuuucuuuuuuauuuuugagauggaguuucacucuuguugcccaggcuggagugcaauggcacgaucucggcucaccacaaccuccaccuccugaguucaagcgauucuccugccucagccucccaaguagcugggauuacaggcaugcaccaccaugccugacuaauuuuguauuuuuaguagaggcaggguuuauccauguuggucaugcuggucucgaacuccugaccacaggugaucugcccgccuuggccucccaaagugcugggaauacaagcaugagccacugcgcccggccaacucuuuuucacaaagguucauuccaaaauaauuuccccuuucccuuuccuuagcaaucucaaagaaucauagacugaggccaggugugguggcucacaccuguaaucccagcacuuugggaggccgaggcaggcagaucacgaggucaggaguucuagaccacccuggccaacguagugaaacccugucucuacuaaaaauacaaaaauuagccgggcauggugaugcgugcccguagucccagcuacuugggaggccgaggcaggagaaucgcuugaaccugggggguggagguuguggugagcugagaucgugccacugcacuccagccugggcaacaaagcgagacuuugucucaaaaacaaacaaacaaacaaacaaaaaagaaucauagacugucagagcugggaaagacuuagagcucauguaguccaacuccuuuuuuggacauauggggaaaccaaggagcagagagguggagcgauuucccccaauacucaaagagugacagagcugagaaaaccugacugcuugucuagugcucuuucuaauauaguuacuucauuagaagaugauccauggaggcccaauauaucuaugacuacaggucaaauugguuuauaauguauuggacaagcaaauaauaacgguuuuauuugaaugccagaaugugauuucucauagguaauacaauuuguaagcugagcaugaaauuuaaaaccugaaaugaaucaguguucacagcauguaagaauguauauuacaaguguaauguaacauuuuguuuuauguguaaauauauagcaguuaggucaaauacauccaccagaauuacuugguggccuugauucgcguggacauccauagcagauucugaagagaauuuuuacugugaauuauauggcuucauagguacucuguaugccauacccuauuuguaaguugcaagcaggaaauaguugauagcaaaggucagcuagaguauaauggagauaaaauguugguugcguaaaauuuuuuaaaaagagggcucuuuaguaauguuuauaaucacuugcuaauuaacauauugguguguuauguauuugaggccacauaucuuuuuuuuuuuuuuugagacagagucuugcucuguugcccaggcuggagugcaguggugcaaucucagcucacugcaaccuccaccucccggguucaagugauucucccaacucagccuccugaguagcugggguuacaggcgugugccaccaugccuggcuaauuuuuguauguuuaguagagacaggguuuccucauguuggccaggcuggucuugaaccccugaccucaggugaucugcccgccucagccucccaaagugcugggauuacaggugugagccaccacucccggccaaggccacaugucauuaagcagcuucaaauccaucaaccaauuaggauaacaauucugaugucaacuaguaguuuauuucaugguucucuacagggauucuuaccacauuagaauaauuaaugucaggacacacuguuuuugauguugcuugggagaagccacaacuaaguaaacaaccucauugguuugugaaugcaaauauugagauagcuggagucuaguuuuuuuaggauagcuaaacaacgaccucugaauggagggguuauaaagaacaacaacaaauagaagaguggauuuaaagauuguuaaaaugcuuaaaccaucgacacaaaaagucauacuucuuaagacauauuuucccucuguucuagacuccaggauccucaucuacugaugucaaacaauagugcaaacagggagucuuguaagcggcucuuuguaaagagaauuaaugacuugguaaaugcaguacuuggcaguaaacauuauauuccuauagccuuagcccauagggcucugcguuuacucagagccuagggaggcagauuuccccauagagacugcccacagaaucauuuguuuccuuuguggauuuggaauggauuuggaauuuguacuuuuucucuuuuuguaacaauaagccucaaaacauugcauaugcuguccuaagauaccugcggaucaaaacauauaagccuuuaaauucacuuagccaguuuuagaaguuggccuuuguugaauuuguacuuaucagauagaaagccagcaacauuaguuuagaggaaagaguguagcuauguucugaaagcauuugaugguuauauuugaugaagcugggaauaugauggaaauuucagaaauauaacaaccuccuaugccauguuucuggcuugguauccagucauucacacagucccuguuaauauuaacgguaggaaugaauuuuacucccccaggaaacuauaaacuuucaauauuuuauucaugguuuaagaauacuuuugacuuuugaaccuaagauuuuagccaaauaagaacuauuuacugaacucuuuuuuuuuauacuuuuaaguuuuaggguacaugugcacagcgugcagguuuguuacauauguauacaugugccauguuggugugcugcacccauugacucgucauuuacauuagguauaucuccuaaugcuaucccuccccccuccccccacccugcgacaggccucagugugugauguuccccacccuguguccaguuguuuucauuguuaaauucccaccuuugagugagaacaugugguguuugguuuucucuccuugugauaguuugcucagaaugaugguuucagcuucauccaugucccuacaaaggacaugaacucauccuuuuuuacagcugcauaguauuacaugguguauaugugccacauuuucuuaauccagucuaucauuguuggacauuuggguugguuccaagucuuugcuauugugaauagugccacaauaaacauacgugugcaugugucuuuauagcagcaugauuuauaauccuuuggguauauacccaguaaugggauggcugggucaaaugauaauucuacuucuagauccuugaggaaucgccacacugucuuccacaaugguugaucuaguauacagucccaccaacaguguaaaaguguuccuauuuguccacauccucuccagcaccuguuguuuccuaacauuuuaaugaucgccauucuaacuggugugagaugguaucgcauugugguuuugauuuguauuucucugauggccagugaugaugagcauuuuuucauguguguguuggcugcauaacugucuucuuuugagaagugucuguucauauccuuugcccacuuuuugaugggguuguuugauuuuuuucuuguaaauuuguuuaaguuccuuguagauucuggauauuaccccuugagagauggguagauuguaaaaauuuucucccauucuguagguuucuguucacucugaugauaguuucuuuuguuaugcagaagcucuuuaguuuaauuacaucccauuugucaauuuuggcuuuuguugccauugcuuuugguguuuuagucauaaaguccuugcccaugccuauguccugaaugguauugccuagguuuucuucuaggguuuuuaugauuuuaggucuaacauuuaagucuuuaauccaucuugaauuaauuuuuguauaagguguaaggaagggauccaguuucagcuuucuacauaugucuagcaaguuuucccagcaccacuuauuaaauagggaauccuuuccccauuucuuguuuuugucagguaugucaaagaucagaugguuguagaugugugauauuauuucuaagggcucuguucuauuccauuggucuauaucucuguuuugguaccaguaccaugcuguuuugguuacuguagccuuguaguauaguuugaagucagguagcgugaugccuccagcuuuguucuuuuggcuuaggauugucuuggcaaugcaggcucuuuuuugguuccauaugaacuuuaaaguaguuuuuuccaauucugugaagaaagucauugguagcuugauggggauggcauugaaucuauaaauuaccuugggcaguauggccauuuucacaauauugauucuucuuauccaugagcauggaauguucuuccauuuguuuguguccucuuauuucauugagcagugauuuguaguucuccuugaagagguccuucacaucccuuggaaguuggauuccuagguauuuuauucucuuuguagcaauugugaaugggaguucacucaugauuuggcucucuguuugucuguuauugguguauaagaaugcuugugauuuuugcacauugaguuuguauccugagacuucgcugaaguugcuuaucagcuuaaggagauuuugggcugagacgaugggguuuuguaaauauacaaucaugucaucugcaaacaggggcaauuugacuuccucuuuuccuaauugaauauccuuuacuucuuucuccugccugauugcccuggccagaacuucuaacacuauguugaauaggaguggugagagagggcaucucugucuugugccaguuuucaaaggaaaugcuuccaguuuuuccccauucaguaugauauuggcuguggguuugccaucaauagcucuuauuauuuugagauacgucccaucaguaccuaguuuauugagaguuuuuagcaugaagcguuguugaauuuuaucaaaggccuuuucugcgucuauugagauaaucaugugguuuuugucuuuguuucuguuuauaugauggauuacauuuauugauuugcauauguugaaccagccuugcaucccaaggaugaagccaacuugaucgugguggauaaguuuuuugaugugcugcuggauuugguuugccaguauuuuagugaggauuuuugcaucaauguucaucagggauauuggucuaaaauucucuuuuuuuuuuuguugugucacugccaggcuuugguaucaggagacuacuggccucauaaaaugaguuagggaggauucccucuuuuucuguugauuggaauaguuucagaaggaaugguaccagcuccucuuuguaccucugguagaauucagcugugaaucccucugguccuggacuuuuuuuugguugguaggcuauuaauuauugccucaauuucagagacuguuauuggucuauucagggauucaacuucuuccugguuuagucuugggaggguguauguguccaggaauuuuuccauuucuucuagauuuucuaguuuauuugcauagagguguuuauaguauccucugaugguaguuuguauuucugugggauuggugauguuauccccuuuaucauucuuuauugugucuauuugauucuucucucuuuucuucuuuauuagucuugcuaguggucugucaauucuguugaucuuuucaaaaaaccagcaccuuggauucauugauuuuuugaaggguuuuuugugucucgaucuccuucaguucugcucugaucuuaguuauuucuugccuucugcuagcuuuugaauguguuugcccuugcuucucuaguucuuuuaauugugauguuagggugucaauuuuagaucuuuccugcuuucucuugugggcauuuagugcuauaaauuucccucuacacacugcuuuaaauaugucccagagauucugguauguugugucuuuguucucauugguuucaaagaacaucuuuauuucugccuucauuucguuauguacccaguagucauucaggagcagguuguucaguuuccauguaguugagcaguuuugagugagucucuuaauccucaguucuaguuugauucccuguggucugagagacaguuuguuaaaauuucuguucuuuuauauuugcugaggagugcuuuacuuccaacuauguggucaauuuuggaauaggugugguguggugcugagaagaauguauauucuguugauuuaggguggagaguucuguagaugucuauuagguccgcuuggugcagagcugaguucaauuccuggauauccuuguuaacuuuuugucuuguugauccaucuaauguuggcagugggguguuaaagucucccauuauuauuguguggaagucuaagucucuuuguaggucucuaaggacuugcuuuaugaaucuaggugcuccuguauugagugcauauauauuuaggauaguuagcucuucuuguugaauugaucccuuggcauuauguaauggccuucuuugucucuuuugaucuuuguugguuuaaagucuguuuuaucagagauuaggauugcaaccccugccuuuuuuuguuuuccauuugcuugguagaucuuccuccaucccuuuauuuugagccuaugugugucucugcacgugagaugggucuccugaauacagcacacugaugggucuugacucuuuauccaauuugccagucugcgucuuuuaauuggagcauuuagcucauuuaccuuuaagguuaauauuguuaugugugaauuuaauccugucauaugauguuaucugguuauuuugcucguuaguugaugcaguugcuuccuagccuugauugucuuuauaauuuggcauguuuuugcagugucugguaccaguuguuccuuuccauguuuagugcuuccuucaggagcucuuguaaggcaggccugguggugacaaaaaucucucagcauuugcuuuccuguaaaggauuuuauuucucauucacugaugaagcuuaguuuggcuggauaugaaauucuggguuaaaaauucuuuucuuuaagaauguugaauauuggcccccacucucuucuggcuuguagaguuuuugccgagagaucagcuguuagucugaugggcuucccuuuguggguaacccgaccuuucucucuggcugcccuuaacauuuuuuccuucauuucaacuuuggugaauuauguuucuuggaguugcucuucucgaggagugucuuuguggcguucucuguauuuccugaauuugaauguuggccugccuugcuagguuggggaaguucuccugaauaauauccugcagaguguuuuccaacuugguuccauucucccugucacuuucagguacaccagucagacguagauuuggucuuuucacauagucccauauuucuuggaggcuuuguucauuucuuuuuacucuuuuuucucuaaacuucucgcuucauuucauucauuugaucuucagucacugauacccuuucuuccaguugaucgaaucggcuacuaaagcuugugcaugcaucacguaguucuugugccaugguuuucuucuccaucagagaagcacucacuccauuuaagugcuucucuacacuguuuauucuacuuagccauucaucuaaucuuuuuucaagguuuucagcuucuuugcgaugggcuugaauauccuccuuuagcucagagaaguuuguuauuaccgaucaucugaagccuucuucucucaaaucgucaaagucauucuccuuccagcuuuguucuguugcuggugaggagcugcauuccuuuggaggagaggaggugcuccgauuuuuagaauuuucagcuuuucugcucugguuucuccccaucuuugugguuuuaucuaccuuugguguuugaugauggugacauacagaugggguuuugguguggauguccuuucuguuugugaguuuuccuucuaacagucagaaaccucagcugcaggucuguuggaguuugcuggagguccacuccagacccuguuugccuggguaucaccagcagaggcugcagaacagcaaauguugcagaauggcaaauguugcugccugauaguuccucuggaagcuucaucucagaggggcaccuggccguacguggugucaguuggccccuucugggaggugccucccaguuaggcuacuuggggaucaggcacccaguagaggaggcagucugucuguucucagaucucaaacuccaugcugggaggaccacuacucucuucaaagcugucagacaggaacguuuaacucugcagaacuuucugcugccuuuuguucagcuaugcccugcccccagagguggagucugcagaggcaggcaggccuucuugagcugcaguggacuccacccaguuugagcuuccuggccgcuuuguuuaccuagucaagccucagcaauggcagacgccccucccccagccucauugccaccuugcaguucgaucucagacugcugugcuagcagugagcaaggcuccgugggcgugggacccuccaagccaggcgcgggauauaaucuccuggugugccauuugcuaagaccauuggaaaagcacacuauuagggugggagugucccgauuuuccagauaccgucugucacagcuuccuuuggcuaggaaagggaauuccccaaccccuugcacuucccgggugaggugaugcccugcccugcuucggcucacgcuccguggacugcaaccacuguccgaaaagccccagugagaugaacccgguaccucaguuggaaaugcagaaaucaccugucuucagcaucacucaugcugggagcuguagacuggagcuguuccuauucggccaucuuggaaccucuccccugaacucuuuuuuuuucccagugcuucuucuugugcuaaaacucuauaggcccuuaucauacagaacuaguuauacugcugcuucuuguugaggaaaagagucaaacccuguaaaauauuugaagagauguauucugagccaaauaugagugaccaauggcccaugacacagcccucaggggauccugagaauguguacccaaggugguugggccacaacuugguuuuauguauuuuagggagauauguaucaauuaauacauguaagauguacauugguuugguccggaaagguaggaaaaccggaaauguaggcuuccaggucauagaugguuucaaagauuuuuugauuggcaauugguugaagcacuuauaaucaauagaaaggaauaccuggguuacaauaaggaauuguggagaccaagguuuuauugugcagaugaagccuccagguagcaggcuucggagagaauagauugcaaguguuuccugucagauuauagagucugcucuaucaguaauuccaaaagggugggaggaggguauaaugaggcauaucuggcucccuuucccaucauggccugaacuaguuuuuccagguuaacuuugggacacccugggcugagcaaggagugguccauucagaugguugaggggccuuagaauuuuauuuuugguuuacauucuugauggcucuucuccuuguauaucucacuuuccaugggcuaaaugaauacugaaagcaaaucugugaaaaauccuuuugcaagauugagaccccugagauuuuugguguaauaagauaauugaugugcuggcaucauaguucucaggcaaguugaaguagaaaaauaaaauaaagguuccuucuuagaauuaucccaaggaaauaucuuuucacaggaggggauaccaagucauaccuauaaagaguagaauuuuuuuuuuuuuuuuuuuuugagacagagucuugcucugucucccaggcugaagugcaguggugugaucuugggucacugcaaccuccaccuccuggguucaagugauucuccugccucagccucccaaguagcugggauuacagguucccgccaccucacccaacuaauuuuucauauuuuuaguagagaugggguuucaccguguuagccaggauggucuugaucuccugacaucaugauccgcccaccucagccucccaaagugcugggauuacaggcaugagcuaccaugcccggcaagaguagaauuuuucaaucaccuucuuaacaccagacaauaggaaguuugguucugaauuugggguugcaaauucuuccuaauugguuagugcccuuuuuguugucuuuuuuuuauugaguaaaauacacauacuauaaaauucacccuuuuaaaauguacaauucagugguuauuaguauauugaccaaguucugcaaccaucaccucuaacuccagaauauuugaaucaucucaaaaagaaacuccauuaugccccuuaccccugaccccuggcaaccccuaaucuacuucauauuucuauggauuaaccuauucugauaguucauauaaauggcaucauaucauauauaguuuuuuuuaugucuggcuuucuuagcauaauguuuucaagguucauccacaauguagcauguaucaguacucauuccuuuuuauggcugaauaguauuucauuguauagaaacaauauauuauguuuauccaugcaucuguuguuggacauuuuggcuguuuccaccuuuuggcuauugugaauaaugauaccacaaacauugguguacgaguaucuguuugaguuccugcuuucaguuauuuggggcauauaccuaggagcagaauugcuggauuauauguaauuuuauguuuaucugauugaagaaccaccaaacuguuuucugcaaugaauccaccauuuuacauucccaccagcauuguaugaggauucuguuuucuccauauccuaacaccuguuauuuuccauuuuuaaaauuauuauuacagccaucuaagugguugugaaauaguaucucauugugguuuugauuucauuucauuuauggcuuaugauguuaagcaucuuuucauuggcaauuucuauaucuucuuuggagaaauguuuauucagauccuuuguccauuuuuuuuuaaauuggguauuugccuuuuuauuuuugacuuguaagaguucuuuagauauucuggauacaagacucuucagauauaugguuugcaaaaacuuucucccauucugugggucaucauuccacuuuuugaugguaucuuuugauucauaaaaguuuuaaauuuugaugaaauccaauuuaucuauuuuuucuuuggccauuaaauaugcuuuugcuuaacccaaguucacaaaacccuauguuuucuucucaaaguucugucauuuuugcucuuacauuuuaaccuuuggucuauuuuuuuuuuuuuuuuuuugauacagugucuuucucugugacccaggcuggaaugcaguggcaugauuuuggcucacugcaaccuccaccuccuggguucaagugauucuccugccucagccucccgaguagcugggauuacaggugaccgcuaccacaccuggcuaauuuaacccuuggucuauuuugaauuuauuuuuguauaugguauuagauagggauccaaauguacucuuuugcaugugauauccaggucucccaccaccauuuguugacaagagcauucuuucauuuugaauuuauuucauuaugaauuuugaauuucauuuugaauuucuuucauuaugaaugaaaagagcauucauuuauucauucauuuguauccagacgguuuaagaaaaaaaucugucuuauauuuuuaguauauaggagccaguguugcuucuauuuguuuugaauacaaauuccauuuuucuuugcauauuagacccuauauguaagaaacaacuuuacacaauaauuuguuugcugguaauauuuggacaagugccauaaauucauguguauuguacuuucugaauagauuuuuucuaaucauagcaaaauuuauuuauuucaaaacuacaacucuuugaaguguucagcuauaauaaaauuuaguuauaaaauuauguggcacuacugaaaaucuaaaggauaaucugaagaaugaguaagacaaauauugauaguaauuuuuaguauuuucaaaauguuucgguucacacacauaaaugaaaucauuuuaaaaacuaggggcugggcacaguggcucacaccuguaaucuuagcacuuugggaggcugagguaggaggauugcuugagcacaggaguuggagaccagccugggcaacauagcgagaccccuguagcuauaaaaauaauaaugauaacuagguaccauauuucagaaaccauugugaaaaauaauaacuagggauugauuauaguaucuuuacucuguauucacaaauugaucucuauauuccugaacauauuuaauccuuugauuuaccuuugacuagguuugucauuguaaucccuagguugcuuaggaagauacuauuugguuugaugaaaaagccggaaugauaauagcucaaacucuuuugagcauuuaguacaugcuuggcacuguucuauacauuuuaaguuauucacucauguauuuaaucaucaacacccuuauaagguaaauaucccacaauuacuuuuguaccaaccuaauaccauugcagacaaggaaacagaugcaaagaggcuaaguuacaagggcacacagccauuaaacuuuggaucuguagagugacugggcuucaaaguccucuuccugacugcuauucccaugucuuuugcaaagauaagucuuugacagguauaugcuuaauuaaaaucauguuuagaaggaaaugagacaauagaauuagaaaaagaaauggcuguaggcuucaaugaaaaugaccuuugugacugggugaaaauuguuuggcuggauguccuggaaaauugucuucugggaauaucuauauuguaggguucacuuuugucauagaauugcuucuuggcccauuuaagagagauacuuuaaguucguuauuaauaaaucaaauauuuuuauuuuuuaaaaaagagcauucuuucccccauugaauucuuggcacucugucaaaaaucaauuucuaggcuaggcgcgguggcucacgccuguaaucccaguacuuugggaggcugagguggguggaucacgaggucaggagaucgagaccauccuggcuaacccggugaaaccccaucucuacuaaaaaauacaaaaaauuagcugggcgagguggcgggcaccuguagucccagcuacucgggaggcugaggcaggagaauggcgugaaccugggagacagagcuugcagugagccgagauugcgccacugcacuccagccugggcgacagagugagacuccaucucaaaaaaaaaaaaaaaaaaucaauuucuguacucucaauuauauuccacugaucugucauuauuccaagaccucccugaacuaaguacaguacauuuacaguaaguuuuaaaauauggaauugugaggccucugacauuguucuguuuuuucaaaauuguuuuggcuauucucaguacuuucauaugaauuuuaggauuaucuuguccauuuaaaaaaauaaggcagcuggaauuuugauagaaauuguauugaaucuguagaucaauuugaagaguguuuccaucauacuacugaggcuucuaauccauggauauagggcgucuuuuuauuuacuuaguucuuuuuaaauuucuuguugugauguuuuguaguuuucaguguauaagucucacacuucuuuuguuaggcucuaaguguuaauuuuuuuggauguaauuguacauagaauuacuugauuaauuucauuuuuagaguguucauuguuagucuauacaauuaauuuauuauaucaaucguguauucuacaaucucgcugaacugauuagcugauaguuuuuucugaauaacuuaaaauuaucuauguacaaagucguguuacuugucaauaugauuuuacuuuuuccuuucuaaucuggggacuuuuauugccuaauugccuggcuauaaccuccaguacaaugucaaauaaaagugguaagaacagacauaguuuucuuuuuucucaucuuaaagagaaaacuuucaguuuuucuccuuuaaguauacugauaguugugaguuuuagauagauauugcuucucagguugagaaaguucccuuuuauuacuaguuuguugaguuuuuuuaaaucacaaaaggcuguuggauuuugucaaaugcuuuuucugcaucuauugugauaaucaugugguuuuucaccuuucuuuuuuuuuuggauugcauuuucuuucuuuuuuuuuguauuauaccugaaguucuaggauacauguucacaacgugcggguuuguuacauagguauacaccugccauggugguuugcugcacccaucaaacugucaucuacauuagguauuucuccuaaugcuaucccucuccuagccccucacccaccgacaggccccagugugugauguuccccucccugcguccaugugcucucauuguucagcucccacuuaugagugagaacaugugguguuugguuuucuuuccuguguuaguuugcugagaaugaugguuuccagcuauucuuaaguuauauuaauauaaugauuuauauaauauauuucuaugaauauauuguauacauugauugauuuucauauacucaaccaaccuugaauuccuguauuaaaugcuacuugguuaugguguauaauccuuuguauauguugcuggauucagauugcuaguauuuuuaaaggaucuuugugucuauauuuacacaacacuuugaucuguaguuuucuuuacuuguaaugucuuugccugguuuuaguguuaggguagcacugacuucauagaaugaguuggaaauucuuccuuucucuuccauuuuuugaaaauuuuguggaggauugguguuaauuauaguuuaccauuugguaguauuuaccagugaagccaucuguuccugggcauuucuuugcaggaaguuuuugauuacuaauucauuauuuuacuuguuauagaucuauucagauuuucuguuuuuucuugagucaguuuuaguaguuugugucuuuguaggaauuugucuauuucgucuaagcuaucuaauuugcuggcaugugaugucuauaguauuccaguauaacccucuauagcucuguaagaucagugguaguguucccucuuucauucuugauuguaguaauuugagucuucucucuguuucuggguagucuaacuaauggcauaucaauauuuuuaaucuuuucaaaaagcaacuuuggguuuuaugaauugucucuauuuuuaaauuucauuaauuuauacucuaguacuuauuauuuaccuauguaguuaccuuuccuaauauacuuuauuucuuccuacaguguggguuacugucuaguguccuuuuacaucugccugaaagacucuuuuuaacauuucuccuaggguaugucuacuaauagcaaacucucucagcuucuguuucuguuucuuuuaauuuccccuuuaguuuugaaggacacguuugcugguuauagaauuauuagaugacaguuuuuuuuuuuucuuucaguguuuugaaugucaucucacugccuucuggcuuucaugcuuucugaugagaaauuaguuguuaaucuuauugaagauuacuuguacaugaugaaucucuucuuucacugcuuucaugauuuuuucauugucugacuucaacaguuugauugacauacauagguguggaucucuuugaguuuauccuaguugauguuuguuaaauuucuuagacacauaaauuuauguuuuucaugaaacuuaggaaguuuucagccauuaugucuuuaaauauucuuucuuccuauuucucucuccugcuucugggauauccauuauguauauguugauaugcuugaugguaucccacaugacucugcagauuuguucauuuuuguuccuucuuuuuuucuuuuccucauaccgaauugucucaauugaugaagcuucauauucccugauuuuuuauucugccugcucaaauuugcuguugaguccuucuagugaacuuucauuuguuauuuuacuuuucaacuccagaauuucuauuuugguguuuuauauaauuuuuaucucuguuaguauuguguaugucaugggacaucauuauaaaacacuucuuuaauucuuuagacaugauuucuuuuaguccuuugaauguguuuuaaauagcugauuuaaaguuuuugucuaauaaguccaaugucugugcuuccucaggggcaguuucuauuggcugcuuuuuuccccuguguaugagccauauuuucuuuugguucaauuuuuuaaaucuccauuuguucaugaggaaguaacauggaugcuuggaaauuauuuuauacuugugggucuauuguauuuacaaaaaccacucucuuacauuuuauaguuuccaaaauacuuauuuaaguuuauuacauuugauccuaaaagcagcccuaugcuuuuuccagggcagagauuauuuuuauuacuguucuacagaugagaaaacugaaacuccuaugacaagccucuuuccauaauacuguauauuuuauguaucccucugucuuuuacauuuagccugcugccauucauaauuccacuauguuguuuuauguacaagcucaguuugguuucuuucauucuuugggcuugauauuauuccagauuguuacaaaaauagguuuaaaauuguuguaaaagcucuuggaacauucuuauuaaauucuuuuugugaagcaaauuacauagaagagcaaccacauucaccaaaagccauaaauacuuagauuuacuucuggcuccuaagaguauucuucauuugggagaaguucauuuguauucagguuuauuuuacauguucucuuauuucaguugcuuuuuuuucucaugauauuuugauuuuuaagguaccaaagccuuuuucuuauaauacagggaauuugaguuaaaguuugaagauaggagaacuagacaacugucaguguggagugaaugcaaggauauccagaaacaucccaccuacaccaaaauaucuguuucaccgguguuccccagucucuauaauuuccacugccaaucauuccuuugggaugagccauucuucccagaaggccauguuuaaaugcacaguuuaccaaaggggaagucauaucugaaaucauuauuauuuucuauuaacagacaaaggaaucugacauuuauucucagucuauugugugcccaggcacugugcuaaauuauuuccucauacaguucauauaagguaggugauauuaucuugauuugacaaauauggaaaacuuaaaccaccaagaacaagauccuaagugauugacacagauuuugccagaguggaggaccugaagcauggaagagguuccccaguuagaugagugaauaggcagacauugagcauucaagggccauuuuaaaagacugggucaucugaggagaagcaaauagagaagaccaaccuuguccaauugaagguacuguuucuuuguuucccugucagcuagacugaguggugagaagugcuguaaauuacaaggacggagagagagggagagaggggugcgagaaauagcagacuuugauaauuauuuaccauagggcuagaaagugaaauuuuacaaagcaauacagugaaugagugugcuucucuaaaagcaagauaauauuucuaaggguaaaguuuugaccuacauaaaggagcgaauguuuuaaugccaaaaauaaaggaacuguuuucccaguugaguugauggaaaauaaaucuuauuccuggcgggcauaccuagaaacagaagucaagcugggaugggguggggcaaggccauguuuugggaagaagaaguacuugauuagcagcagcagcaaccuccuccaaauucccauggcccuccauguuuuauauuacuuguuagggaaguuauguauuuccuuugcauuaauuaagguaucagcuuaagugugagugccuaagcaugugaauuuguugugcacucugucucugauguugugaguggugcauuuauggcaaaaggucucuucauugccagcucacagaugguaaugcuagaauuuaguucaaacuugugguaucacuacauacaacuucagugaugauugcacuguauauguuccugccucucuccagaaacaugaaaacacaagaugucgaccaucugaaaugucaugguaguccuuaaauauaguugcuauuuaaagauguauaaauuauaaucaucccaccagauuucaucucuggggcagcaacauauuugaaguuuugauuuaguugaaaggcaugauaauuuaggaguuuaccauuuauauuaacaaacuugaucaaaugcuuaaauguguauaagagacugggaaacaaaauggaauucuguguaauugaaugcaaaugcaaugauuuuaguaugauuaagccuaagaugcuuucaacuggaauuauuugggaauagauagaaagaaaugaauaggagaaaauaauaaaaggcauuugauuuauccacuuaaucaggaguggaucagaaugagaacuuugaaagguuguaggaauugaugauuugaguguaggaaccaagccuuuuccucuucuugcacugagcugguuuuauuccacuacauuuccacaccuugcagaaaggaacuccuuguggacuauaugaggguaggcucuauguucuguaacuaccacuuacucacaccaaccuggaaauuggcugcuucaugcuccaccccccaccacacccccacccacaccccacccacacccaggggcuguguugcucucccccuagccuguuauuuggcaagguuuggcuaaggauucaggaagaagaaccucauuuuccccuacuggaacuuaaacucauuuuacagcucucacauucuuuugcuucuuuuucacuuuaccugcccucaacugauucuccuguguuauccccaagauuaggcagcaaucuagcauuauuuauagcacuggugugguugaaaggcuuuacuaucuauugucuucguagacuuucugucuuccccuguaaagucgggguuggggggaggugagagggggauuuuaccaugugcucucucagguccuuucuaacucacuuaccauuccagucuguaacuuucuucccaacucuuuucuaauucccuuguaagguguugaauauaaugcugagcacuucugggugcucaauacaucuaauaucuccauuucucauacuagaugccauccucugagaggcaagugccccauuucccagccauccccucuccuguugcaucuagcuagggcauucaaguugauuucuucaaagacggaaauuaccauagcuguauccagaagaauuauguugaacgaacaugauauuaagacuguguguauauuaccugguauaucaaaaggggguuaaauguuaugggggaggguaacagcuauuuauuuaacaaaauguuaauugaauaugacuacaaggaaucucagaggaugauggagaagcccacguuagaacuaaucaggacauuguuaccuacugagcucagugaagagaaagguggaacaguaaguguguugacuauagccuguuauaagcuguccuuuucccuucccacacuuaccuucugcuguuccuaccacucuaucaccaccaucaucaccaaacaauuuugugggauagggaaggauuccaaguaagaaacccagccaaacacuucagucccaggagcaagcaaaaugugcacacccuauccaccaaagagggccaacagagaaaauaauucaccagaaucucuaccaaacuauaccuagccaaaauaggaagaguucaagcaccgcccaacacugaguacaaauuagcuggacuugguuacaugaugcucuucccagaccuugugguuaaauucuaauaaccuucuuaggaaaaacaagagggcugucuugggaaugcuugaugagguuuggaauucaagaauaagaggcaaugaugagagacacccagaugagcauggaaaugauuguaucugaacuaaguuccaacuguauacuuauuucagagaagugaaauuaacccaagcuaugcuaccccaaggcaaguauauagauacacuaaaucagcuaguguuuuaggggaugaaaggucgaugugaauguuaguuuaggcaaaugccaaguagcaauuauucugugaagguuaguuuaggccaauauuaaguagaaauuauuuuguaagccuguacagucaacccaacagaaaauuuuacaacuguggaaaaaacauguaaggauauaguagaauuaacuaagcuaaaauugagagaaucuucaccaauaucaauaauauguagauguuaaaugacuaugaauuuuguuaaaagaccgucuaaccuaauaugggaugccaacaagguaguaaauauauucaaauugcgaauggcuaagcuuaaguugaacuacgguguucagugguauccuuucaaccaauguccuaaauaauuaccaaaagcagggcucaaauuccuuuccuauucgaaaauaccagcaguucuguucaauuucacauuccuucaucuacuguuuggccaugccagucaaaccacuugagguacagaaaagagaacuacacuacaacaaggaaguacuuaaucauuugguagcugcagaauauaacuuggcuugccaauggcccgcauaagagucuaguggucuucugugaccaacauguuacaaaagcuauacaugcugaauucagagagacccaaucauuuuagcaucuuuaaugcuguauuugccaaacaaagcacuguuuuaggauaugucccaguuuuuuauauuuaaaagaaugaccugagcauuucuuaaguuaauguuuacuuaaggagugaagcuaaaaauuauacaagggcaccauuccuuugcugcuguugcuucagccuguaaagguguaugauuagauaggaauauugcaaugauuuuauucuuguuuccugagagacagcccauuucccccuuaggauucagugaccuaaaauuugggaagagaaaggcuugaaaaucucugaccuccaaggaaacuagaagcucaaaauagaguuuuucaagucccagucucaauuaucugaaacauauuuaaaaauucauauucuucaaauaguauaccagaacaggaaaacugcucucaccgaaaaccuauuuauaaacccugaucuagaccuagucuuuaaaggaaggaaguuuugucagaaacuagaggcaucucauuaauccucaguggacuagaggccuucuggaagaauagugaaccgaugucccccagucauugagguugacucuucaagcccaaugcuugaugacauggcugcugugguucauacacagauguuauuuuuagaggcaagaauucucauuucccaaaaguauaaccacaagaugucuauuuggaaugaaucacauuuaugcauuuggacaauaguaaauguucagaucaugucugugcaaccucaguucccugaagaaauauguaauauccugguacacucucaccccaggacccuugcccucugucaguggcccucaucuaacugaggugauuucuuuggaaauggagcagggcugugggguuccauagaugucuuugaagcagguuuuucuuccaggaaaaaaaguuauauuuuguccuuguggcuuuccacaaaaacugguuuagggacaaaaaugucaccaaucuuccacaaagcggguagcaaggcucagagaccuucagggagaauuugaacuugguggcccgcaagggugccuugcuguguuugcacuuugcugccacagcuggcaaaucagccugaucuggcuaagcuuuuugggccuaggccaaucucagguccagccuuuauaacugugacuggacuguguggggcuuuuggccccuuaaacugagcuuuacucuaguaaggcuggagacccucaaggagggcauuacagagcccagaauuaacacacacaggcaggcuaaucuagcaaagagaguacuuaucugggaauuggcagaggcucccuggguggguccaguaaccuuguuuagccacuuggugcuuugcuuggccacaucccuuuggguuagcugcuuccuuugcuuaaaaagaucgaaugacugccuuccucuuugacuuugcccuccucccucaugggaagagucucccucaucuguggggaaagaugguaccugucuuucaggguagcccaauaaaguaaaugcugguagucaaucacucaguccgucuguucagcugucuugcuaucuagcuguggaaucagggcucccuggcaggaaucagcuauuaccauaccaggaaaacagcaauggcauaucagacuggucaaagggacagagguuggaaaaaaaucaagucaaugaauagggcuggcacaguggcucaugccuguaauuccagaacuuuguaaggucaaggcaggaggauugcuugagcccaggagucccagaccagccugggcaacauagcgagacccccaucucuauuaaaaagaaagaaagaaaaaaaaaaucagugaauaagcuacuuacuaauuucuuaacccauugguucauucauucuuucaguuaccaaacauguccugagcacccacuaugugucaggcauugugcuagucccagagcuaugcccuuuccagauuaauacuggaguucaaaaccccuccuuccuggccccauuccaaauccuaacaacuuuauacuagcuacccugaggaaaguuuucaggcugaaaauggacauguugccccacaucucucucgacucucauuuccucauuuguaaaaugaggcuaauaauaccugcccugcugccucacaggggucccauauagaucaacuaagagaacagauacagcagcuuuuaauuauaaaaaucauaaaaugcuaauaguugugacucaauaaugaagauuuauugagggcuuaccauguucuccagauuuagccuuacccaggucauaacugaauguuaaccuauaccaaaaauucugaauuuauccuguuuggaaauucagauuuuauaaauauauaguuuuucauguauaauauuaauauuuugugaaugcuguguaccagauacuaagcucagugcuuuacacaaauuaccucauuuaauccccauaauuacacaaugugggagauggauacaaguauuauuauacucauagagaagaaacauggaacucagugagguuaaagaauaacuuguuggcugggcacagugacucacaccuguaauccaagcacuuugugaggccaaggugagaggaucacuugagcccaggaguucaaaaccagccugggcaauauagggagacccugucucuacaaaaaaaaauucaaaaguauucaggcaugguggcaugcaccuguaguccuagcuacucagaaggcugaggcaggaggauugcuuuagcccaagaggucaaggcugcaguaagcugugaucacuccaccacacuccagccugggcaacagagcaagacccuguuucaaaaaaaauaaauaaaauaauagcuuauuuauaguaacaaggcuaguaaaggauagagucaauuugaauccaaguuuucugacuccagaguaugaaccuuuaaccaccaugcuaugccuccucuuggaaaagaaucaaacccuauacacuucuaagcuauugguaauauuauuggaaauuuuccacuuugagguagcggacaguuucuuagaacuacagagaaccauuucuacuacuggggaaggagccccacugaaauggauuuaauuccauccugggucggcuucuucacauccugguguuuugauuguuuguuuguuuccuguccauuuaacagggggacauauuuucauaaguuucacugcugcauucacaaaccauaaaguaagaauugggaaagcuggaagugguagagaaaguguguucuguggaucagaggcagauguggaagcaaggcccaggcaagaacauauguggguguggguagcuuugcugauaccauauggaagcacagccucuagcaggucucucuucuuugucauuaaacaucucuguguguauccuugguacacagacucuuaucuuacugggagcauccagaaggguuuucccagacccacaaaaauuccacccaggcuucuuucuagugcuucaguguguggccauggaguauuacuuuuuuuugccuuaggagguauuuguaacaagcucuuaugucugcugcuauggcugcuacuacuaccccucuuccuccucuuuuccucuucaagaucaucauuguuauucugagcagaagaguuaacauguccaauaacuuauuaccuuuccaggcaaugugcuaagcacuuuacaugcauuauucuauuuauuuguucauucauccauuuaauauuuacuguucauuacuuuguaccaaacacugugcuaggcacugggaaccgaacacacuuuuaucccuucuguuagucuaguggggaugcaacagggaauauagaauuacaaacaguggaaaguucuagaaaagaagaauacauggaacuauaugaaaggugaauggugcuauuuuauuuaauauuucaacagcccugugaagauaauaaauaguauuaucccccauuuuacaggugaggcaagugaaacucagagaguuuaagugacuugcccaaagucacacagcuaguaaguaggcugaguagggauucacauccaugcuggucagauuccaaagcucaugcccuuaacugcuauacuuuauugccccccccccacgugugaagugcauauauagccauuaauucuaggccuauacauuuggguucuggcuuuaucucaaauguguggaguugcaauuguuuccaauuaguuguggcugugguuuggugcauucguucaaagagagugugcacgcaaaacacaggucacgugcuaggccuuguggaugugcacaacguauaaauaauaauggcauuccaaaaaagcugggcuucauuggagucaccacauuuguuuuccauuagcuuaugcuacucaaauacaaacgguaaagcauguguuuacauugcuguggauacggaaagccaggaccccaaagcacauuuugcagguuguauaaagcugagcauccaaauaguucaaaaucaguuuuauaagcccagcuuaauagcuuuaaaauguaaccuggauuccagauauuaaaaaaugccuacagaaaguaugugaguagccaaaagagauaaaaccagcuaaauccuuaaaauauguaccaagucccguauuugcaguaucuauuuuguuacuuaucccuuuauuuuuuuuaaaugcuaaagagcuuaaagucaagcaaacucuuagccauguagcagcaguaauggaauuuuucauucuguacuaaccagcugucugaagcuuuucaaaacaaaccuguucaugaugagauaguuugguuauuuaaaacacaguagaugacaagccuggggaaagcaagcagaaagcauccaauguuguucaaugcccagugcuuaucucccccuucugguccucccacccaauagugaaaagcuuucccaucaaguuauaguuaaugcccagcaucugagaaaauggaauugaaauggaaauuaucugagcuaaaggcaguaaagauggcaaaaauguacaaugaaggccccauucguugaugucuuuaccuaagacacauguuucuuuugaagaguucuggaccuggggggcaaauauguuacuguuaaugagaucucuauuacuuacucaguaacuugguaagguuacugagcuucaaugucuucccuuaacgugagaaauggggauggcagucuucccuguuauacaaacugguggagaguauugaggauuaugugagagaacauauguuaaaccccagcacaguguguggcugauaagcuucauaucuuugcaaucaagacaauuccaagaggcauauuauuuauaccauauagacagaucaagacuugcugcucucacuggucuaauuucaacauauuugaucccucuccgaacaauaaauauguccuuugaucucccauggaccaagcacaaaaagagcuucagccaaaucucauugucccaugcugccauacccuuuuguuauauugguuauggcuuuaaaaauaugaaauugcuguacuucagaaagcccuuuuuucccuuucauuguguuuccaauuuucuuaaguaauuauuccaggcuuuuuguuuccuuuuaucacacaacccugaguaccuguuccaaggcuaacuuuaaauguuucccugucuaaucaaaugaagucaaucaccuuuauacaaggguauuuuccguaacuacaaagacaaaaggucaagauauccauaccuaacugaaaaggaaaucaucauauuauauuuacuuuuaaacacaugguuugaagagcguuuacuaaggauuccaacaugcauggugcucugguggcucuugucaaaagaugguuucagugggauucugggaagcagaguaacauuggagcagccuuucugaaagaguaaggaguggucugcgguucacucacaguaagaugagggggacagaucuaguuaggcgugugucuguaguaccagcuacucaggaagcugaggcaagaggauugcuugagcccaggaguucgagaccagccuaggcaacauagugagaccccggcucaaaaaaaauagaugcagaucugugugccccaucccagauucaccaaaucagaaacucagugagugaauugggccagggagcgugucuuuuuuuuuuuuuuuuaacuuuugccuuuuuauuuuuuucgaaaucacaauuuguauuuauuuugucaaaauugcugaccuggauauaauugggaaaggaaugauugaaugauugccaagagcucaauaucaacacaaaaauguaagccaucaagacuguuuguacacgaaaaaacuuauguuucuguuagguguuugggggaauuauggcuacacauugaauuacuuguuauuuaaauauuacuucuacaacaugcauuaucuuagauauuuuuguuuuuccuauaaaauaccuuucaacuuaaaaaauguuuaauucuuuauuuuuccuuuuauuuuugguugacacauaauuguacauauuuaugggacacagagugauaguucaauacguguauacaauguguagugauuaaaucaggguaauuagcauauccaucaccucaaacauuuauuauuuguguuguggacauucagauccucucuucuagcuuuuagaaaauauacaauaaauuauuauuaaccauauucauccuacaguaguauagaacagugguccccaaccuuuuuggcaccagggaccaguuuuguagaagacaauuuugccacggaccagggaugugaugguuucagaaugaaacuguuccaccucggaucaucaggcauuagauucucauaaggagggccaccuagauccuuugcauguguaguucauaauagggcucccauuccuaugagaaucuaaugcugccacugaucugauagaaggaggaucccaggugcucaccugcuacucaccuccugcaguauggggacccugguauagaacacuagaacuaauuccuccuaucuagcuguaauuuuguaucuauuggcuaauaucucccuauccuccccuucccagacucuaguaaccacuauucucuacuucuaugggcucaacuuuuuuuuagcuccuacauaugagcgagaaugugggguauuuaucuuucuaugccugacuuauuucacuuaacauaauguccuccaggcucauccauauggccucaaauaacaggauuucauuauuuauuguggccaaauauuauuccauuguguauauauaccacauuuucuucauccauucaucuguugauagacauuauagguugauuccaaaucuuggcuauugugaauagugcugcaauaaacaugggggugcugauaucucuucaauauacucauuucuuuuccuuugaauaacuacccaguagugggauuacuggaccauaggguaguucuauuucuaguuuuuugagaaaccuccauauuauuuuccauagugcuugugcuaauuuacauuccuaucaacauguauaagaguuuagcgaggcuaauuuuuuaauaagcauccuggugauuuuuauggaauuuagagaaucacucccacaguguguaaguauguacauacccuuugacccaguaucuuuacuaaggaaauaauccaaaauauggaaagaguuaugugaauguuccugaugauuacauuuuuguuuauaaaagcaaaauaacaggaaacaaugcaaauauucaauauuagaaaaaugguuaaguaaauguugauagaucccuuaauggauagaugcaucaucccauuuaaaguaugacauuuaucauauuuacuuauuacaacaauucugugaggcaggcguuauuucucucauuuuauagaugaggacacugagguuuagggagauuaagcagcuugucugaaaauacaguuuuaauaaguggaaaaaguagcguucgaacucaagucaaucugcuucccaaaugcaaguucaauuuaaaaacaagcauuaaaaagugcugaccuuugaaaacacaaacauuguuuauuaaaguuugggaauuagggguuuucuuccuuguuucuuuuccuuucacguuucuauauuugauacuugcauauuuaaaauauuagauucuaaaagaaaguugauuguaugcuuaggcaacugugauagucucaguggcuaaaacagaguugcacagacaguaguggcuguagaaaaagcuggaaugugaagggccuugugcacuuccacuaagguauccucuguauucaaaguaaugcacagcagaagugucagguuaacagaaugucuauggggauaguggaaugaaauacucagacguagguuuuaauaugaucguuuacauugauaaucauuauugugugccuuggcuuuuaaaaagcuaacaggacaguguccuuugaaaauggcaaacaguuaaucaaaagcauuaggccccuaaaguuaccugcuuuuguguguaagucccucauaauuuucuuuucauaaaguuaguguucagucugaaagacugagagagggaacagaaaggucaauauugugaauuguaauuaagcaauuggauuucugggccaaauuccaggcugccuaaauccacuccuugcuggcaauuccuccucucugacccauuacccuucuuucaacacucuggagcuucagucucuucuuuaagauuuucgcauuaacaauagauuucuagguuuggguuuguuuuguuaaugugugaggguuagguuuaucaguggcugucuguguaaaauggcuuaaaagucuacuauaauccuucuuccaugcugaauuugucaccagaaugggagugauuuaauaccuaaagaaguaacuucacuggcaaaguuuuaaaggguuuuuguuuaauugcacuuuguuuuaaacugagcuacucaagaauaguggggacauugcacacagguuggaaacagucucucaaagauuagcuaugugucuuagccaagguccuccaaaaauguuuagcuacucauucacaaauucuucuucuauaauuaaucugggccuugacuuucuccuuuuucauaagguuguggaaauagcuuuuaaagaauuaaagauaccauaacacuucauuuugcuucaguucaauagcacauauauugagugccuacuaugugcuagacacugccuuaaaugcucugggguucaaagauauauaagauuaaaccccugggcagcucacaggauggugguggagagaagucauauguucaaauaccggauugcauacagaaaguggcauuuaggagguacagauaaagggaacagugguagaagagggagagggagagcuauaaugacugucuaccaggaaagcuuuauuaaugacauggcguuagaacuuggcuugaaaguauggaggacuuugaacagacacaaaugaagaacagcucauaguacauucucaaugaauguguacugaagguguuaaugaaagggacagaugcaaggugugcuugagaaauagcaaguucacuaaucuauaucuaaacauaauucuacuuaugugaaaaauuaucauucagguauuccaugauguacacaaaagaugcauucuugaaaauuaacauaaaaaugcuuauaucgaaagcaaauuucucauaagacauaaugauaaaggagggcauuggggguuuuggugaaacugaagugauguuauaggcuagauuagcaguucucaaagaaugguuuauggauccugggaauccaagaaauccagggauccacaagguuaaaacuacuugcacaacaguacuaagauguuauuugucuuuuccccuguguugauauuugcacaaugguucaaaagcaguggcaaguacaacucuucgaugccacaguaugaaucaagacaccacaggaugaauuaagccaauagcaccaaaauguacuaguagucauuguauucaucacugguguguacuugcagaaaaauaaagggcaguuuuacuuaaggauaucauugcugagucuguaaaaaguuacuaauuuuauuaaaccucaucucuugcacuuuuaaaagauuccguguuauaaaaugggaaguacacugaaaguauuuacacaguaaaccaugucaaugugcaucucaagaaaaagcacuugugagaaauuugagcugugagcuuccuguuucauuuuuacuugagagaaugacugacaaacuauaguuaugcagacuuaaauacuugcuagacauuuucuuggaaaggaacaaagagagccugucaguucagggaaaacaacuggcaguauuuauugccaauaauaaaauucaggcuuucaauagaaaaccaaaaauuguuuuaaacuuuuaucugccacugugagcuugagagcuucccaaaacuuaaagacuuuucagaugagauuggagauaauauuaacaaaugugauuuuuuauaucacauaaugaaagguguugacauugggaagaccugcauugcucagugagccaguauuuuccagaugacccauggaugaugauacaaaaugaguaaaaugcguguucaaaguucaaaacauaccaauggauguaaauguaacaggauaugauauauuuauuuauauaguuucauauuccacacugcaacuaacuacuuguugaguuuuuaauguaguaucaaagaaaaaucuccacaauuaucugaaaagucugcuaaaauacuucucucuuuucccaugacauaucugugggagguuggauuaacugcaaauguuucaaccaaaaccauauaucacagcagauugaguggagaagcagauuugauaauccagcugucuuauauuaagcuggacaucaaagagauuuauaaaacuguuaaauagugccacucuuccuaugaauuaucuuaugucugggaaaauauguuugucauucaaaaauguuuguguuuuagccugggcaacauagugagaccuugccucuacaaaaaguaaaaaaaaaaaaaaaaauuagcuggggauggugucacacaccuguagucccagcuacuuaggaagcugaggugggaggauugcuugagccugcgagguugaggcugcagugagccaugaucaugccacugcacccccaccugggugauggauccagacccugugucaaaaaaaaagaaauguuuaugucacaucauggguucauucuuguuauguuuauagaagcuaucaaauaaauauuuuuaaaauuucucaguuauaauuucuaagauggcaaauguugauagauauaacuuguauaaacaaaaauaacuuauauaaacucuaugguucucagcaaguauaaaggaguccugagaccaagaaguuugagaaccacuaaucuagcucaucuuagccuguauuuauauauaauauaaauguaguuguguaugaugagcagcagcggaaguggcagggugaacguggugcuggagugggagacaguugguagauuggcuucuccaauaccauuagagguuguuggccaggaaaaaaaacaaaaacaaaaacaaaaaucucuuugggacuuuccuuucuuugcuaaaaaauaaaaauaaaaacguaaaaaccaccugcagaaucacauuucucuguaguauguagcucuuuccaaguagaucucaggguggcagcuaaaucacagguggagaacauaaaaguauacuuagccaugacauaaacauagggacgauggaaaccgcagaaaccccagcuuguguuugcagcaauuuuucuuucuggauaccucuuccacaaucacaaagaucucaguuucuguauauccagaaucuuuuguuggcugucuuuuaaaaguagggguuggaucuaagauuuaggaugagaaaugggugauggggaagaagccaggacaaaaacagaauaugagaaugaagccuuggagagagauggcaaggaaaaauaagauggaaucugacaacggcccucagggacccuucgugcggugugcugggucucugggucaguggagaggcuuuugaaaggcgggagucccgugaaauucguaaugcauuggccaugugacugaaaagccagacaccgcagagugaaacaaacaugucucuuagugugcauauuaucuacaauaaagcaaaauaaauuuaaaagcaucuuauuggaauugcgggagaggagaauaaugaacaauuuuucuagugaucaaggcauauauaaugaugauugauuguaaguagucauuguacauguguauaaaauggcacugcuauucuccucauuugguaggaagcauuuugugguuuuaauuuagugacuguaaauuugauuauugggggcuuccauagggaucuuuucuggucuugguguccucuuagcuuugccuuaucaugucuuaaguuccucaucagugaauuguaucauggagacuuucaggagcuuaaauaccaugguaugagaagaucuaaugcaauauacacucuggcuacugcaugauguaaguagagucaaggaguagaccaucacaucaaaugcuauggaaagguucagaagucugaaacucuaaagaguauaagcaguuuacaccuacguaaauuugaaagugauuuuuuacagcuucuguguaauucauugaacauuuuuaaugccuccuguuaauaacacacugugcagacccaccugagaaauaugaagagcugaugcauuccugguuguuuucuuucagcuccugagaaccaugucuaugcccaaagguagaguucuggauaaaaaccuggaugaggaaggguuugaaaguggagacugcggugaugaugaagaugagugcauuggaggcucuggugauggaaugauaaaagugaagaaucagcuccgcuuccuugcagguaacugauuagugcugacccaaauguaaucuaaaaauggugaugcucaggaauuaaaaauaaauugaacccgcugucugcaauucccuuacauucccugcaacacacaaucucaucaacucuucaaggaaagacuauacaagcucuagaaagugaaguucucagguagccuccuucuuuuccucccaccauuuccaaccuuugguagauuaaaaggguaacuuccuguuuuucauuaucuaaaaugaacugaccuaaucaguuggcucuguuucucauuggaguuuuccuugguucuucucauuuauaaaaagaaaugcauaauaagaaaugcaaauuugggaugaaauaaccuguaccauaaacccccaugacacaaguuuaccuauauaacaaaccuagacauguaccccugaacuuaaaacaaaaguuaaaaacaaacaaacaaaaaaaagaaaugcaaccuuggaagucuucugaaaaccacuggugagauaacuuucaaaggaagagccauuagcugaccuucuuuucuuaggacguuaugucuauuuuguuuucucacaagcagucuaacauagauaggcuauggcauaugacugaagaccuacauaaagacaagagugguagggcacgguuguucaugcuuguaaucgcagcaauuuaggaggcugaggugggagaaucaccugagcccaggaguuccagaccagccugggcaacaugaugaaauccugucucuacaaaaauacaaaaauuagcaggguguggugguacgccuauugucccagcuacuugggaggauugcuucaguccaggaggcagugguuguagugagcugagauucugccacugugcuccagccugggagacagagccagagucugucucaguaaaaaaaauaauaauaacuaaacaacaagagcaauagaaaaaaguaauauaguacugcuggggucaaggaggcaaaacaacaacaaaaauuccuuaaauuuguauuccauaucacaguuuagaguacuuucauguggauagguguucuuugauuuuacagguaauuaaaaccagggcucagagaagaaaugagauugcucuauauggaagaacuagaaaucuaccucgggucuugagacuuccacugccauucucuuuccucuguggugcacagccuucuccuuaaaacccuaucacccauggccucugagaugcuaaauguuccuauuucucuggcagccucuuuccuucuuaguucuucuuccuaauccuaccugaaacuggcuauuauccggaugucccuucuuaagccucugucuuuucucucuucuccagaaagaaugcagaucuuaucuacucucccucuuuugacuuuuucuuccuuuuugagauagggucucucucuguccccuaggcuggagugcaauggcgcuuucacaccucacugcagccucaaacucuugggcucaagugauccucucaccucaacuucccaaagugcugggauuauaggugugagccaccauggcuggccucaacuuuuuuuuaugauuuauuuauuuuuuauuaggguaaaaaaaaaaacuaacauggaaucugcccucuuaaacuuuuaaguguacaguacaauacuguuaauuauaugcacauuguugugcaacagaucucuagaacauuuucaucuugugugccuaaaacucuauguccauugaacagcaacuccuuauuuuucccucccccagcccuuagcaaccaccauuuuacuuucugcuucugugacuacuuuagacaccucauauaugauggaaucaugcacuauuuguccuucugugacugguuuauuucacuuagcauaauuuucucaagguucauccauguuguagcaugugacaagauuuccuucuuuuuaagacugaguaauauuccauuguauguauguaccacacuuuuuuauccauucauccaucaguggacauguagauugcuuccaccucuuggcuguuguggauaauccuacaaugaacauucuuuaacuauuauaacacugugggaaauaacuuacauaaagucauuaccacgagucucaacugcucuccuaccaucccacaucuccagcugcuuauuaaucauuucugacuucaccaccaccacccccagcgugaugugucacaagucagauuuaucaacugaccaucauucuccugaucacugaggcuuaaaccuaaagccaucuuugcuucuucucucuugcccuuaaaugcaauuaggcccccaaucccugucgauucuuucuuuguaauuuauucugcuucuguuaauacuuuuuuguuuuuuguuuuuguuuuuuuugagauggaguuuggcucuuguugcccaggcuggagugcaguggcgcagucucagcucacugcaaccuccaccucccagguucaagcaauuuuccugccucaaccucccaaguagcugggacuacaggugugcaccacuaugcccaacuaguuuuuuguauuuuugguagagacgggguuuauccauguuggccaggcuggucucaaaccccugaccucaggugauccacccaccucagccucccacagugcugggauuacaggcgugagucacuacgcccagcccaauccuuccuuucuauuccccccuucacacccuccugcacauacuauugcagacacaucguagguggucuccaggcuucuaggcucaggcaggaguauugagagccuuaggcuaguagauuagaggacaaagaauuugagacccaggcagaagauuccaucaaauucaucuugcauagcuaccugguuaaucuuuugaaggcauuucauacuuucuccgcagcucagcugucuucaugccuugaggauaaagcuaagacuccuuaguagaguucugagggucuucuggucuagccucaacuacccuucuggcuucauuucccaccacuagcccccguaagcacccuccacuuuggugagaacagccauauucaugcuccaugaaccccauaaacauacuguucuuguuucuguuuucccaccacugccuauguuuauuucuuuuuuuuuuuuuuuuuacuuuuuuuuuuuuuuuuuuuuuugagacagucucacuguguugcccaggcuggagugagugcagugacacaaucuuggcucacugaaaccucugucucccggguucaagugauucucccugccucagccuccugaguagcugggauuacaggugcacacaaccacgcccagcuaauuuuuguauuuuuaguagagacaggguuuugccauguuggccaggcuggucucgaacuccugaccucgugugauccccgccugccucggccucccaaagugcugggauuacaggcaugagcccccagugcccggccugcccauuuuauuucuauagagauugaccuuuuuuucuuucaucuuaaauuuuacccauccuucaaggugcaauucaagugugaugcagugaaaagaaaauaggucuugggguaggacaaauguuuauuuaaauucuugcucuacuuaugagcaagcaugaucugggacaaguuucuuagccuccccucuaugucuccauucugucauccauuaaauggggaucauaaccccaacuuuauaggacuauuaaaucgagggggaacauuuauaaaacaucuaggcaaguaucuagcauaugcuagguguuccauaauuguuacuuucucuccaugaaaucuuucauagccaucucaguccauaguuaccucuguccucugaauucauuacuaaaaugaauucugccagugcuuucaugaaacagucuacaauggcucccagguuccauaggacauaaagugaccacucagagccuggcaaccuauuagaagaauguugaauaaacaugaaaaguaaaaauaagagaagcuaauguucauuggacacuuauuaugcucuaaacacugugccagagcuuggcaugcauugucucauaucauuuucacaauaccacuaugagguaggggucauuacuauucucacuuuacagaugagaaaauuuauacuggagguguucucacucauagugggaauugaacaacgagaacacuuggacacagggcggggaauaucacacacaggggccuguccugggguggggggaggggggaggggggagggauagcauuaggagauauaccuaauguaaaugaccaguuaacgggugcagcacaccaacauggcacauguauacauauguaacaaaccugcacguugugcacauguacccuagaacuuaaaguauaauaaaaaagaaaauuaugcaggaggagguggaguggcuugcuuaaagucacauucacaaagggcagagucaggauucagagccaagaagucugguuucagaggccacuccuugaacaagccuacucugacucuuuuuucucugaucaucaacacaacuauaaaaagaucaaagucagcuuugcauuuugcuaccuggaaaaguuguggucaucuaaaguugcccagacaacuuaccaaaauguugccuggucccagcacugaucccugagacauaccgcuguucauacuucuccagaaaagucuaugcuuauuccuacuugugcuuuccugacuauaagccacuuccuuauccauuucaaggcacugcuccacaauuccauggugacuuaacuuguuaaaacaguguuuggcaugggaucuugucaagggccuuuucaaaaucuaaauagauuacauccaugguuucccuuuguccacauacacauuuaucguguaaaagaauucuagucaauuuguuaggcaugauuaacacuaaguucuuuauaaacuguaaaacauuagauaaauggugguuaauuuaauugagaggaaaaaugaugccuagcccccaauacauuacacuugccuaacauauucagugauccuaccagccugaaguuccuugggccccccuuuaaaaaugcuucucauggagaggagacucauugccaaucugccaggcucaugguacaauagcuauuuggcauaauagcuauuuggaaugacaggcuauaugcuuuggucagcuguuauacaauuuuaccuaaaauuuggauagaugccaucugguccugaugauucaucagcauccauuuauuuagucagcuagacuuggaacaccaugcacguucaccaccauuucauuuagcccuccaaauugccuccuccaaaauacaacuugggaauaaagagcauggcucggaauauguuaagacucucuuguaucucccuuuugucccugaacagaccuuuugcgacaugaccagcaaguagcucuaucggcuggcuucccuggcuuacuucuucccuucuuuugaggcacugaaugaagugcaggacacgcagguucuguuccuggcuuugcuucucccguauguccuaaagcgagccccuuccacuuuugaaaagucaguuucuccauuugugaaauagagggaguguacacacaagucuugcagggcauuccagugccagcagucugugauuauguucauuucuuuggcuuugaucccuggcaaggugcuuaucagagucuuuugaggacaucuucuuguaaguuuucaucugaccuugcagguucucuguucucuucucuugagcuauaguucuauauagaaaagaucucauuuuccccauucuaaccccuuugacuuuuccaccaaucuggcaagcugggcuucuuaccaagggcuccccacauguggucuucaacacauuuuugcauuaggaugcuauuaaaaguaauggcaaaaaccacaauuaauuuugcgccaaccuaauaauaagaagguuuuaguaguuuccaggcuuucugggguauauucauuuauaaaauuauucaccucaaaguucccuaaguauucucuuuuuccuuauuucuuauuuauaaauuuuacauagaauccuuagagucuucuucuuucugauuguugaauuuaauuguuggugggaugaccauuacaugaugucuuacccaugguuacaucuucgccuguuccucgcacuucucagaaccaaggguaauguauuucccuuuuggugcguguccuaguccauuugcacugcuauaacaaaauaccuuagacugaacaauuuauacauucuaguaaguuauacuuacaguucugguggcugggaaguccgagaugaaggugccagcauuuggugucuggugaaugccuucuuccugcauccucauguugcagacggaacaaaugcuguguccucaccugggggaaggcaaaagggcaaaaaagggacagaugcuguguccucacauggcagaagagauggaaaggcagaaaggagccuaucuaguucucuccagcccuuuuauaagggacuaauucccuccaugagggcagagcucucauggccuaaucaccuccuaaaagccccaccucuucauacuguugcauugccgggggcauuaaguuucaacaugaauuuuggauggggcacaaacauucaucaaaccauagcagugggauacuucaucucucucagccugcuucuguuucuaaaaaguggagauacagcaaacuagcacaggagcagaaaacaucuugggcuuagggcuuaaaccgauuguauuagucuguucucgugcugcugauaaagacauaugagagaugggguaauuuauaaaggaaacagguuuaauggacucacgguuccacauggcuggggaggacucacaaccauggcagaagaugaagggagagcaaaggcacaccagcacuuugggaagccaaggugggcagauaaccugaagucgggaguucaagaccagccugaccaacauggagaaaccccgccucuacuaaaaauacaaaauuagccaggugugguggugcaugccuguaaucccagcuccucgggaggcugagggaggagaauggcuugaaccugggaggcggagguugcagugagccgagauugcaccauugcacuccagccuggacaacaagagugagacuccaucucaaaaaaauaaaauaaguaaauacauaaauaaaaccaucagaucucaugagacuuauucacuaccacaagaacgguaugggggaaacugccaccaugauucaauuaccucccgcagggucccucucacaacacguggcaguuaugggagcuacaauucuagaugagauuuggguggggauacagccaaacaauaucaucaauacuaaaagcaaauggcuguuuauugcccuugguacacagauauuucucauagaaaugcuugccuucaggaaacuuucagucucucagaugucaguguggggacugcaaagagaaaaccugccacuuguugcuugacauggggugacuggucccuuuugccauucuucuguugucaucuccaagugcuaugggggaaagcaguggucugccccuggcuagucacuucgucccagcaguacuguggaggaagccuuuaagauuucacagcugugagccccauuuaggguaauauuauuaguauuauuuaguaucauuggauuauaacuuauuauuuuagcugucuguagcauauauucccuuuuuauaguuacuuuauaaucugaacacaaaauaacgacgaucucaaguaaaacagcaauuaggaaauauuuucauaagccaaugaucuuuauuuuuauuuauuuauuuauuuauuuuuacuggaucaaguguaaucuuacacuucuacuccuaauaagccugcacacauaggaaaggugaaggacaccucaauggcuuaaguguucuucuaaagugucaagucaaaccuucauaaacguaggcugguagucauuuugcauuaauaaauucauuaauagaguggucuggugaaaagggucauuggaaauuuaugauaggccuuuuaucaugagugacaacugcaaaauauuaaugauuuagaacaaaucauguugccugcugaaaagugaguagaaagcuuguagggaaaugaaauguccuggguuuuuuuguuuguuuguuuguuuuuuguuuuuuuaaaugggaaaguuguuagguccuaugcagaacucggaauacauuagauacaguaauauaucuauuuauacuacccuguugguaacaaguccaggaauaaauuauggcaguuuuaccaaaauguauuuuauagugugaguaucccaauuccccuuccuuugugcucuuuggaaaugcaccauucagaucuuugucacguaaguuguagauugcuuccugcuaaguaagccaccccuggaacucucaggcaagaucuuguagugacugccuccaaacucauuucuugggauaucagccccuccaacaugugaccucagugcaagcgaccccacgucauccacugggagggagaucccaucuguugggcaaaugagacaccuucuuacccuuagacuguugaaguuugagaucuaaagggaagggcgucacuucuacagagucaaacaaacugggucccaguucugugucugccacuucccaauguugugaccuuggacaaagucagucaguuccucugagccacaguuuccucacuugcaaaaauggugauaaaauauuuccugaccuacccaccucauaaguugcugaaugaaacacaugagauaauggauguaacauacuuuauaaacuuuaaagcaucauauccauuuaggauaauauuauuaauauuguuuaguguuauaacuuaaauuauaauuuuagcuaaaggcuuuuggugaauaaaacuaaacuaaguuccaaauguccaagccaauaauuuucaaauguccaagccaauaauuuucauuauaaaugugcuacucuuauacacuguugguggcaauauacacuaguacagcuacuauaaagaacaguguggagauuccucaaaaaacuacaaauagaacuaccauaugauccagcaaucucacuacugggcauuuacucaaaggaaaggaaaccaauauauugaagagacaucugcacccccauguuuagugcaacacuauucacaauggccaaaauauggacucaaccuugguuuccaacaacagaugaaugcauaaagaaaauaugguguauauguacgccguggaguaaaaaaaaaggaaauccugucauuccaguuuaacuguugccaauccugucauuccagguaacgugaauggaacuggaggacauuguguuaauugaaauaagcugguaacaaaaaguuaaacaccacauguucucauucguauaugaaaacuaaaaaaaguugaucucauagaaguaaaaaguagaacagaggugggguagggagagacaugucaaaggauacaaaauugcagcuagauaagaggaauaaguucugguguucuagaaccacuguaggaugacuauaguuaacaauaauauauaguuucaaauagccagaaggaggauauugaauguucccagcacaaagaaaugauaaguguuugagaugauggaugugcuaaugacccugaucugaucaguauauauuauaugaaucaaaacaucacuauguaccccguaaauauauacaauuauuacaugucaguuaaaaauaaaaaaagaaggaaucucugaaaaaaaagauguucuccaucauccccauucccaaagguggcauuuuuaauuacucauuaacuuguuuuuagcccagggugguuugaagugagaagguauuugaacaaugacaaauaugucggcugaguuguacaaauaaccacauagucacaacaauaguagucacuuacaucuugaaagaaucacagcuaguuauguuuuguuuucuuuggugcuaguggggcgguaagggcauggguggacaacgaguugggaagggucaagaaagggccccugauuuuuuccauucuaucucgcucugagcuacaagcaaucugcuuucauguuuuggucuuuucuuuuagagaucaaaugucauaggaaagcugaaggaagcaaagcucaccauaauaacacuuuucacacagauauagaccaggugguucucgcuaaucaauugacaagacagccaaucccagcucacccuagagcuuugcgaagcucccagggcucacaaaggggacuuagaugugagcuuuagcagugguauuaccugccaauugaguagguauaccaagaaagaggccuuccccaugcuuuaauguuggcuagggaauuacuauagguaaucuggugauagaugagaaugagcaaagguuaaaacuucccguaaaguuaucauaacucaggauaccuuagggaguuuguuucuuauuauuuggaaggagauauucugagauuugcuuuucuaggugugcugcgcugugauacuuucccaucugagccauuaggcuauaaggcuuuuaucaggaguaaugcuguaaaaguuguacuugcugguaggccuuacacauaacucuaagaauugaguaaguauuagggauauugugagcaauuuagugccauuguauuauauuuucuaaucaaucuucaaauuaagaggaaacuguugaacagaugaauuugacuaaguggugcaauugauuuucucuggacagaagccauguuggccaguuuuaugacagccucaacuaaaaugugguaauuuagccaaguauugguagaaaggaaagggauggagagguucagcauucagcuggugggaaaguagagaaggaucuagcaggaaaguggcaagccugaagccucucgcuggguugccaaacagaagugaagcagucccuguaggauaacauccccgagggaucugggagugcagacuuacaugccagcaaaaggaaagugcuccccugcaagaagaaauagcauagcagaaagagagaaauguggagaugucugauuaaaccugugcuguuguccaaaguuuccaugauaaacaaugaucuccuaggggguucaaaucagaaacaaggaaucgugagcgugcagagugagacagaagcugaaaagaucuaguguggauaguccuaguggcugcagguagagaucgggaauaaagugagggcugagguccugcucggagaaggggagggauguggagccauccaaugcccuccaauuguugacuuuccauaaggccccuuaaacugugcacaugugcacgcaugugcugucaaaucucuccaauucagacagugcaguccuuuagguuuuucuagcacggcaaaaagaacaaagaugcagccaucaccuccccucuuuauuugucugucggguacaaggacauuucccauucgcacugguaggaacgaaguuacuggcaaguuuuugugugguuaauuuuucugaagggaaaccuuguuauagaucuugccuguguacacaccugccuaaaagauguuuaaugauucuuaucauuuccaaauauacuugcugaguuuuuuaaaaagugccuuuuagucuguuuuuuguuuuuuuguuuuuuuuuuuuuuuuggcuuuuuauaauccuaaugugaaugucugaugguaaauaagcuuuuaaggugagaacacgagcaccagcacagacagaaucuuuuaauuuguagcucauugguggacugaagcaguaauauaauuaccaaguaaauaaaaauggaguagaaggccaggcacaguggcucacaccuauaaucccagcagcuugggaggccaagguggauggauuacuugagcauaggaguucaagacuagccugagcaacauggugaaaccccgucucugccaaaaauccaaaaauuauacgggcaugguggugcgcaccugucaucccagcuacucgggagggugaggcaugagaaucgcuugaaccuggaagguggagguugcagugagcugagaucgugccacugcacuucggccugggugacagagugagaaucuguuuuaaaaagaaaaaacaaaaauggaguagaggcuauucuacaaauucagguuuccgaggacagucuagguuagagcaggaggaaaucucaugagcacauucaggaugagcuucagagaagagucguucuccaaauaacagugaacuccuuggagggucgaaagcaaguauuuuucauccuguguauacacuucacaguucucaaucaccuauucuccuucccuccaugcugcucagugacucucaguacguauuuaguaaauauucaguuauggauuuguaauauuuacuuuucacauuugcuuccuuuggucccauauucaauagggcaacagugugcuucaccuucauugcaucuuaaacuagcuuccucaaaguauccucaacuuuuagcagccguauuugugagcaaagagaucugagauuccuguuccagucaacacaggaguaaggacucagcugagugggggaaggcacggcaugugaaacauaggguguuuguagccuccugugcaucuugagaagagacagacagauggggaagauucugcacacagggacagugggaggauggugaaaagaaguaacaguguucagucuacaugagagaaggauuaggaagauaugaauguugucuucuaauaguaagaagucuugcauauggaagaggagaguagaucuggagccaaugcaugacauuuacaaggagacauauuuuggcuaacagaaagaugaacuaucucuuugagcuauuccucaauugaauggauugcccugagaaacaaucagcuuccugacuuugaagguauuugacuagagaauaaauaagcauaucaggccaagugcaguggcucacauguguagucccaccacuuugggaggccgaggcaggcagaucacuugaggccaggaguuugagaccagccuggcuaacauggcaacaucccgucucuacuaaaaauacaaaaauuagccaggcaugguggcacacaccuguaaacccagcuacucaggaggcugaggugggagaauugcuugaacccaggagguggagguuguagugagcugagaucgcaccacuucauuccagccugggcaaccaagugagacugcaucucaaaaaaauaaaaauaauaaaaaaagagaguaagaaauauuggcuggauggggcuuaggugucagagaguggauagauaccuacaucaugauggacuuuugacuuccaggguccugaauagcucugaggggcuaaauuuuuaugauguaaacauguaaauagaacaaaagagaaucaauaugguggagcaaaccaaugaggccauuuuucaggcugggggaaagaaagaggaguggagaagagaaucucugugguuguuugucuaugagcacaugucaccaauuaugauuuucugcaacuauuuuccuaagaaaacggauccuuacgaauggcagagacuuuuccagggagcaauucuuuucaacaucuucugucauucacagccuccagauuuguuuugccacuacaagaauccaguucucauuucuccccaauuaucuccaggcuuguggccguccugccccauguuagaaaagcaaacccaggacagagcccuccccccggcuacaagcaguuagugcugauugcuguauugucaauauuaagguuguccaguucacacucauccccugcaccacucucucccuucugauucugcccacacagaauagaccagugcaucucaaguuaucuaugaugaaggacccagaguuuguuuguuuguuuguuucauuccucccaaaucugucauggaccaauaucuuuguagacaauaaaacuaaauuaccagaaaaagaaaaugaccaaaaaaaacccuauaaaauacaagccacacguuuuaauuaugagauucaacagaccuaaaaaucucugucagauugcuauaaaaguuucaaagugcuuauuuucaaugucuguacuuaucuucuugcagauuagcaauaaauagcagagcaguagcccacacauugaguagggagguguagccugcucugugugucucugccuuguauuccuccucaccuuggaucucauggugggaaacacucaaaagcagucuaaauagagugagggcagugguguacuagagcuggcuugcacuggcucacgagagccaauuguuaaauuuucagaauuccugugagucaguuguuaaacauggccauuacaaaaaauuaaauuauauaaauuuacaaugaaauaaauucuaccaaacaaaaauaacacugaagacucaucacauccuaauuauuuuauugcauuuuauaauuaucucuacucuuagggucauaugucuauuguguguguaugugugguggaaauaauauauacucuugcaauucuguguucaguguggucacauugguagcuuaaagcuggccaggauagaaauacuuacaccacagaaaucaggaagaaacuacaaaucagggcuugauuuauuguuuuguugauugucuagacucuagacuuaagaaagugauaggagaaaauguuaauagcacagaauaaacuuaaaaucauguugucucuguagccauuacauugugaauagcacaaaaaaauugaagaaauauucuuccaguauuugaaaacuauuauccaauucaguaaagaaguugcuccuaucacugauggagugaaguucugacuccauuggaguggaacacuaauaauaauaguguuauuucacuuuugugucaccucuuaguguauuccaauauaucaaccaguauucauguaggaacuacacuugcucaucgaucauaacucuaguuuggcuccaguugcaagagcuugaacaaaagucaaugaaagcauucugugagaacuaauuggcuaaauaaaauuuauaaugaagaguauuuuauauuuuuaucuguaaauuguaaggugcugcacauccuuuauuccaauaaaauuaaaaauaagcugacaugcauacuuccuuuuuuugagagccaguuguuaaauauuuaccagcucaccacuggguaagacaauauauuuagaggauuuauuuuccuuuguuuauccuuaaaguuucuaaguuuaaaucaauagcucuugcuaccaugagugagagaaaauuucugucuuccaaaguuaugcuggcaaauuaaagagccccucauuuucagugauacugacuucuaggaaucccaaacuuggaaacuuucuuaacuuggaucuguaagauccauaaacuuuuuuccucaaaacuucuuauucccuguugagguucgggggcucccucugaaaucccucugcuaaccgauggaaaucucaucagucccaucccaaaccucaaugguauuccugcaggucaauucacuggagcacccaggugaggaccacuuuuagaguucagccucgcuguagaagauggcauuaagacaaauguauaccgugugccgguauuagccuuggcuucauagaguucgaguggaacuccuaauaucagguuacauuuuguuggcucaguaaucauuuuuugaaccaccgaccauaugggcagagguugggaggaaagcuaaauuuggaacacacucccacucuccuguucaacauuucuuucuuguuugugcagggaggcaacauuauuacucauacucacauacaguaccaacugcuagaggacuaagaagugagauucucccaaaauguggucggaucacuggagauuuucuauacaaauaugcagcaguucaguaagaacaucugugcucugcuucugcagaugucagaaccugucugugacacauagcacuagaagacuaaauugauaaugaaaaggaacccagggauuucaugccuguggguucauaaauucuuuaucauuuuuaguccacaugcagagauagcaccuuucugaacugauaucuuuuugauucaggcauuuuuagagcauggagccaugaaugucucuccauuuaguuuuucuuguucuagcuuuccuucuccccacacaccacuucauauggaaugauaguuggaacaaagaagauggauauuuugggagaacaacaauaaugauuugggcaguaucugaggaaaucaugcacauuucuuucagcucuggggcuuucuaaaccuaaauacacaaguuguauuuagccuaaagcagcuaaaggucagugccuccaagggguuuagaaacauguucaacuuaaggaaugaaaguuagucugccuuccuucgaggagagguuguagucuucucaccaauagccagcuuggagucauaagggcauucuccuugcugucccuaaauucuaggcauaaaugaggaguagugaaaccaaaucccuuagcucagccuuuccuaaucuggccccaaccuacaucuccaaucuuuucucucacuaaccccuacuccauccuaugcuccaacuaccuuaaaguuuucacuguugccaaacuugcuauucuguuccuucaggcgugccugggccuuuguaaagucuuguaucuguaauauacauaaagcacuuagcccagugcccaugccuugguagguucccauaaauaguggcuguuaauauucugcacaugcugaccuguuaacccguacuuguuuccccuuuuguaccuuuaaaacucaguucaggcugggcgucguggcuugcuucuguaauccuggcacugugggagggcgaggugggaggaucacuugagcccaggaguuugagaccagccugggcaacauggugaaacccugucucuacaaaaaauuagcugggugugguagugugagccuguagucccagcuacuccagaggucaaggugagaggaucgcuugagcccaggagguuaagggugcagugagcuaugauugugccacugcacuccagccagccuggacaacagggugagaaugucucaaaaaaauaaaaauaaaaaugaaaaauucaguucagaugcaucuccuuccucagugacaccuagcccuaggcagagugcuccgucaauaugcuucaagcauuuaccaacaugauggucagguaauucccagugccugggaccuaauuggugcucaguaaguguuuguugcauggcccuggccauacaaaaaugaauaagcaaaguaccugcccauagaaguuccuaguguaguugggggucuugggggguggugggcaaugggaagggcacagacaccuaacuggaucauuguaauguaaagcgguuaaagcacugauugcaguauguacagggaguuguggaaacacaaagguaaagcuucacacccagccuugggucgucagaaacugagcugagucugaaacaauguguaggggucagguggaaagggaagaaaauuguaggcuggcaggauaguaugagcaaugacuuggagaugagaaagagcacggugguucugaaaaugacaugcacuuuggugugacuagaguacagagaagcaagaggugaggcuggaagauuuguuaggggucacaucaugagggccuucucugccuuguuaaggagcuuggucuugauccuguagcagggucuauaaauucacaacauaugggccauuagccuccccaacccccaucccucuccauagcagacauucauaaucacagcaccccacuccacugagcccagaugugacauccuaauccuucugaacauagcacuacagggaaacaccaccaaaagauugaaggcuugaaggcagcauucugguuugcugccuucaaaccuuugguuugguuugguguuuuguucuguuuuguuuuguuuuguuuuuuguuuugagacagggucucccucugucaccuaggcuggagugcaguggcacaaucacggcucacuucagccucaaacucuggugcucaagcaauucucucaccucagccuccugaguagcugggacuacaggcaugugccugguuaauuuuuuuuauuuguagagaugagauuuugccauguugcccaggcuggucuuaaacuccugggcucaaacgauccacccaccucagucucccaaagugcugggauuacaggcaugagccaccaugcccagccagagaaagguuguaagcauguugggaguuugagggcggcaagugagugcaagugaagggagaaggcugacauggucagaauugcauuuuggaaaacucucugggggaguggaugaagaugcagauuuaagaagaagaaucagcaagaccugucuauuuagauguggcagagugagggagaaagaguuguugaggaugaggucacuguuuccaccuugggcaaaugggcagaugccagugccauucagagagaaagcauggaggagguaaugauaggguuggcacaauaauaauagcucauauuuuuugagugcuuacuaugugcccggcacaguuuuaagcauuuuguguggauaaacucauuauauccucccagcaacgcugugguguggguaccauuauuauuuguuuuguagaagaagaagaagauacacagagggguauagaauacugaagagcuaacacaaucaagggcacuaagggagaguguuagaaugauaaaagcugaaaacccacaccugagucauuuggaggacuauggauagagccagccaggucacuaggcacccaugcuaggguuuaucaguucaucuuuaauguuuuggaaaccaaaggauuuaucguucuuggaagaagcccgauguguauaaauccuuccugcccuuaccacaucuguucuacucacaggggcaaacaucaguaggaauaggaauuaaaacaagccuguccaaaugaugaccuaaaugauuuccaaaugcaucuucaaauauaaaauacauccagcauucuuaaaauuaaaagggagauaguuugagggguggcuaguuucccagacucccccagagcaccucauuugaugaaugcuguaauaaaaacacuuccacccacuccacccugaauauuaaaagggcaagguuaggaaggguauugaauuuuaagagaauacaucacauuagauugugcuguuuuuucuaacgauuaacccuuucuuguuuuaauaauuagacuauauacaucuauggguauguauguguauguaaauguauauauuuaugcaauuuguuuaauaacuucaugcuuugcaaagcgcuuucucaugccguguuuauuugaguauuauaggagcuuaauuacuuuaaggaacaggcuauuucaaugacuaauagacguguugccauuuucaucuuagcuucaugucugacucucuugcuaucugggcugugucaguauugcagugugagcacuaccaagagucagguacuuuagccaggaggggaugaauguccaugccccauggccugaacauguagcucaacguuagagucaaggugagcugaggacugaacagcugagguuuucagaccuguccgccauauuugcuguuaacccugaacucagaucaugagaccauggauuugcuaauuaucccauaguguccucuggaacagcuauaaauaaacuacaaaugugcaauuuuugccugaacaugccauucccauaaacaugucuuuaccccaacucaggccauuacaucugcuugugaugucuucaauucuucuguccugaagccugccaauacuucaagacccuccuccuccacaaaacauauucuugauggcuucagcuauccaugacaucucguucucuucugaagcccuuaucuccaccauucuauacauaacaauaacaauaaccaacuagcagauuguuauuuacuaauaacuuugaaauucaucaucugauuaaaucuucauuacaacccuguaagguagacuuuaauauuagcucuuagagaggagaaaacugaguuucagagaguuaaauuaaauaacuugcccaaagucaauugauauuaagagcuaggauugggcugggcacagcagcucaugccuguaauuucagaacuuugggaggcugaggcggguggaucacuugaggucaggagcucgagaccagccuggccaacauggugaaaccccgucucugcuaaaaauacaaaaauuaaguguggugacacacgccuguaaucccagcuacucaggaggaugaggcacgagaaucacuugaacccaggaggaggagguugcagugagccaauaucgcagcacugcacuccagccuaggugacacagugagacuccaucucaggaaaaaacaaacaaacaaacaaacaaaaaaacagagcuaggauuggagcccagaucuuucugaugucaaauucauuucccucuccaccaugcuguaugacccagcacacauagcugaaaaguauuuguugaugaugaugacaacaauccucuuguguuaguaaauagccucugacuuuuuccauggaguugaugcucagaaucagaauagccugagcaagaagaguucugcgccucuguagccuuuuaggguuaagugcuauagagaggagcugaaaguacauugcuccacucaguugggugggacuagucuggauucccagaagauuuuucucccucucuuuauauacauuuccccauaucucucccaugaaucauaguucuucugggugccugagccuggacccgaaaaggagggauugaagagcaugugguauucaaguaagucacuauaugugcuuaggagaucuaggucuacuccucugugcuguacuugagagcuauaauuauugauccacaguacauucuugugccccaugaccauccggccucaguauauccuagacuaucauuugcuggggcagcaguugguuuggacagcuuauucugaagguagcuuuggaaacuugcauaaucuugguacugagagacugagcaagcagccaggcuagaggccccaugugcuguucuucgguccagugccccagcuaaaauaacacauuuagaauuauucaguaucccuuccgcucaucccuaaauuugaaaaugcauacucaugaggaagccuggcuuuuaguaggucuuugguauguuagagaauugcauguuaugggaagucaaaaugaauguuggagugaaucucauucuggcuguaauaauaaucuucacauaguagcaguauuguagccaaugagguuuauccacacaugauuauugcugauuaaaauaaugauaauaauaauagucagaaacauaauagcacuuacugcuaauuguuuucucuaugcugacguuggucuaagugaguguuaccacaguuaaucucuacaaggcccuauggaacauugguaauauaacucccauuuuauagauaagggauauaaagcucagagagauuaaguaaaaagauuaaguaaaugguuuaaggucacacaacuaauaaaugguccagccaaaauucaaacccaugccuuuuuggcuccaaaggccaugaaauauuaauaguagccucugcucuaccacuucccuuucugcugcuucuugguacuccugucuaugccuuguaagccuucagucagcacccagcugagacccacaggaagugcuucagccaauguugaggucagcuaaagaguagugaccagcaugcagcagaaagggacccaaacuguucauucuaaccaugccauugugcuccgcuggccaacccuuaagccucauuacauuucauucucccagcaaagacaguaaagauaagaaugcagauggagugugugggaugcgauaugacuaaauucauuuggucuucuggaacuuuuguaaaaauauaaacagaucugaucuaguuaaauacuccucuucuccuuaggcccagacauaaucacauaauucacagucagcuuugcuggcaagacaaagauuggagauguuccauaaagaagauaucaguuugaaaaaccuacaaccuuagcugaaaaauauaauuuuguucauaaagaugucuaguaggaaauaaccagaaagacugaaauaacuuugaaccagucguuaucuuuggucaauaucauguggccaaugagaauuuauaaucuccccuuuauauagaauguugcuuauauuaauauggcuuucuauaaaauaucauuuuaaauguggguuggugaacuggucucucucucucucucuuuuuuucucaauagcuucauugggauauaauucacauaaccauacaauucaaccauuuuuaaauguagaauucagugguuuuuaguacauucacagaauugugcagugauuaccacaaucaauuuuagaacauguucaccacccccagaaaaaccuuuuaccccucagccaccacucuccaacccuccuaacccccucaacucuagauaagcacuaaucuacuuucugucucuuuggguuugccuauucuugaaauuucauauaaauggaaucauacuauauguaguccuuugugacuucuuucacuuagcauaacauuuucaagauggacccauguugaaauauguaucaguaguucauugugggguuuugcuuaauaacauuccauuguauggcuguauuauuuuacuuaacuauucaucaguugauggaaauguguuuucuucccacuuuuuggcuauuauagauaaggcuacuuguuuauagccaaaaagugggaacaaagaguaggaacaaaacaagcagccuuauuuaucauagcuaaaaggugggaacaaaacacauuuccauccacauuuauuuaauucuuguuuaauuuccuuuaacaauguuuuguauuauucagaguauagguuuucuacuuuuuuguuaaacuuauuccuauguauuuuauucuuuuugauacuguuguaaguggaaucacuuuucuaauuuaauuuucagaguuuauugcaagucuauauauauuugauuuuuguauacaauugauuuuuguauacugaucuucuauccuacuaccucaauggauucauuuauuaguucuaauagacuuugugauuucuuuagguuuuucuacaugcaggaucauguugucuucaaauaaagacaguucuacuucuuccuuuccaaucuggaugccuuugauuuguuuugcuggccugcuuacacuggcuagaaccuucaguaccauguugaacagaauaggcaagaacugauaucuuugucuugcucaugaucuuaaagggaaugcuuucauucacucacucuuaaguaaauuauuaauagcucugagguuuuuauagaugcccuguauugggcugagggaguuuccuucuauuucuaguuuaaguguuuucaucaugaaaggaugcugaauuuugucaaaugcuuuuucuauuucuaucaagauaaucauguaggauuuuuuuuucuuuauucuauuaauaugguauauacauuguucacauuuuguauguuaaaccaaccuugcauuccugggauaaaucccgcuuggucaugauacauaaccuuuucaaccuguugcuggauuugcuuuguucauauuuuguugagaacguuuguguuuauauuuauaauauauauuggucuguaguuuucuuuucuugugauaucucugccuagcuuugguaucacaguaaugcuggccccaucaaguaaguaaaaaguauuucuuccucuucuauuucaggaagaguugugaaugauuguuguugauucuucuuucagcauuugauggacugaagccaucugggccugggcuuuguauauucagauuuccuauuucuucuuaagucaguuuugguaguucauguaauucuaggaaauuugucuauuucauccagguuaucuaauuuuugguuuacaguuauuuauaauauucccuuauaauccuucuuuauuucuuuacaguuaguuguaaugucccuuuuuuaucucuguuuuuaguaauuuaggucuucuuguaauuucauuuuuuucuuaugcagucuugcuauagguuggucaauuuuguagaucuuuucaaauaacaaacuuuuaguuuuguugauuuucccugcuguuuuucuguucucuauuuuauuaucuuuaccucuaauccuuauuauuuucuuccuucugguuguuuuggguuuaguuugcuugaguuauugauuugaaaucuuccuucuuguuuaauguaggugaucauagccauaaauuuuccucugaggacuacuucccugcauuccaaaagccuugguauguuguauguucauuuucacuuauaucaaaguauuuucuaauuuuccuugugauuucuucuuugacugauauuuauguaggauuguauucuguaauuuccacauauuagugaacuucucaaauaguuuucuuuauugaugucuaauuucccuccauugugacugaagaauagacucgacaugauuuccaucauuuuuaauuuauugaggcuuguuuuauggcuuaguuuaaggucuauauuggggaauguuccaugugcacuugagaagaauguguauucugcuauaaaccgguuaauuuuaucuacaggauuaauaugaagcuauaauaaaguacuuuuucagcuuauauuucauauuuuaaaacaagauucagucaauaaucccuucccccauguccuucagaaaagaacaugugauucauaaucaccauucagaucucaggauuaagaacagaacuacagaaaguccuccucuugacauuccaauuccacuguccuuuagaaccauagaggcagcacuuaauuauccacaaggagauuuuuuauuuuguggcuuaucugaagugaccuauaguuuucaaucuuucugccaccccucccaagcucaggccacugauguaagccagcacggaugaggggcauuuaaauaucagaacagggugguuuguuagacugucacugaagccauagggaccggauauguuaaauacaaaaagcccaucugacuaguguucuaagccucuuugguaaccuaaucagauuagcuauuagaaaauggcuaucaggcugggcgugguggugggugccuguagucccagcuacucaggaggcugaggcaggagaauggcgugaaccccagaggcggagcuugcagugagccgagaucgcgccacugcacuccagccugggcgacagagcgagaauccaucucaaaaaaaaaagaaaauggcuaucaggacaccccaaaaaaaguagccaaccuaaaugcgcagagcacaauggcugagugugagugguuggcugaaguaaaugugaugcuuaacuguauguugguaucauuuaugccauuuuugaaagcuggccaugccucaaaaaauacauucuggaacuaauuuccuauuuuaaaugguguucaauauugccuuuugucagagaaaccguucucacuuguagauuuauaagguaauacaaauaaacaucaaagaaauaaaaauauuaugaucaaccaagaugugaguuuaaagacaaaaagaaaaauuuugaucucuuuuuaugcuucuaaauucucaugauacuuaugccauacacauauguauaaguuuauaaagcugugcgauaauaaaaucacagacuuucacaguagguagguuuaagauugaaacacaggagaaccauuucuccugugagauuuuuuuuugagugcuuauaugagcacucuuaaaauccaaccacagaauauccugucucugaguaauaaaauuggguacacuggcuauaacaauauaaagauggccaagaaccaacauggaauggugaaucacuuuaagcauuuggucauggggccaaagaccaggcucuuggaccuagacuguguaucuaauucuacuucaguaaaucaagcuagugaaggcagugggucucaugcugagaaaagaaggaagcccagacucaaaggggucuaauucugcugggagguuaaagaauggaugccuuucauggaauuauuuuguucaacuuagaaugagucguccacagaugugcccauuucaucucauauuuguuuauaccucugcuuuaaaacauucuuuuucugcugggcacaguggcucaugccuguaaucccagcacuuugggaggccgaggcaggcggaucaccugaggucgggaguuugagaccagccugaccaacauggagaaaccccgucucugcuaaaaauacaaaauuaggcgggcaugguggcacaugccuguaaucucagcuacucgggaggccaaggcaggagacucgcuugaaccuaagaggcggagguugcggugacccgagaucacgccauugcacuccagccugggcaacaagaaugaaacucuguuucaaaacacaaaaacaaaagcaaacaaacaggccgggcgcgguggcucaagccuguaaucccagcacuuugggaggccaaggcggauggaucacgaggucaggagaucgagaccauccugacuaacacggugaaaccccgucucuacuaaaaauauuuaaaauuagccaggcaugguggucggugccuguagucccagcuacucgggaggcugagucaggagaauggcaugaacccaggagguggagguugcagugagccaagaucacgccacugcacuccagccugggugacagagcaagacuccaucucaaaaaaaaaaaaacccauucuuuuucuauauagauguauuaaggcugauguuucuagcauaaccaaaauuuguauaaucuagaaauaacuuccauuugcuaauacucauuaugcaagauggaaauugcucuuaagagcuuacgguuuguauuuauagggacacuacauggauagaugccuguggccacaugugucucacauuuaacuguaaaauagauaccaacguccauccagcauagagugauuugaaauauaacauuuaauuuccaaauguuaguuuugcucagaaaaauauaaagccugucugguuagagaagaauuuauggaaugaugcuucagggcuguuuuaauugaaguugugucuuuacuucaguuaaagcucucagggacaguaaugauaaacaggguucauagcaguggacuuccucuaaggaaaagcagcucuuguccccagcuuccaggaacugggaccaugguuuccaaaucagucacacacagacccacccccugcccucagugucccauaguuggucuugaaaucuuccuggcauuuggcuggagacaaaaagagggcagggacauagcagcuucuaaaggauuauggcuccaaaguggaaagcucaucugcagugugcaacugcuucaggcuuguucauucauuuuuucauuuuugauucacauauucauggcccucugcaaguucaucuucgucugccuuuucaguuuaaucuuuuuauuuugugagacaaggucucacuuugucccccaggcuggcgugcaguggcgugaucaugguucgcugcagccucaaccuccuggguucaagugauccucuugcuccagccccaccaaguagcugggacuacaggcaucgccaccacgcccaugcuaagguuuuuauuuuuuguagauacaggguuucgccauguugcccaggcuggucucgaacuccugggcucaagcaauccaccugccuccaccucucaaagugcuaggauuacagguguaagucaccuugcccggccuuuagucuaaucucuugcuucuucucacauaguccagcugaacuauuuccugagcauuuuccauuuuuccaugccucugugccucucuauauaccauuuuuuucuaucuagaauacuuuugccucuccuuccacuuacuccuccucucagucucuauauauccaaaugcuacccaugcuuuccagccucaguuuaaaugcuccuuccuccauaaugucuuuucugauccuaaaacacuccuaccuaauccagaggugauuacugucuccucuaaacuuccucucuuucucuguaccuuguugagacacuguaacacaauagauaacagcauagccacuuaugaauuguguggcuuugggcaaaauucuucuccgaaucugagaccuuaaauuuguacaauggagacaaugauaccugucucauaguauucuuguaagaauuaaaugagauuagguaugcuaagaaccuacacagcucucaauuguagcuguccuugaggacagagacgacaucuuguucaacuuuguacucucagcacuuagcauugcacuuggcccagggugguacuaugugaauguuuguggaguaaauagguaccccuuuaguaaugggaaugugguggagaugugcaaaguguuuuccagcuauuuaggaggugaucuuuugugucugucacuugccuuccaauggcucccuugucagccuacaaaauggagcuguccuucucuguuucuaaauuaaaagucaggucaagcaaugcaaauuuugugcuuggugcuucauuccagcucucugauuauucccugaggauuucgcucuccuuuguagagucuggagcucauccuuugcugaggacuugaauccauucagauuuugcauuguuaaguuuucagccaaguucagcuaguuugguaguuuguuuguuuauccuuggccaaaauaugacuuccucuuuuuucaaagugucuuugaaagguaucauaaagguuuugguacauucaaaagaucauuaaauauuuuauguguauauaaugagaaauucuuuguuuucuccuaaacugccccucugguaaagucaagaggaaagcauguguuauaagugggccuuaguuuuuauuuguuggauuugggccucucuccauucucuuuuuggcagauaccuggaguauauugaauuccaaguugacuuucaaucaaacggcauuucuauauuuccuuaagaaaaauacuccuaggguaaaggaaaaaugucuugagugccaagagggacuggucgauagauuuugaccacauuuucaggagcuaaggcaaggauaaauucaaaccuggaucagagaacucaaauggaagaaaagcagccuacuaaaagggcucugccacaggccauugguuucacugccaagggggauaugaguuuuguccuucauaggaaaauaugcagcucuuuaauauucuaucagaaccagaggaugcuguucauggggugugauuugaccacauucagaaauuuagccauaauuuuaaaacgugugggacauuacucuguguuguuguugcuguuuucuuagagccaugguaagggccuagugggugagacagauuggauaugcaacacuaugucauagauauacaucuuccuuaaccuugaacacccuaggaugggagcaagacagggcucaccugggaaacucagcauucaacccauggucuguuacucaggaggcacccuauaaguauuugaaugaauggaaaguacuugucuacaagaaugccuuuuuuagagcuuccuccuggcaucagugugggaggaacauuggagaaauacucaucagccuuuccucugccuucugacucuuacggcaauuccugcuugagggucaaugaaguuuggaagcugguagagggaaagggaaagauuccuuuuaaauuuuuauuuaaucuucccuaucuacuugagaucuguugaugucuggacagauguuaaggcuuuuguuuuuguuaauugcucaucacuuugaacaaaucucuuucucuagccuagaagccaggcuugagcuaaaugacagggcccauuaguauuagucuccuugggcucuguguaucuggugaugaaaaguaggauaaagcugaggggaugagguccugucuguaggaggaagauaccuggggccauacuuuauccuggauucugcucaccuuccccaauucaaaccaauuggugaauauuuuauuugcauagaacaccugcagguauacauguauguuauguucaaugugauacucuaugugaucuuuguagguuuuucaggcuugguaacaguacagcuaaagauuuuggaaggguggagaggcaaguauuaaugccaguucauuugacuucucuaucaccaccaugugaauagaacuuuuauuuaaaaaaagaaaagaaaagccaaacaagcccuaaugucucaugcuaugaacagaagugccugcaauauaggucaagccuuacauguccucuccagaguaggaccacccuacuggagucuggagguagaugauauuuccugagcugcaugucugaauccaucacucccuccccuggcuccuguucuccagacaaauggucuagccaucuugcuggaaucggcaauaucauccaaacauauggcagucuuuggagguaucuaaugggccagcagugcacauuauggugauaucauguuggaaccugacaaguucuauguguaaagcucaauugugcuuaaaaggaaguuccauggccaaucuguucauggaccugacugcuuuauuuagaaaaauuaaagucacucuuccaauuugaucaacaaauacuuauuggggucccauuaaauaccaagccuuauaugaaaaacuuuacauaaacacugucauuuaauucucuuggcaacuuuguuggggagguaauuuuuacaacuuuggagaugauaaaauuagggcuuaaagaagugaagucuuacugcuggcaagugguagagcuuggauuugaauugaggucugucucuuccucaaacucucccuauucugcccuguggcaucccaggaauucuuuuuccuucuuacuuccaauuauuucauagcccaguucuaccaaaaagcauaacucuauuaaggguuccacaguuacaaaaguccuuuggggaugagcccuuuaaccauuguucaugaggaccuuugaaguuucccaaguuccuccuuagucaguugcaugcauauaauaaaaguggucuuguugauggcacaggaaccuacuuucaucaccauuaacuugggaaggcacgaggaaugaaaagaaggugaugagagagagagagagcaagaauucaaugcagccaguuauuucaguucaacucacagauauuuacugagcaucuccuucaugccuagcacaguguuaggcacagugagaauaaagaggcuauauauacagcaccugcucuguaggagaaaggaagacacagaagaaccaaagaguuugggcugaauucugugaacaguugugaggcauuggugacuuuugagcagagaagugacaacugcucccaagguaugcuuuuauucauuccuucugggcuauugcgggggucaggagagagcagcuguugaggagggauggggcagugggcguugaaaaagccagacucuacuaugcugggguauuaaagaugcaacaguuucugcaucuuugccuagcaccucccauacaugugaaaucccacaguuuaauggaaaggauauaaaccaucugcagaaacauauuuguuuaaaaaggagacaccagcaugaagacuuagcaacuuugaaccaguugaaagaagagcagcugccugauauuuucauaguggaucuauugauuguucaucuuccauucuucuugugauuuuuauuacuagcauauuucuauugauugugccagaaagauccuugagagaaagaagaauuuguaaauuguuacuuuagagagauuaaaaucuauguaagaguuaaaguuucuguagguuugguccauuggcaugcacaguuaaagugcauaagauuuuggaagucauuuuauaucaugagggccgauggaggucaggaauuuuccaucccuguucaccuuuucauggaaugcuuacacuuaaucagcaccuacugugugccagacaccaugccaaugcuuucacauauccuuacagcaauuuuguuuuauaggugaggaaacuagggcccagggaaguuauauaacuuaccccaaaucaaaauugguaugcaguagagccaaaguugauggcuguguuuacugguuccaagucuagaacuuuuaccaccacaccacccaccucucucacugaucuauaucauacuccuagaguguguguacacagggugcaucacuagaaagggaugagagucucugacuugcucaugaccacccauugucguuuaaacaaagcacagggccaugcagaaaugggguucaagccucaaauuuugaugagggaaaggaacauguugggaggacuggguacugacacaacgcugccagcccaagaagguugcccugaucagcuauaagacagcaugaagucaacaaaucucuucugaggauauggaaggacuauaaugaaaaugacaucaagaggggaacaaaaacacacuaguccugauucucaauuuuugucccagauagaagcauaacaaugcuucuugguggguacagauccauaucacuucugugcauccaucucuccucucucuuaaaagaccaaugggcugguggcagaguuaaagacugguaaauaggcccagaccaaacuaacaguggcguaucacucuaguuugugccugaaucccagacuugauccuaggaccccuuucaguucccuaacuccucugcuugguuaugauuucauaauuuggaguuggccuaagcucuccagcacacucuuuccaaaauacuucuaggcgaaggcugggagugggaaauacagccuuaugaaauaguuggcuagggccccaccccuucucacaacuggaaaugggaaauagggcuuagcuugguuaaauaaaacauucauuaauaccugggacugggguccugguuauggaggauuaaaauuugggaaaaccuuuucagaaaaugaagagccaaguagucugaaaaagcaaguauuggaauuuuguuaucucagaaaugcuccaugugcuggcuuguuuuucaucaguaauaaagcuaugaggagcaacaaguugauuuauaucugaaaaucuaggaucuggcauugcaaaauaguugcuggaacuuaaugcaagaaaauaguuaauaucuuuagauuuagcuauuaucuauaaucuuuuauuuucucuuuugagcaaaauguauaaaucugauuguuucuaauguuuuuaucacuaaguacaaguauguauauuaaaagcucaguauaacuaucuugacacaagucaguugaacugccuuucuaaaauagaaaguugaauucaacaaaacagcucuaaggccuagucccagcuacucaggaagaucgccugagcccagggguuugaggugucagugagccaugaucaacgccacuacacuccagccuggguggcagagagagaucccuucucuaaaacaaacaaaauccagcucuuuuguauucaauucauagcauuggauagucagcuugccuuuuuuuuccccucaaguguuuugguaucauguagcccagcuucauuuauugguuccuuaaaagaauuauuuuaaauaccuccaaacccagccuugcagaauacuccccuaccccucuucagggacaacaacauaguuuaguuguccuuuuuaucucucccuguuccugaccauuucccucucuuugauccacaaacugggacauuuauaauaucuaauauaauuucuucuaccauccugugaaggcagugauauugucccuauuuugcagauuagcaacaaaaggcucagauuugaaggacuguggucacauggcuaguaguugaccggagcuacucaaucucucaugcggucccuccagauccuaacacucccauaaugguucuaugguggugaucccccuuucuaaugacuccuguggaaacagacuaguaucuacucagaauggaccugcccauagcaaauuucaucuaaguccuacuuuacuauauuaacuacaucgcagauggagacugaggugcagacauuaagucauuuauucuuuuuuuuuucuuuugacaccgauucucacucuuucgcccaggcugaagugcaguagcacgaucucagcucacugcaaccuccaucuccuggggucaagcaauucucguaccucagccacccgaguagcugggauuacaggcgcccaccacugugccuggcuaauuuuuguacuuuugguagagacagggucucacuauguuggucaggcuggucucaaacuccugagcucaagcaauccaccugucucagccucccaaagugcugggauuacaguugugugccacugugcccagccaggucauuuauucuuaaucuugggaaaaaucagcaggaaaaucaggaugagaaccugauaccucuaaggggaacuggaccaggcugccuccuuacuuuaaugcugcuuggaaaacugcucgugacuccuucgccuuuuugauuucacauaaauauuccaagguacccaaacauuuuucaggcacuauuuucgcuuuuuaaaauucucucaaaguuaaaacagaaugccuguaugucugugcauguacauauuuuagaacugugugcuuuauguacuguggcuugaaagccuucuauguuauuuugauuuuauaaauguuuucauaaucacccaaauggugcaguucaugcuuuugucaucgaauauaaacuaaauuuccuaauggaaaaugcauucauucuggaacaaugccagaaauuguccaaagaagauacuugaaguuugugucauaaaauaucuguguggguaaauuaucagguguucaacuaaaacuacagaacugauuuuuuaauuccuauugacaucauugcaagugcuccaaauucuaucacuugugcacuucacaugccuucuucauaauuaacauaaagaaauuaaugucuuacaagcuucaauauuugaugccauaugaauccugaggauauuuaaaaggagaagaaauguaaauaggaugaaauucuuaagcaagauuacugauaugacaggacuaaagagcuucagagugugugaaaagugccucuuuucuucccuuuaauaaguccauuacuugcacuugggcauauuuuaagguccuuuucaugcugaaucuggaguugggcaugcuuugcauuucaagcuuugucuaugaaucaguaaaagccaaaguuauuucugcuuuaaaauaacaggagccaggaacagcuaaucucuuuucauucugaguuccuuacauuauuuuaguggacaaaguuuguguuggcuacaaaacaggccauucacaacaucuaugagaaggaauuuagguaagaaugaagagagauuguaggauguauaaagacucccucuccugaggccauuaagaaauuccaaauuggcacuguuuugaauagugacauugcauuagccuugcuaauuucaguaauucaagcugauagcuucuguuuaccaaucuuuuggauaaaaccuucccaucacuacaguaccaaugugcuucucagcuaaggugaguugguauuuuaaaauaagugauggagggggaagguagugaagcaaguuggagguugaugaugggcagcaugguagcaccucuuucucugucagaaacgcuuugaaaagagguauaugucuuuacuuccucaguaagacaggccuuuugcuuuucuuucuuuaagcaggaaugagagagaauaugagacagaggauaugucacucccuuaccucauugcaucugaccucuuugaugaucucugucuggcuuuuaauuguguucauuucaauaauugggacaggcaaagaaacccauccaagauuuuuuaauuuuuauuuuuaauugguaaauaauaauugcauguauuuguggaguacaaugugauguuucaauauaugaagaaauagggacuuuuuuuuuuuuugagacagagucucacugugucgcccaguuuggagugcaguggcaugaucucagcucacugcaaucuccaccuccccaguucaagcaauucuccugccucagccucccaaguagaugggacuacaggcaugggccaucacgcccagcuaauuuuuguauuuuuaguacagacgggguuuugccauguugaccaaguuugucucgaucuccugaccucaggugauccacccaccucggccucccaaaguguugggauuacaggcgugagccaccaugcccggccaaaauaggcacuuuuuaauaguaggaauacauuugcucuucaguucguaaaaugugcaaauaaacuuacaaacaguuaauggcaaaaacuccagggggaaagggaacuccuuuuuuuaaagacauuguccuaagucucucuugaauaacuggcaucucacaucaugcuggaaaaauguacacagggaaaucuucagagccucacaagcugagaaaguagaaagauugccgaguguuugaaaggguuuaggguuucauuugaagagcagcuacaccccaccgugccuaugcucugauacacagaauaugggugaggcgguccauuggaaaucacccugagugaauucacagugaaccuugggugacaggacacugacggcaauccacaccuuccgaacauccggcccuggguuauugaccugggauuccuguccgucagugacuaagaccaaagcacagauucuucccugaauacuuuggcucaucaaacaauaaagauuagagagagaaaaagagagaugagagagagaaagagacaggagcagagacauagagagacagagagaaaggaaggacaucaaagggugggcggguagaugaugugaaaugcaugagagauuuucuuagguuccagagcaguguuucuccagaaauguuaauggcuuucucaaauaaaaaauaacaucuuacgcuugaggagcacguuaaaguuuacaaguauuauuuacauaucuuaucucauuugagaagugaguacaaguauuuaguauuauacaaguuugauacuaaauaaucaagucuucucugcuuauagacacagcaggaaaggucuguggaucagucuuucccagguuucucuucucagaacacuccacaggcucugccccugcucagaauccccauggcacucuguucaugccucucuuguggcacucaucacauucuaccuuggccuacgggggguuuugguacuugccccaucuuccccacaagauagagaguuccuugagauuuccugaguuuuccucaacuccguacccacuauggcaccuggcacagugucuagcaaacaacagguacccaauuuauguucaucgcugcccuccuaacaccuaugccaugugucaaucuccugcuagauggagagccccuugagggcaggcuccauggguucuccuguccccaaugccuggcccgcugguuccucagacauccauaaauguucucagcacucaagaaauguuacauaaauuggcuggacaugguggcucacgccugugaggcggagguugcagugagcugagaucauacuacugcacuccagccuggaugacagagcgagauuuugucucaaaagaaaaaaaaagaaagaaagaaagaaagaaauguuacauaaauuaaugaauuaauuacauuauacuaaacauacucaauauaaacccuuccuuucaccuguggcugccacacccaccacucguccacuuuaagggcuuauucaugaggacacauuuauuuuuauuuauuuauuuauuuauuuauuuauuuauuuauuuacuuacuuauuuuugagacagagucuugcucuguugcccaggcuggagugcaguggugugaucuuuggcucacugcaaccuccaccucccggauucaagcgauucuccugccucagccuccugaguagcugggauugcaggcccugcuaccaugccgggcuaauuuuuguauuuuuaguagagacaggguuucaccaucuuggccaggcuggucuugaacuccugaccucgugauccauccaccuaggccucccaaagugcugggauuacaggcgugagccaccgcaccuggccgaugacacauuuaaaccaaacuguuuucaucaggccucagguaauggcgacaaagaucagcauccagaauuugauacguuuucaacccuaucuuuccccaaaaagauacuccaaaaagcaaaucguaaggguuagaagagauuuuagagaaagaagcuauagagaaaggaaaagaaaaaguagugagauaaagaagguaggugagagagccuggaaggcgaaggaugcugucugagucuguucucagggcccugcacccucuaaaugcugccuggccaaagcaugagaaaaaugagacaaagaaaaaaaaaaaaagcccaaauugaaaagggagccuccuaaacuuggucuuaggcuucauacugaggaaaaaaagaaagauuugcagguuacuuaccuuguuguuagucaaaagggggcuucacauuucuccccugggugaccuaagcuauaaucugucuccauagcccucuguaaauauuucuuccauuugugaggaaauuauagugacuucagaggcucaacuuacuuucucuaaucucuuggcaaagaaauuaaaaagacaaccagaaauugcuguccgaccggauuucugcauggcauagggagaaccacuugggagaaaucaaucgagaaaaaaaaaaucuuuauuuaaggggaaugcaucuuuaaucaugguaaucccuuuaguaaauugcauucucuggugacauugcauaccuaauuacaguuugcucauuuugauuuucucuuuauauuguugccugcuucuuaugcaguuguggaucugcaggcugagcaaugaauuuacugcuggcauuaaaaacucucggucaagugggucucagguccaaaaugucaccacuuugggaagugaauccaaggucaccagacaauuauauuuccuuuagcacuuccucaaaagauguauucuccacccucuuaaaucauuuggguuauuuucucaaagaaguauucucaacaucuuaaaacugugaaaauaaaaaugaaauauuguaaauggguucaaccaagcaccauagugguagcucacauacuaggauuugcuccauaauccaacugauauagccucgugucaugcugggguuuguuuuguuuuguguuguguuuguuuuuguuuuuguuuuuuaaugaaagcacucuauugccaagucauauucuguggugagucacugugacucccaggucaucuucuguagcaguugugcccagccagauucaucagauguugaaaaugcuguuuguuucaaauaaauauuuuuuauuuauuuauuuauuuuuauuuuuuauguuuuugagacggagucuugcucugucacccaggcuggagugcaguggcgugaucucggcucacugcaagcuccaccucccagguucacgccauucuccugccucagccuccccaguagcugggacuacaggcgcccgccaccaugcccggcuaauuuuuuuguauuuuuaguagagacgggguuucacuguguuagccaggauggucucgaucuccugaccucaugauccgccugccucggccucccaaagugcugggauuacaggcaugagccaccaugcccggccccuuaaaugaauacuuuuuaauagcaguugcauuagggugauagcauuauaagaugauauuucaaaaaaaaaucuuuauuuuuuuuuuaaauuauacuuuaaguucuaggguacauguguacaacgugcagguuuguuacauauguauacaugagccauguuggugugcugcacccauuaacucgucauuuacauuagguauaucuccuaauguuaucccuccccccuccccccacccccccaaaaacuuuaaugucauauuucccugauaaccuccucuacauaaucuuuuugacaucauuuuuaagaaaaaaaaacauuacucucccuucucucaaaauauuuuucuccaaccaaucuguaccaccuucugucuuguaacuugucccccauacagccuccauuccuacaugccaggaccuuggcauguaggaaucaccauguacccaaaggugguauguucuaggauauucacuacagcauuguuuauacagggagaaaugagaaacaaccuaaaugcccaucagugggaaaaugguuaauuguguuauauuaauacuaugaaauuccuugcaguaaugagaaagaaagagguaguuccacauguaugaacaggcagagauuucuaagacauuacauuacagucugagccuauguaugcauauucauggaaaauccaguaauuacucuuggauagugcuaggagggggaggugaaagggggcucucuuuuguuacucuauauacuuaggcauuguuugaaucuuuagcuucaagaauguauucacauguugaguaguuuuaaaauuaacaaaauaaaagaacucuaucaagaguucagggaggaugauuugagaggggacaaaacaggggagcugucacaauaguccaggugagaaauuauaagaacauaaucuaagccguagcaaacaaugguaauugaaagaagaguucacaaaauaucaaggaaacagaauuuacaggaugggguaauuaauuacagcuggaggaugaaaaaggaggaggaaucuggggguggcuggcagguuucuggauugggcaacaguagaagcauuuacugaaaaaggggaaccugggaggaggggcaguuaagggaauagaaauagaaaugcugcauugcugcauucaucauuucaguggcuuuuuuuuuuuauuuuuuuuuuugagauggagucucgccuugucacccaggcuggagugcaguggcacaaucucggcucacugcagucucugccucucagguucaagcgauucuccugccucagccucccaaguagcuaggacuacaggugcaugccaccacaccuggcuaauuuuuguauuuuuauuagagacaggguuucaccauguuggccuggcuggucuugaacuucuggccucaagggauccacccaccuuggccucccaaagugcugggauuacaggcuugagccaccacacccagccuucaguggcauguugagucugaaaugccugagagacauccaaguagaaauggccagugggcaguuagaucuucagaaagaugucugagcuagagauagauuugagaauccucagcgauaaacagaaucagggacauggaugagagcauuuaggaagauuuguaagaugagaagaguggaaggccaaggaagagaugagagaauauccaucuuuaagaaaugagcagaggcaaaagagccugcaaaggaaucugagaaugaucagagaaguaggaggagcauccagaaggaagugguguaagggggaaccaaguuucaagacagagaguggccagccuggccagguggcaugcgcccauaguuccagcuacuuggaagcugaggugggaggauugcuugagcacagguguucaaggcugcagugagcuauguuugcaucacugcacuccaccugggugauagaguaagacucuuucucaaaaaaagaaagaaaaaauaccuggguguaguggcaugucccuguagauacagcuacuccagaggcugaggcaggaggaucauaugagcccaggaggucaaggcuguguuagaaacaaaaugcuuguuccucagugccacaaagaaauagcacucaaacauaaauuuaauuuucucagcaaggcaauuuuuacuucuauagaagggugcaacucaugaauggaguaauggcaagagcacaccugaacaagggaagggaagggguucuuauuccugacgcugguagccccuacugcugugucguuccccuacuggcuaggguuggaccacacagucuaagcuaauuccaauuggcuauuuuaaagagagcagggguaugagccagagcagcagggugaguaguuugguggggaggacgguuagaaacagguaacuaaaggugacuuaggucaaagcaggugaccaggggugacucaggucaaagcaggugaccagggugagucaggauggagcaggugaccaggggaacagaugugaacuacugauuaaaacugguggaaaagguuguuuacugaaacuacaaggaaguuaaacuuuaaaaugcaggacaaagaacugaacauacugacauacuaauucuuugacgagaaaucuagaacucacuguaucuaacagcugcaaugagccaugauugcaucacugcacuccagccugggcaacagagugagaccccaucucuaaaaaaaaaaaaaaaaaauugccagauacaguggcucacaccuguaauccuagcacuuugggaggccaaggugaguggaucccgaggucaagagauugagaccauccuggccaacauggugaaaccccgucucuacuaaaaauacaaaaauuagcugggcaugguggugcgcaccuguagucccagcuacucagggggcugaggcaggagaaucacuuaaaccugggagguggagguugcagugagccgagauugugccacugcacuccagccuggcgacacaguaagacuccaucucaaaaaaaaaaaagagagagagagagagagaaagaggauagucuguaguauugaaugcuguagagagcucaggauggaaacccugaaaagaauccauugaggaauuaacuguaaacuagcaugagggaucuuauugggcuaaugaaaaugaucuaaaauuggauuauagugauaguugcacaccucaguaaauuuaaaaauuauugaauucugugcuugaaauguacuugaaaugggugaauuuuaugaauuuuguuuuaaauuaugccuuaauaaaguugucaaaaauauaaauggaaaaaaagaauccauugaaauuuaguuuagggcaaaauauuauuccaaggggcacuucuagucugaucucuuccuaaaugguuugggaaaagcccugugaaauaaaaugacagggagucuaugagauuacugaugcuacaccucaacacuccuauauugcaauaucaauauuuagcuuauugucugauuugcuuuucaccaagcugauacuaucaaccuauguccuguccuccucuggauaauugcagauuaguuguuuuacuuauuuuuaucauuucguauuuuuagcacauauuucuagaaaaaaaguaggaugccaggcuauaaagccucaauuuauaccuguuuuaguuguuguuguugauugcauuuuaauguguuuaaacauggauuccuuauuggcccuacagaaagugagauuucauacugaaaucucaucauucauuuucugacacuucuaugaugccuguccuucucagccauuuuccuucuuaauucgacuuggccaaucacacgauguauuugucuugguuaaugggcacaugugauguauucuauaguuagguaaaaacaaaauggaaaacuucugccccuucuuaguuguaaggaaccagggcugucaauggcccuacuuaauuaaaguguucguuucuugccaauugcaucuucuuuuuauuuugguucaauaucuuccugcugcuuauuauaguccugcuuagugaucuggcugccacucuuuguaguagaauuuuccuuuuucccuuucacaucuuuauagccgugaguuugagccacuuagcaucuuuuuacuuuuccuggccuccuuuugcacuugcuugcuuuguucuaaugcccacagagcuauuuguaugaggaucauccagcuuuuucuccucaguugccuuccuguugguuccuuccaacuuauguccuaaucauguucccaaauugaauuuucuucaccugaugccucuucuuuucuuccucuggauccugagugaugccauugugugauugcauugagcaaaauaucuacuaacugcgaauuaguuuccuauugggagggagaaaaauucaauguaaacaauugcugaguugguugcuccaucuucuccauaggcaguauccucauaugaccaucuuuaccguauaggcgcauuucguauugcuugauauguauucacacuaucccugagauuaaccucuaguuuaauaagcuggauagauuaugugguuuuuucuccccacuccaggcagguccgugguuauuucccuacaauuaugucuuggucaauaacuccuugacugauuuaaagcccuccucccuaagugagucauggucuccaaaagacgcuggucccuuucuuugaaaaggaugcaaagcagucucuuuagauuucucuccagugucugugucaaagcaaaggucacuuuaacccuuaugcuuucacccuucuucccugccaugagaccucucaagaccugaaugaaaucuuagacucuuagggcuagcaagggucaucagaagcuauuuaccuucacccccucauuccauguuugcaucccuucaccgacaucucuaccuaauggcuguccaaacucucauagacugccucccagagauagaucucacugccuagggccagccuaugcaauuuccagauugcacuuauuauuagaaaguucuuuaucuuucaaguccaguuuucagauuguguuauuagaaaguucuuaauuucuuuuaaauccaaaucauuuuccccuuaggggaaagacaaagccaugaaucagcauuaacuaaaauggcauggcuauggggcaagaagaaucuaagaugaagaaagagagaagaggaaugacaaagagggugcaggcaggugcuggggucaggaaacaggcaggcauuaucagauaaauaggucuguggagcuagaggggcacaggagggaaacugaggugacaggcagaagugcugagaggagaacaguaagggaauggaaacugguggaaaauuaaagaaggagauacuggaaucucuucuaaaaggaauggaacccagacuagagguuuaaaucaaaguggggaggaacagaaaaucauuuuuaagauucaaaaccuaucagaggauuccaacguugcccuuugccuacagcuguggaaaagagcauuauggagacaggagaaaauguuuacuagaacaaggacuagacagaagagaagggaauaauuggacacaggaaauuaguuuaaagagcaauggaaagagaaaaagaagugaauagagaaauggaaaggagggggaaugaaaacacagaacuuuuagguuaaagaauuacauuuauuccugugccagcacauaauuguauuuuccuggcaagcauccugcagcccucugcaagggaaaaggggugccggcaugugugacugcagggauugaagucuuacugcuuuguacuauuacagccaagcgagggacuucauuaacgagccuguguuuugaugucacagagacaggcacugaaacuucaaucaccagcagucccugcacuugagaaucaguggugauggaaagggcaggguguggccaagggcgaaggguggggugggggggggcagauugugaggcugggacaggggucaaagguaugggaacacaaucaugaagguuccaaguaagaaaugaauagaaccuacucaucaaaaacccuguuuccugcccagcauggcacacagauugccagcaugugucagcugcucacauagcaaagcaucaaguuccaggcagcaaaagggaauaagaacauaaucuuuguggauuccauccacacugagugugguaaacugaugcuguggguaaugaggacugaguauugcucagaaguaccuuggaaucuagaggucagggcuugagcccugccauuugcuuccugagccacccaccauuggcccugccuuuuucuugacuucauggaucagugguggcuccuucuccuaaggaaaucaucaguuaguagagaucaacuccuugggaagggugucuuguaaggaggcagcccuucaccugcacauucucaguaggguggagauguguguucauucaugcagccauuguuuccugcauucacucagucauucaacugaaugacugauguuuuuagguguuuguguuagccaagcacugugugggagugacagaggggaauaaggugaauuucuuucuucaaugaagcacagucuaguugaggagaggaacauagaaaugacuaacucuacugugaggcagauggaaauuaguacuguaauagagguucaauucaauuaauacucagagagagaagugauuuauuuggcuugaagugagaagggaaggcuuccuggaagaggcuaucauguaaguugaggcuugaaagauacaauuguggggccggucacaguggcucacuccuguaaucccagcacuuuaggaggccgagacaggcagaucaccugaggucaagaguucgagaccagccuggccaacauggugaaaccccaucucuacucaaaauacaaaauuagccuggcaugguggugcaugccuguaaucccagcuacuugggaggcugaggcaggagaaucucuugaacccgggaggcagagguugcaaugagccgagaucacaccauugcacuccagccugggcaacaagagugaaacucugucuaaaaaaaaacaaaacaaacaaacagaaagauacaauuguggauagaaaagagaggguaggugggagacagaaagacagaggggggaggaaggagagaaagagaaagagaaagggagagagagagaaaaggauagaaagagagaaggagggagggaagacaggaagagagagagggagggaaggagaaaaagaaggacagggagggagggagagagagggagggaaggagaaaaagaaggacagggagggagggagagagagggaggaagguaaagagagagagagggaggaugguaaagagagagagagggaaggagagacaggagaggggggaaggauggagggagagaaagaagagagggagaaggggagaagaagagagagagagauaaagaggggggagggagggagagagagagagaggccauuccaggcuaagggaauagcaugaagaaagacaugggaacuccagagugcuuggcauuuucagcaaauggugaaugggaugguaugacugcagcauauggcacuuggagaaauauaugggcaguugaaacuggaaagcaagaaaagaugagcuggggaggcucaugaaugccaugcucaggaauuaggacucuaucccacaugcaguagggagccaucaaaggauuuugaggaagagagaaauguguuccaacauauguuucaggaaaagaguuuucucugguuccagcuaucacagaauggaacauucuuucuuccuggauggcaaugggccccuggagaggaauggcucuuauguggcuaaggcauugaggacuguggguggcggugguggggaagcugaaggaaagaggagaaauggacagcaucaaaagagauggcaccugugugaaugugagaaugggcacucgcugacaugcagguccaaaggugggaagagaggaggauggagccaggaugacagugugugcuuccgaguaaauugagggaaaaugagucucaauucuccaaaucccauugaugaugaguguauuaguccauuuuuaugcugcugauaaagacaugccugagccugggcaauuuacaaaaagaaaagagacuuaauggacuuacaguuccacaugacuggggaggccucacaauaaugauggaaggcaaggaggagcaagucacaucuuauguggauggcggcaggcaaaaagagagcuugugcagggagacucccauuuuuaaaaccaucagaucucaugagacuuauucauuaucacaagaagagcacaggaaagaccugcccccgugauucaauuaccucccaccggguccuucccacaacccuugggaauucaagaugagauuuggguagggacacagccaaacuauaucaaugagggagagauuucauacucagaaaguauuuaaagaacaaauccaaauggaauaacuuagggaggcuauucaucuuucauguauaaggauaccugccugcuguugauuacuggauaggguguuuucagggccuugagccauuuugaccccuuggcuauuguaugaguaccuuucuuggcuguugggcauugccaggacauugcaugcauuuuaguucucagguccauuuauuuauugauuuauuuauuuauuuuguaagauccauuguggcugauuaaaaauguaagguuaccugauuugggguuuucccauccaaguauaucuaaaacccugauacacugaugaagcccugauauacuugggcuccaagggacugcaaggccacucccucacucccauaaccccucaccagcaauuggauuuggcuacaauaagugacauuuuguguuuuucuucuaugugcucaaagcccaaugaugcauaccucuguagcugcaucaugccugaaauguauauugcaaacagagcucugugaaucuaaaugauuaaauaacuuuugaaaauguuauaaggacagaguguaugcuuucauuuacuuuuuuuuuaacaguuucagcguagcagccuuuguaugaguuacaaaagcaaauguaaguuuccugagaauguauaaaagugucucuuaaaaaaaugcagccucaugccugggagugguggcucacaccuguaaucgcagcacuuugggaggcugaggcaagcauauggcuugagcucaggaguucaagaccagcccggacaacauggugaaaccaugucuguacuaaaaauacaaaaauuagccugguguggugaugugcaucuuaguccuauaggcugaggaaggaggauggcuugagccugggagacagagguugcagugagcuacgaucacaccacugcauuccagccugggcaacagagccagacccugucucaaaauaaugaugaugaugaugauaauaauaauaauaauaaugcagccucagauuaaaauucuuggugaaaauuacccucuuccccauucccaguugaagagcuaucuauaucugcuauuccaggguagcacucaaauauccauucaucuucauucuuuugcacaacuuaacuugacuuucaaagcacagacgaguaccauuuggcauggaugcuuugguaucagguauauucacacacagaccccucuacaagguaagauaccagaguaguggugcacuccccuuaggaacuagggagcauccccagaugcuguuaucucuugguuucuaguguaaguuuuuuuuucuuuaaauuauggcaaaauauauagaauguaaacuuugcuauuuuaaccaauuuuuauuuuuuauugagguaaaauauacauauauacuuugcuaucuuuauuaauuuugagugugcaguucagugguaauaaauacauuuguauucuuuuuuucuccuucaucccuccugcuucuccccuucccagccucugguaaccaccaaucuaccuucaugagaucuauuuuuuagcucccacauaugagugagaacaugcaauuuuugucuuucugugccuggcuuauuucacucaacauaauggccuccaauuccauccacguuguugcaaaugauaggaucucauucuuuuuuauagcugaauaguacuccacuguguauacauaccacauuuucuuuauccauucaucuauugaugcacacuuagguuaauuccaaagcugggcuauugugaauaguacuacaacaaaccuggaaguacagauaucucuucgauauacugauucccuuucuuuugaguauauaccuagcaguaggauugcuggaucauaugguuguuuuauuuuuuguuuuuugaggaaccuccaaacuguucuccauagugguuguuuacaucucuaccaacaguguacaaggguuccccuuucuucacauuugaaccauuuuaaaguauacaauucagugguguuaauuucauuuacaauguugugcaaccaucaccacuauuuccaaaauauuucaucaucccaaaaagaaacucuguaacuuuuaagcuguaacucacccuuccccuacccccagccacuggcaaucacuaaucuacuuucucucucucucuauuuguuuaugcuggacauuucauauaaauggaauuauauacuauauggcauuuugugacuggcuucuuucacuuacuauaaugguuuuuuuuuaaguuuuuuuuuuuuaaucuuggcuauuccacauccuucuuaauguguauauuaaguuguucuuuagcuagguagaagagguguauacauaucauuauggaaaauaauucuuuuggcugaccuggaaugacacaaaagaaagugaggaacauuuaaguaauaauaaccuuaaugucucagaacuuguaagggcugaaaauuggacaagcugaagaauuccagcauaaguuucuguguuauucuagaaugcaggcuaauuucaauauguguguggugcaacuaaaaacuaacagcaagaggagauaaguuagagaaaugacuaccuuguggagaauuuagggccaccaacauauuagaaguaguuaaaguccuaucaguguuugucaaccuuuagaaauugacauccccguuuguuugcuuguuuguuuauuuaugagacagagucucgcucaagguucauucauguggugccauuuaucaguacaucauuccuuuuuuuuuuuggcuaauaguccauugaauggacguaccacauuuugugucuccauucaucuguugauggacacuuagguucuuuccaccuuucagcuauuaggaauacaaugcaaugaacauuggcauacaaguaucuguuugaguaucugguuacagguuguuuaugcaucaaugacagcaagaauauaguauuuuaaaaggccauuuugcuuuggaauucuagaggcaccgucuaacaaaacuugguuguacagacuggugagguguuguggcacuaacagcacugccaugcaccccaggcacagucaggguggcaaaugccucauuucacucacucucagacuucucagagaauccacauuagcucccccucucuccuuaacucacuaaucacugucuuuuuuuaacagaugggucuugcuguguugcccagacuggaauacaguggcuauucauagguguaaucauagugcacuacagucuugaacuccuggccucccaccucagcaacccaaguagcugggacuacaggcaggcaccauggccacaucugguuucuuacccaacaauccuacugaaacaucuuccaaaaaucacccauaaccuucuauuuaacaucuacaguggcuucuuuucagucuuuacuuuucuugaccccuacacaacauuugaccguguuaacccaccccucuuuaaaguguuucccaucccuugucuucucuagaucaguuaucuugaucuucuucccuggcccuugcuguacagugucucuguccucagcuccucuucuucuacugacuguuaggcccaucauuucccaugggaaugagauaaccuuuccugugggaaguaaaggcucugaugagcuucgaucucuguggagcuguuaggcagccucaggcaagaaggaccuguagacaucagaggaguggucaugacacugcuggggaagguggugagaaugcuggggcugguggaggagagccaccacccacauuacccacacauacugucagugcuuccaggaugggguuguucuguuccugggaauaugguuugacucaugaugugccuaaauaacuaugguaggccgggcacaguggcucacgccuguaauccuagcacuuuggaggcugaggaaggaggauaauuugaggccaggaguuuaagaccagccugggcaacagagcaagacccugucucuacaaaaaauaaaaauaaaaaaauuagccagacgugguggcacacaccuguggucccagcuacuugggaggcugagguggcaggauugcuugaguccagguauucaaggcugcugugagccaugacuaugccacugcacugggaaacagagugagaccccaucucuauaaauaguaaguauguaaguaagugguggcccauaugacuuuuuuauuucuuucuuaauggcuacacauaauagugaagcauagcuggugguugaaaaccccuggaaacauuuguguuagaaaaaggaagcagucugagcccuaguuaaggacaaucacugugauguuucccucguaacaaggaaguugccauagaaaagacuacauuaagucacucaucaggaauuugugagucagaagguccagcgugguaguugacaaagcccaggugacccaaguugccuaacagugcugggauuguuuuuuguuuguuuguuuguaacagggucuuacucuaucacccaggguguagugcaguggcacaaucacagcucacugcagccucaaccuccugaacucaagcaaucaucccacgucagccucccaaguagcuggaacuacaagcacacgccaccaugcccagcuaacuuuucuguuuuuuguagaaacaagguuucaccauguugccaaggcugguuucaaacuccugggcugaagugacccaucccccuuggccuaccagaauccugggauuacaagguguaagccaccguacccaaccucuaacaguguuuuuaagauuuuucuaccuaaauccccccacuacgucagagaagggugagugaaucccuacuccugaggauuugagacauaaccugcuaaacaggaaaugucugaugacuucagugagcuugcaacuaauacauuucugcuccaucauuagccuugcauauuuuaguauaaaaaagugugcuuucccccaauucccuaggaagaagcaugugauggcuucauguaccuacaacccacugcaguguaaucugaagauacacauacuccagauugagaaacagaggccuacaauaagagaggccaugccucagcuaaugggaaaaauucauuauauucuuucaacauccuauuguuguaacuaaagauguuugcaagcuggaaugagccauaagaaaugaagaggacaucucauugcccaaacccucuucuaggagaggccauuggauuauucccagguguuacugucauuuagugggcaaaauuagcaauucauuuguuugucagaaaggcagauugugggccaggugugguggcucacaccuguaauccacgcacuuugggaggccaaggcgggcagaucgcuugagcucaggaguucgagaccagccuggacagcauggugaaacccugucucuaugaaauauacaaaaauaauccaggaguggugguauguauuuguaaucccagcuacucaggaggcugaggcacaagaaucacuugaacucuggagguggagguugcagugagccaagaucacgccacugcacuccagccugggugacacggcgagacugucuaaaaaaaaaggcagauuguuaaaugagcccauucccaaaagaagucccauuagaccaguuaaaaaccagaggucucaaguauuucuuguccuccucaucugaucuaugaagaagaaaaucuagacucccagagacccaagggucauuugaaaagucauuuucuucugcuuuaaagucuagucauuucacaucuaaaaguugacaaaagaggagguauugagguggcaggaaagaggguugugcugaagggagaacaaggaaaccagggucuguuuuggauucaagagcgaauggcagagcccaguggcuccugugggaacagccagcagagugagcaguauugcaaugaaugugauuucuccagagauuucccccagcuucagccucuggggguugccaagcaauguccugagguuucacguaugcaugucuuggaggccaacuguacacagcaaaugcaaaacacagagauagcaguauugcucuguugcuauauuagggccagauugaagccaucugcugaugcaagcuuggcaaguaagaaacccccaugcuuggcucagcaguagcguuuucucuccuggcauuuugauagcagcacuucuuucagucugcccugugaagucuuccuguugguaugggugaagcccucauagcaaugcaucauccuccuugaagcccacacccucagagggugagcauuugcuuccuauuaugugcucaagacuccauuagcuuuguaagggcccaaaggcuugucuuccuggcucccagaucccccugugcaugccuauccaugccugcuugaugcaccccagguccagcaacuucucccccaaagcucuguguguacugccuccaauggaaguuguuaugccagaguuuaaaagcaaaacagaaacaauccagcauggauguguuuauagccaggaucucucauccaagauuaaaaaacagcucaagaaaaaaagagaauucagaauuugguagcugaugaauaucaccagagaaacaucccaagggaagcaacugauugaccugacuugcuuauggaggcccugucagggacagccaccuuggcugcuguaaguggaagacugauuacagccugcagcaggcuaugucccucagugggcugcaagagccuuggaaucagagagaaauaaaacuagaaggaaacuuagaggucauccaguucaacacuuugauuuaccagauggggcaacugaggcccagaaaagaaggaaaugacuugucuaaggugagauaauaagucaguagcuaaacuaggcuuggaacccagggcuccagacugccaggaugcacaggaucacuugaggccaggaauuuaagaccagccuccuagggacucugcuaggagacgcugaauaaccaaagauggagggcucucuauuuauugcuuuucucaauacagaaaaacuuuucaacacacaaaaaaaugcagaccuuaaugacugacaauuauuuuaaaaaagaauuaucuagucuacaacacaaaggacaugaaggcgaaaugagagucaggggcugaauguguaauuaguacagauguugagucuacccuuugggcauaguuaaacugauuacaaauagaaacagauuuuuggauuuagcaugaaaaucuccuugcuggcccaaaagguucucacugaugaucaagauagaaacaauuuaugugcauuuuauaauauguaccuaauacagcaaaaauacauucuggaaaaucacugauaaacauaaagauaugaaugauugaaaagagaaugguuuguggugauucucauaauacaucugguuuguagcaaacugagaaguuucugguuugauguagauuuagccacuuuguaggguuuuuuuuuuguuuuuguuuuuuuaacuuugcuacuggcugauuccccagauacuauucccacaggcuucuuguuuauuucaacacaagaugucugacaagucucucccucuuagagcugucuuccacaguguuaacaaucaucuuucuaaaaaacacaaaucagauuguguuguuuguuuacuucaaaaccuucaguggcucccuguugcucacagaauaguuuuacuuuccuaauccaccaugauuuggcucuuacuugucccuccgccuuaccuuucaucucccaccaccucuucccccacagugcgcgcacacacacacacacacacacacacacacacacacacacaccacaacaauguccauucuguggcuccuccuaccauggaggcuacuugcugcuucugaauaugccucauagacauucucugagcuuggugauuuuggucaggcuguacccucugccuggaauaaccauucauucagccccugccauaauucuguccauccuucaugguguagauuaugucccaauuauucuuaauuuuauuauuuuuuauuuuuauuucaauaguuuuuggguacagauguuauuuaguuacauggaugaguucuuuaguggugaauuuucagauuuuagugcaccuaucguccaagcaguauacacuguacccaauauguagucuuuuaucccucaccucacucccacucuguccccugaguccccagugucuauuaugucauucuuaugccuuuguguccucauagcuuaguucccacuuauaagugaaaacauacgauauuugguuuuccauuccugaguuacuucccuuagaauaauggccuccggcuccauccaaguugcugcaaaagacauuauuucauucauuuuuauggcugaguaguguuacaugguguauguauaccacauuuucuuuauccacuuguugguugaugggcacuuaggcuggauccauauuuuugcaauugcaaauugagcugcuauaaccaugcguguucaugugucuuuuucauagaaugacuucuuuuccuuuggguagauacccaguagugggauaucccaauuguuuuaagaagucuucccagaucuuucuauuuggaauuuuuaucucuuucucuucuauccccgagguguuuugcuugugccuuuaacugagcccuuucuacuuucugccacguagcuaguugaauugucucuugaucaauuucccuugccagugagggggcucaugaaggcagacaguaagucuuucucuaacccucaacugugaugcuugagacaucauaggcuaguuuuguuuguugaauuaaauuggauuacauuuccccuguccagaaaugucuguauuuaucuuucaccaaaaauccuauuuccucugucuccauaaugcuucauuauugugcuaagcuauucccuuuaucucuaaucuucaugaugguggcccaagcguacaguggcuuugcugggauucccaccaauuauaagccacaggugccuggcuauggaauugguugauaaacuuuugcuacugcugaaugaagagccucaggaaaccugcagccauagcuuauggaacacagggagauagcguucugaauauuccugggggccuuuuggagguagaagacuuggccaccuuugugguugggguaucuaauggcuuuggccaucauuguugauuucuucagggaaauagaacugauaugauaauucccauuuccaacccagagcucuuuucaggauuucaaaaaguuuaacaaggcuacuuaaucaaguauguggucaauuuuaugugcaaacagugacuuugcucucaugcuguuuggaaguucucuuuggcacuguguauuucacuaauggaguuuguuuucaagaagaauccauuacuacuuaauuacuguaguuuauuugguauauagaauuuuucaagaggcaguguagcuucauuugagguuuagagucagaccuggacucaaauagcucuucuaccccauaccagcuguguaaauaugggcaaaauaauuaaccugagcuugagcuuccucuccaguaaaaugggaauuauaauaccuaccuuauaacaucguggagaugguuaaauucaaugaaauaauguacggaaauaguuuaacacagugccuggccuacagugaggacucaguaguugggggucauuacuauaauuaaaaaauacagggcccaagagauagaaauagcaaaagagggccaggcacaguggcucacacuuguaauuccagaauuuugggaggccgagguggucagaucgcuugagcucaggaguuugagaccagccugggcaacauggcaaaaccccgucucuagaaaaaaaaaaaaaaauacaaauaauagccaggcaggguggcacaugccugacuauuauuuguauuuuuuuuuucuggagacgggguuuugccauggccccagcuacuugggaggccaaugugggaggauugcuugagcccuggaaaucgaggcugcauugagccaugaucgcaccacuauacugcagccugggcgacacagaaagacccugucucaaaaaaacaaaacaaaacaaaaaacaaacaaaaucagaagaggucuuuacuggcaaaaaaaaaaaaaaauuagacacaacuggauuuaacaaaacuucuggguuugccguaacuacuacaguaaacaaaacuguugaaaguuagcagaugauuugaagaaagaaacaguguaggagcugaguagugacauuaauagauauuguuucaucuugauguugggcaaggggcacuauccagaaaaggaaucugaaagcaaugcugagagugcucgcauucaggucaacccuaaaaauacuccucuuuauuuaaguugagaaguugcugugagaaccaaggcugggcuuucaacagaucuagccauaugugcucuccacuuuggugaaacccgaucaugaccuaagccugugcuauccuugccgacugacagcugaccucggccuucucugugcacccugcauaguucaccuuucaaagaaagaggucuaauuuccaaguagagcauugcucuuuguucuuuuucucuuuuuauuuuguuuguagguauuuauuuuggaaggcagggaaucuagauuguagucugcucaauugcuucucccuggguaagagaguuuccuggaaaauuugauuugaauuauuacgaguacucaggaagaaaaacucucugcuuuuaaaugaguaaaauguaaccagauucauauaucuuaaaccuuaggacauuauuucuuucuacagccaugaaaauaguuauaguuaauaacaaaauggagaaaauauuuguauaaaauauaggcaaaaguucaacaaaauauauauuauuaaaaugaauaggaaaaauaucaauacccacuagauaaaaaggcaaaagguauaaacuacuacacauugagaaauauaauuaguaaacuaaaacauaggaaaaguuugucugcacuaguaaucaaaucccugcaaauuaaagaaacguugagaugucgccuuauauuagcaaaaaauaucuuuuuucaauggaggugccguaaaauuguuucucucaucauugcugguggcaauauagauugcaauagaccuuuuggaaauugguaucuuagucugugaaauuagacucccuggcuuugaucacuuugaccuugcugccugcccuaaccagugcuagccuuagcagagccuugguccugggcccugcucuguacuggaccagcugaguccccacgcuuucuuccugugacuuauugaguguuucauccccuguaagagaagcucuuccuuccucuuccuuccuucccucuguagaaucccagucauuuccucugugccuguugccgggcaucucagugucccaaaggaucuuucuagcucccuuggcuaccagacaguuggcuggugaaguugcucacaucauaucaccuucacaagauauugaaauagcaacauuggcaacggagucuagaagagccaagagaguagauuugaucucuaaaucuggaaaagcaaaucugaaagauaaugagcccuuggccagggucagccaucuugaauuuccugauaaaccacugucuuccuuagauuugccuucuggggccaccuuugcuuuaggacaagcuaaauaacacccugauuucuuuucagaaucaugaacauauaucauaaaugcuaggcagucaaagaaugaaaggcucuugcccauuagccucuccuuacacccauucacuugguaucaguuuaaaucuaugcuuugaucaauuuugcuuuuuugcgaggauucuuuuuagggggaaaugaaaagaccuuauagauaaaaggagaauuauuugggaaaauaaaacaacuuucaacagcaaacuaccuauccucaacccuaauuaaggaaaagcucccaggacaaggaaauguauauaaggugcagggccuaagaaacguacacugggaacccacagcacccccuccccaccagcacacauacacacaagaacacaaccacaugguauagucaccuauauggcaucuuacguuuugauacccauaagaucuggugaaaaugcccuucaagcaaaaccuugccugggaggagauguugcaaagggcuagcaugcacccuacaauguggaugcagccaaaggggaguggggugcagccuguucgcuccccacuccugcuugcugugaucucuggaaggagcacuucuggcuggcuccuuccacugccuccccucuccccacccccacccccacauauccuucuuuuucccaucucacaguggccuuuuucucccccauaaaaaagggaaucaaagcugaggcuuuccagugguccagacacaugcucgagcugugcauaguguuauacugaggcuauggguagacuugcauuucaaauccuucucuuuugauugacagaacuggccuaugaucuggauguggaugaugcgccuggaaacagucagcaggcaacuccgaaggacaacgagauaagcaccuuucacaaccucgggaacguucauuccccgcugaagcuucucaccagcauggccaucucgguggugugcuucuucuuccuggugcacugacugccuggugcccagcacaugugcugcccuacagcacccuguggucuuccucgauaaagggaaccacuuucuuauuuuuuucuauuuuuuuuuuuuuguuauccuguauaccuccuccagccaugaaguagaggacuaaccauguguuauguuuucgaaaaucaaaugguaucuuuuggaggaagauacauuuuagugguagcauauagauuguccuuuugcaaagaaagaaaaaaaaccaucaaguugugccaaauuauucuccuauguuuggcugcuagaacaugguuaccaugucuuucucucucacucccucccuuucuaucguucucucuuugcauggauuucuuugaaaaaaaau

SEQ ID NO: 21572 - RNA, 22828 nt, Homo sapiens
agccacgcaaaggagaauggaagcaaaacuuuauuccucuuggcuggagaagagaacuagugggugguuguguacaggacccccaucccucaccccucccagaaccaaagaagacaagcagcgccaccaaauggcucccucugcccaagugaaagccgagaggucagcggcuggcuggggaggcaggugagcgcagcacggcacagggcaggggcggcugcagugacaggcgggcggccagggcggccugggccgggguugaggggaagagggcggggcugcuuggguagcggggcaggcuugggggcugccggcuggcacgggccccagacucagggcaccacaacgcgguaggggcugccugggaugugcucguccccccauuugaccaccaguguguacucccccuuguccuugagcagguaggacacgcuguagagccggcugcccacgugcuucaccaggaucuccucgcaggggguccuugggccaugaacccccaccagcagcauguuguugccugaggcaagagggguccucagucccaggucccagcccccuuccucccgcugguguccugcucuccucuccugucccuaagccaguucuggggugacaguucucucuuccuaaagagcugccagcaccuccccaacccaggccagcuuagcagauuccagcuccucccuggucuuuguuugagggguccaggagguggcagggagguggcucuagaagugaaagccacgccccaaaggcggucccugcucucccagacacuggccauccugugauuucuggccucauuuuggugggaaggugggccgggggcccggguugcccaccugcuuugcugcagucuacugugaagcugcucuucuggccuacguaggccuugcucagccccaggcccuuggccaccaccuugcuggcgucagcaggcccaggacccggggccccaugcuggggggcacagguggccuuggucagagagucuacaaacacugaugaugucucguggaggcugugguugcugacgagacgggggccugcaaggcagaguggguggggcuaagagguggcuguggugccgggcguugggcagaugccaauagcuuggccccaggcucaccugugacuuuggccuugaaggggcugcccccaaugugguaggggccgccguacuugauggagaugagguagcugccaggugccauggggguauaggugacgcgguagcccucagggcacuccuggcaauccaucuucaccuuggaggggccgucaauggucaccgacagggcaccagcucccgcauugcucguguucacgacgaacucagcuggguucccugggagcacaggaggucaggcagagccagacuggccugccucccuguccucggccacccagcacaggcuugucaccuccaggugccuccuguugucaccaagagcuuggaggcaagggccuagcagcugugugcacacgugcagccgcaccgacagacuuaccugugacaccgccuuccagaccugcuccguaagcagacaccaagccuggguccccuccaugcccaggcuccccaacucggaucuugaaggggcuuccagggaugugggugccguugaacuugacgucaaucagguaaacgccauucucccgagggaugaagcgcacagcauacuuaucugaggagcagggagucaugcugugggccuggggccccuccucaaaccagcagauggugucugugaggaacagccucaacccuggcccuccccauuuugccgguccaucagugugagcccagccacgcugggcaccugcaccccgcagcagaccuccugagggccgaagguuuagacacucaagcugcccaccgucagggugcauugggacggaaaucuuuuacaagccaaacccaggccuugcugccuccuaagaaagguuaccgugaacaccauauccccugcauguuaacaggcucagagacgggcaggaacuugcuucaggucaugcagcugggaagggcaggacuaggccgugaaaugaagcccacugggcuccuccuacccacaaggcugccccaggccugugcacaaguaccauggccguggcugaagggccgggcagcacugaggcuggacuuugagucuuucccuguggagauggcaugguacugcaggguagaaggccuuccuaauagcuguggguggcgagccacauccccagcggcuugggucaccaauugggaaaggguugccuggcuuagggggcccaggaguuggggccccgucuuggcugcuuacagaagcgguaccuuccuuuuguacucucagccugcuuccagccagcagggcagggcggccgggcagggacagggccucaccuuggucaauuucugugacauagcacuccuccagggcuccugaggggcugugcaccuuggcaucgaucgcccccuuggccccguucaggcugacugcaaaagaggcuggcugguugaccuuuagcccugacuccuggaagcacagcagacaugguuagaugggggugcuugagccagggcaagggaggacggaaaggccccaggagcaagaggcccgcgggucgcacuuacccaucuggcguccaacuugguuuaaagagggagagccacugauuugcaaggggcagcaagccacaggcgcacauccccgccccugcccccacacucugccgucgcacacacccagguggcaggaagggagggcugccccacccugugggcagcacccagccuuggcaggcugucccucuuuaaaccgcagcccuggugcucaaggggcacaggcuucuguucaaagccuuuagaccugagacacgagaaaaacuccacguggugggcaggauauuuccugccgaccccaagcgugggcugcacccggccagagcagaggccuggaacccagagcugggccaggggggucacugaacacagggccaaggccuggucucugcgguggcucuggucuguccgggcccaggagccccaggugggcgguuucucucggugccucaccugaaggcuagaaacagugaggcggcgggcgucgccagacggagaagccacaggcaccacgaaggggcugucgggaauguguuccucguugaacuugacugagacuucguagucaccugggcagggaaagaguguaagaccggcucaucagccuuugggccucccaccucccacgaacagccuggguggcccugugaccucaaagugaagagugagugccaggcagggcuaucugugccagcccuggguccaauacccacacucaggccccaccuccuccaaccccagccggguucccaguaccuggcuccuggaccacauaagccacaccacaggagccguccuugcgguccucaaaagagaucucagccuugcuggggcccucgacagcaauggccaggccuccagcaccagcuucccggguccagauacugaauucggcugugggagaacaguuuguccucacugaaggcugcuucaccagccucggcccccuccaggcauagccaagguagacaugccugccggcucuuuccuccacccccaaccccacccuggccaacgcaggagagcgagcacucggggugugagcaggccuaccuggcacuccagcuucagcucucuccaggccagggcccccagcucggaccuugugggcucccccuuccccuaggggccccacggugaacuggaaggggcucccaggcacgugcuggcccuuguacuucacgcugacugugugugugcccaucucagcgggaacaaagcggaugcaguaggugugguucuccccuuccacgaucucggccucaugggucuugcccgaugggcuggucaccugggcugucauauccuggaugcuaauuucugcaggguggggaugggcuagugagcagcagcccugggcuccaccccuccucuuggggcugcuugagccccaggaccccuccccaggcuucccacagccccuaccagggauuuucaggcugaggucacaaugacuaccaacguuggccacugaaggagcccgacgccugcgggugaugcucucuuucacccggcccucgccugucaccuucacagagaaggggcugccugcaggaagaaagcacggcccacgccccuccagucacauacugccugugggcccugguguagugaggggggcugccgaggcacugcugcacucaccaggcacgugcuggucggcaaacuugauguugaugauguaguugccuggcucuguggggcaguaggugacccugcacgucccguccuccagguccucuguguugauguccaccuugcuggggcccucaauggacaggcugagcccaccauagccuaggggauggauaccccugagccucggugcuaugcacagugcucccgccccagcuggugggcagccacugccuaccugcaucgcggguaucaaugauaaacucugcaggcucaaagguguggccuucgugaaggcccugaccagagacccgaacacgacuggcauccccaauuuccgacuggcugaucaccaccgggauggggcugcuggccacgugcuggccauuuuucuucacaugcaccaggugcucccccgucuccuugggcacgaaugaaaucccuggacacagggcauggcugucagucagggagggcauggcuccccacaggcugccuccuuucugaacccccuggacccuucagccgcuuacccacguggccauuacgcagccgcuucagcaaacagggcuccucccggcccgagggcgggaccacaguggccgucagcaggcugagauccgucucugagauguugauggggaugucggcagcagagccgaccuuuaggugggacauacgcauggagucgucaccugguggggacaggccagccaucagugugcguccagccaugggagaccaugcccacccugccacccguuucugucacugcucccagugccacccaccugugacccgagcagugaaggggcugccugggacgugcuguucauuguacuugacuagaaugcuguagucccccggcagcacaggcagguaggacacgcugcaugucccauccugguugucagugcagcugauuucugcuuuggacgggcccucaauggccagagacaggcccccuggagagagccgugggugagcaugggaacuaugcuggggacacuccaguuggccugcacugaggagcuccgauggccagggcagcagggcagggagccccauucaggaguaucuccugaguccagcccuuaccccggugagggcaucccgggcacagagcaggucaagaccagagcuauugcucacccucuccugcauccuugguguugacggugaagguggcaggcuuguucacuacuccaugggugaggccaggcccauaggcagugacauggccacaguugacguaauccacauagaacugcaaggggcuuccugaggcaggaagaagggccuuguggaauggcagccucgugugucccccagccccaucucucugugaggugguggcgguggagugggcagaggcagggcaggcccaccugggaugugcauguugucauagcggauguccaucucgugcaggccagccucgcugggugcauaccgcacggucacggugccgucuuuguugucagugauggugggcugcgccaccuugccugagggcauccgaaccuccccuguggggcaguggggcugaggucagggcagcucauuggcacagucuggccuccuuggcucccgagcuccuucccaaguccccacucaccugugaucucgcccuucuugauggugaaggggaugacaaggucaaagggccucaggcuggucacauccagcccauugacacccaccaggggccucuccggggccugcaguggagacacagggcaugggugagggacagugggaggaucuggggucccuccucacacaugguaaacuaggggcucacagaacacccagcuggcuagccccagugucccuagcuggccaggccguacccaagucugcuggccgcccugggcguagguguacuguggggccagcugcugagaccguagagggggcugcaccgagggcugguccccagccagagccugcagggcaaagcagagagcugcuggagagucuguugucacagaggggccccaggggaacaggccgggaccugccagacaccccugcugaccuaccccccaccccuccucaccgucacuuggaaggggcuguugggcacgugcucgccaccaaagcgcacacagaugacguauuugcccggcuggggggccguguagaagaugucgaaagugccguccucauucuccaccacguccacauccaccucugagccaucaggcgugcacacggugcacgucacuuugccuuugccugccgccuuaguguccacagugaucaccgucuccuccccaaucugaaugguggggccgaugccagcaccugguggggcaggguggguccccaaaggggggccagcgugugagcucggguucagguuguucccguccgccugccgcccacacaggccucucauugccaccaccaagcacagccaggccgccaggccuccugccccgcccugccccuccaagcugggauggcgagugguuucucagaaggcaggaagguuucuccugaccaccucaagugcccaugugggagaggcccgacaguagcacccaggugccugggaggaaaaggaagggcccacuccagccuaaguguugacagccacucccuugccuacucagccucguccagcaccauggcccacacugcugaacgccagcaucuggcugggcacacggcugccugcgcccuucuggccuggccccggcccccauugcuguguguggacgcggugaggcggaguccugcugcagcguggggggaugugacacuugccuccccaccccccaggccugauggugaaaccggaguuuccugacaacugagaaggcucgcggugaaaagcagcccggugcagacaggagugggagcggggaagcgggaggcagcgggguuagcacccgaguagcgcagcgcagcaggcuuggcagagcggggauagcacccagggagacagggaacaggaggcccaagcuacagccaccacugcuggguugcgagggcagagcagcugagcaggcuccagggccccagagugcccgaggaaaggggagagacagugacguuaugaucugggucuccgccguggaggcuuggggggcugugggcugugaggccuggcagugagagugcccccugcagccuggccuccugccagggaagcagccaggagcacgaaaccuacuugaaggccaagcucgaggggcccugccaccaagucccacuaucggccgagggcuccugcugcacuaggcuccaugcuggccugccgcggccaggcagcucucccaggcuccagaccuggcugccggcugcccacgcugcccugggaggcuucacucaugugcaccccaugccaucuaguuaguggcuugggccccaaccucacagguacccgacugcccccacuuucccugcccggcucccagccaaccgcaggucucagccacuccauccucaaaguaugccuccuaauuuggcucucacugaagccccguggccgucaagcuugccagagagcaacuucagcgcccccuuccccaccccgggcucccugucuccauucugcaaacaguagccagggaaacugagguuacugagucuugcucccacccucaaagcccccaaggcccugcaaucaguacuccccagccucccccgcccugcgcacacacgccugucacacacacaucggauccuacggccugcucuauaaagccaucucgcuccugccgcaaaacucuagccacccucucacccuuuccuuagccaccucgcccaagugccaggccuguagccucucaucagcaucccugggugucccuggcuggggcaggugacccuccaugccuguuggggaaugucugaauaacgucacugcugggggauaggggaagggggaaggagggagacgggccacagaaugcacuuuggggcucugaggcugggccgggccccgccaugcuggccgcccaagcagucgacacuggcgcuacugcacuaccagccagccccacccgcucaugcaccucccccggcccgggacgcagaggccccuggaagguggggaugggggucuguggaucuggccagggcuggggcucccauugaguuggggagaccccuuguucccucagcccacgcaggagcccuugugccucccugggugccaagaucccgagaccccaaaguccccaguggggugccucucaggaugcaccucaccccaaagcucucagcugcaacccgaguucucagauggggaaauaaaggcccagagaggggaagagcuggagcggucaugcucagcuccggaagccucccugggcccucgcccuccagcccacggccucaucuucugcaccccacccaacucugucccugccuagagcugcagcuggaacuguccugggaaucggccccaagaggaaaggaagcugccccucugggcaggaggggcauugggaguggccccagcaagcagcuuaccuagcccgugaccuccgauugacacugaggugagagggcagagagcaaggagaaaggucaggugagucacucaagggggcggcccccacucccacacgccgccccaagcagcgagcccuugcacacaggcacaacccaagccccgugccgagcgccgcagcggccaacagcgggcgggcucaccugugacagugcacuugcuggcguccccggugggcacggcacgcacgcgguacggggagaaggggaucucgucaccaccguacuugaugaggaugguguagcgaccugucacgucuggcacguaggccacuguauacgugccgucaugguugucuuggaugugugucuucuucggcuugccuucgggauccuguguggcagaggcaggggaggcaguuggcccaagcccgaguagccccgggccugccucaggcgcucccagagugcccagcgcugcugcuacagggacagucucugggccucaggcaucuuaacugcuauggcccaaaagggcugccugcaccuggcagaguccagaauggagacuaaaacaucccacacuucccacaugacaacaggcgcggccagccagcuuggcacccauccucagccccagggccuggccagcacuaggaggagcucaccggggugaucucaagcuucuauccuauaccugccccaugagaauauuacagguggggaaacugaggcacagaaggcuuuggugacgugcucaaaguuagcagcaagugcacgucuggggaagccugugccugucaccaccauccuaagguagucacaaccuuagcaaaccaaagacaggggcccuguccuucccugcccuccuuggugcagcuccgcagggagaucagacaccagccacccgcagcccacacuccagccgcccaggccccccugccuccccugccugugcccggagcucaccgugaucuggacagccagcaggcccuccccggcguccuuugcaucgauggugaacuccacgggcaggcuggcaggcacgccagugguguugagcccggggccacuggccuucaccuugcuggcaucaugaguaggcagcaccuugaccuugaaggggcugugagggauugguguugugagcagucagacagguucucagcauccagccugggccacuccccacaggcagcaggcccugccucuuaccuccgggguaccucuucaucuccauacaguacugagaugcuguagggcccuucucggcugggcacauaauugacggucugggugccaucagcguugucuaccacguccacuggcuccaccaggccuggccccagccccagggacagagcaucagcuagucuccugggccuccauuccuaccccaccacacuggacggccaggacccagccccaggccuagaccucgcuuuauccucauccacccgacccugggaauggccuugacccccucuggcacgaaagacacccaucugggugccagcugggacccuugccugccugccuuccugccacaucugcucagugaccagucccaucugcucuaccuccuccaagucccccaccuggcugcacugucaccugaggcucuuccaaaaacaccuacacacuugcaccaccucugcacucugguccucacuuugggccuccaguuuccuuucccggcccucaaacaggacacugcccuccugaccccuggcuccaggcaugcaaacacucaccuuugggcccuugcacuuugaccugcaauggggccacaccagccuugcuuguguccaccuggaaggacugagggagguuggcacgaaccaugccugggcucaggccgggcccagagcacuugaccuuggacgcaucugucacaucaugcacagggaccuugaaaggacugccugaggguuggggcaaagggauggcggcuguaugagacaggguggggacgagcagacagucccagcccugcccuggccgccaccuccucaccuggcacuugauggccaccauaggugacguugaggcuguaggugccagccucauaagggauguacucgaccgagcagcugccguccuuguuauccaugcaggacaucuuggccucggaggggcccucuacagccaggcccaggccgcccgugccagcuccccugguccaaacagacagccggucauuccugggguucccaggcccaccagccacacgggcuccugggggcucccuuaccuggucuccacagugaacuuguugggcuuguugguggugccacuuuggaugccuggcccguggacacgcacccgggaggggucgcagcccucggucacgggcaccuggaaggggcugcugggcacgggacugccgucauaggucacguccacggagugcaguccuggaggagugcaggccaggucaggaggagcccgggccaccccacccaccccgucugccagccugugggaguccccagcacgcacccuccucguaaggcguguacuccacuuuguacaugccaucgccacgguccugaacguaggucuccgucagguugccugagggguuggccacacgggccuugacgugcggcccuccggucugugucagagcccgggcguccacacugaacucagugguggccucacggaagacaccugcaaaggcacagagaggaggcuuggggcucggggguucuggucccugucccccgucacauaccccacggcagggcaacucacccuggcccucaauaccaggcccauagcacuggacaccggaaguguccaccgcagguuccaccugcagcuugcuggggaaguugggcacgggcuggccgccguacuugauggugacgguguaggccccggggcagaggggaauguagguaauggugugcgugccaucaccgugguccuggauguacaccucggccggaagccccgccuccgagcagaucucaauggucagcuccgcgcugcccgcgcucgagcaguccacuuggaauuggcccaccuccccagcgguggcccgcuccagcccggggccugagcacuugacuuuggaugcgucaaagcagggaaccacgugggccuugaauggggagccagggaugugggugucagcgaagaggauguugauguuguaguccccgggcucggugggcacguaggacacggaacaugugccauccccauuguccaagcacucgagcugcgccucacaggggcccuccaccgucaggcccaggccaccugugccggcgcccuuggugucgauggugaagcgggcgggggagcccgcacugccucccugcagccccggcccaaacgccuucaccugagggaagaaggggucaggagccaaggccacacuaugccccgaucccagaccuccugcuugacuuuccaccugccuccccuugcccuggcuuccugcccucaccaaacagggacacgggcgggcccaggcugccugccagaugggccauccaucagucauaaggacaaaaaggagggcagggcgcggucacucacgccuguaaucucagcccuuugggaggccaagguggguggaucaccugaggucaggaguuugagaacagccuggccaacauggugaaaucucgucucuacuaaaauuaccaaaauuagcugggcaugguggcgggcaccuguaaucccagcuacuugggaggcugaggcaggaguauugcuugaagccaggaggcggagggugccgugagccaauaucgcgccacugcacuccagccugggcgacagagugagacucuuucucaaaaaaaaaaaaaaaaaaaaaaaaaaaaaaaaagaaagaaaaaaaaaaaaaagaaauucuucaacccugaugacuuuuuguggguuucuauuucccuccuccccuuuacucucacuuaaacagggucaagguugacagucugucucaggaaaaaaaaaaaaaaaaaaggauuuagggcaggucuggagaagaugggguaccuuuggggcccucagagagcacaguggguucuacccuuagggccucccauaccccaauuaccuugcuaggcuuggugggggccacagcuuccagaggaaaggggcugccaggcacgggcacgccgucauaggucaccuccaccucauagggcccuuccucacggggcaggaagcgcaccacacuguugucagcccccaggccuggcuccaccuugcagggcaccgcugcacccgaggggcccacaaucuuggaugccacuuugccuugaccaccagcacccuuugauuugacugugaacuccuggucuuugccaacguccaccucuguggaaacgaugaaaggaaggagagagacaugacacccagcucagccaaucccuggaugugacaaaggccuuugcgacaagggccccaacuacuuacucucucccaggccagacaccuugaucuugcugagguccaggcuuggagauacugccacugagaaagggcucuuagggaugggauccccuccauaagugacauugacgccuacuggacccugggaagggugcagaagggaaggggguauuuagagacaccagaauugcuccccaacccccuccuggaccuccaugccuguccucucccagguaaggaaugagagugggcagaaagucccucggagcuguccccuaggcugcugcaugaggaggcuggggacucggugacuguaguggaggguguggcuaccugcuggacaggcguguacuugacuguguagguguugucaugguggucgaugauguccacaucucgcacugcaucccccuuggugaguccugagaacuggacguccagcuugccuuugccagcagcuuuggcauuuacugugaagugggugggcuugccaagcucgacaccugaggaacacacagggaccauguaggggcacccugccccaagcccuccuacccuugaugccccgcaaccugccaugggguaccuguccucaccagugcgacugaggccagggcccucggccuucaccuuacuggcgucaugagagggcuccaccuugacucggauggggcuggugggcguggccugcaggcagugggaggagaaggccuuagaggagggcagacgucauccgcaaugacaucuuagcggccaggagcgcagcacccaccuggucagcaaagaggaccauaaugguguagcugccagccccccggggcguguacuugaccgugaaggugucauugucauugcggaugaugucgaagucgaugucagcuucggcggggccuaccacuccaggggcacacuugaugccgaugcugacguccccugcggcggggagaggagcggaggcugagaccucgcagggacaccccagccaccugcccucccacccacagccaggccuuacccuggccagccucggcgcaguccacagugaaguaggugggcucgugggccuugagcccugucuuggcuacuccggggccguauacuuugaccuuguugggguggcugccagcucccacauucaccugcagggcacaggggcaagggcaagggcaugagcagccuggaggagacucagaagcucccucagcuacacuggcaggcacacaaaaugguccagcugccuugggaagagucuggcaguuccucaguugaccacagagggacugugugaugcuccgguucacuccgaggcaacuacccaagagaaaugaaagcaaauguccacgcaaacaccuggacucacuguuaacagcacuguucaugaucaccaaaggcaagcucauccucaauaucuguuagcaagugaacggaaaaauggaauguggucuggccacacaauggaguauuaugcggccauaaaaauaaaugaagcggccggacgugguggcucaugccuguaaucccagcacuuuggaaggccaaggugggcggaccaccuggggucaggcgguugagaccagucugaccaacauggagaaaccccgucucuacuaaaaauacaaaauuagcugggaaugguggcguaugccugcaaucccagcuacucaggaggcugaggcaggagagaauugcuugaaucuggcaggcagagguugcagugagcugagaucacgucauugcacuccagccuggcaauaagagcaaaacuccggcucaaaaaaaaaaaaccaggaugggcgcgguggcucaugccugucaucccagcacuuugggaggccgaggugggcagaucacaaggucaggagaucgacaccauccuggcuaacacagugaaaccuugucucuacuaaaaauacaaaaaauuagccggggggguggcgggcgccuguagucccagcuacccgggaggcugaggcaagacaauggugugaaccugggagaaagagccugcagugagccgagaucgcgccauugcacuccagccugggcgacagugugagacuccaucucaaauaaauaaauaaauaaacaaaauaauuauaaaggaacaaagugccaagacaugccaaacaugaacgaaaacacggaaaacuucguggugagcgaaagaagccagacacaaaaggccacauggcacacaguuccaucuauagaacauguccaggauaggcaaagccacagcagaaagcagguuaguggucaccaggagcugugggacaggggagucaggauggugugccacaaccacuugaaauggacgaaucgugugcuacgugaaugcuaucgagauggacuaaaggccgguggagguuggcucacccugaaggggcuguuggggaugcugacgccuccccaggacaccauggcugugugcuucaccggcuuccugggcacguaggagcagcuguaagugccauugccguuguccuugaccaacgccuccacagggcagccuucauuguccugucaggcagauaggagcagguggccugcuggucagugcccaggccugggugcccacaccugcccugcccccaacacccgugggugcucuaccuggacuuggacccgaaguggggccuugccaccgugcuuggcauccacugugaacucugcuggcuuguugacggccacaccugucuucuccaauccaggcccacgugccuucaccuagcgggagaccacccagcugucagggggccagguccaggcugccagagcuacaacccaggcaggguggccagggacacagagugccauccccaccagaccccaagcaggagcagcagggcgagacuuaggccaucacagccugcucuuuacccugucuggguggaaguccuggggcgcgucacggaugucagccaugaaggggcugaggcggaugucuucgcuguugcacagcacgugaacggcauacucgccagccuccugcggccaguagcgcacaucacaggagccgucgcccuugucgucacauucgaucuuagccugcgauggcccuuccaccgagaagccugacaacagccaccaguccccucagugcccuggagccucagggugggccguccuugccaucgucuguccccaggugcccaugcugcagccuccaacuuacccagcgugcccacgucguccccgauagccuccaccacaaagucugcugacuugccaacgacgccgcccuccagcccagggccccaggcccguaccuucugauugccacacucggugcccaccuucacuucgaagggacugcaaaugcgagagccacacagggaacaccgaggaucaccacaugagccagcgugggccccacuguggcggccaggcaggaagagcccauguggccccucaucaucagguggggaggcagaaggaagagaagaggcagagugugcagagcugggagagggaugccugggggccucaccugcgcccgauguucugaccaccccacgugauggugacgauauagguuccagggaccaugggguaauacucgaagccauacacgccaucccccagguccuucugcuucacgcgcuccucucccucugccaagacaaggagggccucaggccugcccagcagugaacccgggggcugccgccacccauccuggccuggcuccaggccaacuuacuggggcccuucacggugaccuucagcuccccacugccagcgcccuuuguguacaccuugaagucagcugucuccuucacccgcacacccuugggcuggaggccccggccaaccgcccggcaggcacucggguuacaggcugcaggcagaggggccagcugagcaccagcagcucggcugggcgaccccucccuugccucccacagggccgggcugucaggauuggugggucccucagagcuuggcuggagggggacaugcaagacagaacuggaagggacugugaccccaggaacuguggccugggccaggacauggcaggccuccucccaccugcuccacaccagcccagagccccccagccucccccuuccaagaagaagacagauccaaguaccguugacccugugggcagagcagagagcagcagguuucuagacagcuggagcgagcucuuccgaaggugaaagcgugaggagagagauggagaggggcgaggagaggagaggaggaagggccccagcaggggaggaaaaacagcaugugcccagacaguagaagcucaaagaguaggggccccggggcgggcugcagcgggacuggcccagggggucccccuccugugggaggcccagacugcagugccacagcagagggcagucagggccgggccuaccuuggccaacagugacaguguaggggcugcgagggaugggcacgccggcaaacgugacgugcacgguguggacgcccuccauggugggcugguagcugcagcgguaugugcugucgccccgggccuccagcugaggcucuaccgugcccuucugucccaugggguccuggaucacaaccucgaccucgcccgugccagcuccugccacgaggcaccugcucagcucccaggccccagugcggcucuccccacagaccagcugggccuuggcagccuccccucaccugccguaaagaucucaaaguagguggucuuguuggcgauguugccacugggcuccaggccgggaccuugggcugucacuuugcuggcgucacccugugacuuauccacguacaccucgaaggggcucuuggcgaugugcuggccagcaaagagcacaguaaccuguccccagaagggugggccgugaggguagggcugggggccuccagccacugccugaggucacaagccuccccccuggccaagggcucaccuuaugaguccccgucaccucggggacguaccagacggagaaggugcgguucuugucguuauuggcggucacuuuugccugcagugggaaggagccugugagccuuugcuaagagcagccccacugaaagggagcgcugcggggccucugcugccagcagcuggcccuaccuccuccugguguccggccggguccuccacguacaccagcaccucucccuggccagcacuucuggucuccacagugaacucugcccgcuucuucaccauguugccugugggcucgaugccuggcaggggaaggcgagccaaccacgggccagcuguuaaggccacagccucaccccuccacccuucagcccucccugcuggccccuaagucaggcacauuccaaacugggcaaguucauucagugugagcuguggcacagagccuggccucgggacccagcugugcucucgcugcugggacaggcccagccuguuuucuggaacauucauucucaccgcacugggcccuuguuccugugugagccuugacuggguuuuaggucccuguuacugagaccugguucaucuccauuuauaauaaagaccgcuggaugcuaccuccccgaggaccccacgcagcaggcuucugugacuggaggaaccuauuagcauucucuugucguuuucacuagucccaaaaacccacucuugucugacucuuggguggcuugaucaccuagccgccauguaacccaagaccccuggggaccgccacguuuagaugggacacugucuuauggggaagacguuggcacacgggugcaccccugguggggcucccucaccuggcccguaggcacgggcuuucuucggguucaguuugggccgcaagggagccccuggcuucagcuuggccuuggggaacugggacagguaggucaugacagagugcucguccacguugggguccacaaucuccucgggggugaucaccugucacaggcagaaaacaggagccaucgggccuccgagucucucccaacugccgauccgguccccuacagcuguagccaggccgggcggguguaccugggggaugcccagccagucauccgccugcugcauggccucucgcgcauugguaacgggcuugcuggcgucccaagagucccagucaggacacaggccuguggcgcaagggaggcugugagucugggggccgcagaacccccucaagggccacccaugggugaccccagcccagucucuccugccucugcgcccccucacccggggcacagcuguccaccagggcgcccagggcccggccgcucugccagucccggcugaaguuggugaugggcagcugcggcagcuuguucuggauccagcccaggagccucugcuugggggucugcuucuuggccuccucauccuccuccucgucccacaugggcauggagauggaguagugcaggaucaggguccagaugaggcccaggaucagcuucagguucccguccacgauggccuugcugucugugaguagaagaguggccacgcugggcacacggcugugcgggaggggccgaucccaggcuuuggggucagggucuggcagcacgggguagcaggggccaaggaggagguagacacccccucuuggccagugguaggauguggaugaggcccucucugcccagggucccaggggguguucagaggugaaggagacuuuggggugagggcagauacacacagacacacacacacgaugccagcaggguaugauuacugccagaagcccugggcccagaggaagggcagagggcagacccagccugcagaugggcagcucuggagaacagcuggacaguguccacagcugccagagcagggguccgccacacaccucaggggccuauggggaaccaggaggaggaggcugacuccagcuggcccagaauccagggcccaugaccuggaguggggcuggggcugaggaagaggaagguggguggcccugggugguugggaaauacaacuguuguuccaggguggguggggugaggcaggggaagugggggaguugggcaaacgcccuuugggugagggauugugacccccgccaccacccccacuuccucuaccaccucgaagacucaagcuuggaguugggaggccacaggccuagccaggggaggggcccagagcccaaaggaaccagcaguugggccacauggcccugacucacuggggcccaucgggagaugccgggguggcagcaggagacacugggaacccccuugccacccacugccugacccacuugccaccuaacgggccucugggccucggcaggcucgccacaggggaagugguuagggcgggucccugacaccccccaucaccauggcaacccugcugggcucugggccccacccaaggcuacuucugggucucaggcucaaggcaggauggcucaucuuuagaagcccugucagccucccccauaaucagacaaaauacuucucuggugagucaacuagggggcgggccuaugaggaggggcugggcuguccauggcagcugcuucccagcccagcaggcagcaccuggagggccaggugagccgcucagaguggccuccccaguucccagguugguccuggccccacgaggcugccuuucacucuccccaaauggcagcagggagggggacucggagaggaccaagggugcagggccagggaacaaggccagccagggcuucccaucaggcccccaccccaguccagccucagaccccucaacgacccccacacggggagcaaccaggcccaccagguccauguuaggccagccuacuccguccccaucccccucccaaaagagagagggaaggaccagggcccagggcugggagacugucuggcuggauggccccgccccaucccaccccccuuuccccagccccugggccagccaaccccucccuccccuaaucacugcugcuuuccaacauuuuuuugccuuauauggcaaagcucugggaacuaggccugcuccagccagcucacaaggaggaggggagcugggaggagggaggagacccccccuaaagagcugggguguggcccgccuccccacauccggucgcccccccuaccauccaggacugagaugacucagcuuggcuagacugaggcugggacuugugggggugggccugccccucgccucaacuggcauuccaaagaaagaacuuugguucuugggaucugcccucugaguggcugggggaacccaagucuuggucccucacuuucuuggguucagcaagggccauuccagggcugcaggguaacuggaaggccucucaauucugaagaagagaagacucaucaucccucuccucucccuguuccacaucacccccgagucacccauucuggggccugcccucucaugcagccccuaucuugagaacgaauugggcugcugcagcaggccuggucaaugccagccucuccaguccagugacacagacacugggcuggcacaaugcacgcuggagcaucuaccaaccaacuccugcgugcuacacgcagaaaagcaaggccuacauggaagcaagaguuuggcccaagaugaagagaaaaguuggcguccaaguagucuacaagccaggucucucagucaaccacgcccaacucaccccgggugcaguuuugcuaacuaugcuucuuucuggcccccagguugccuguguguguguggggggguagaucuaaacuggugguuggagccaucuccgaugggcgacccauccuccagggacacaaagagcccagagccccagacaaugggacgcacgagcuccaacccacacuucagaaccaacgggccucugaaggccagagggcccucucuaaacagcuguggggggagagcccgggccuccuccuccucggggacggggcgcagggccaggagccugcccagugcccgaccccccaggcccacucccaccgcgagcacagccgcggaggcgcggccugcggaggaugugaguucagccugggcgccggccagccggggcgcagcgggcgggggcgcguagcgguucgcacgcccggccggccagccagccagcccgcgcgccuuuguucugcaggcccgcguggagcagagcagccggaggccucgggaguugcgcugcggcccggaagggggugguuuggagggguccgcccggggagauggaaggacgcacggaguccccgcccccgcccgcccggcgcuucggggcgucccucaccgauggacaccaguuugaugcucucgcgguccaggaacucgagcgccaccgacacguucucaagcugcauuuggcggaaagugggccgcugguugugcuugcggugcaucuucuucuggcugagcaccuccaacagcgcgauaagccgcagcccgucgcucagguccgucugcagguuggcgaugcgcuugcucacgcacuucaggugcucguugcaccagcgcgugaaaguguucugcuggaucuucuuccacggcgcguccuccgccagguccuucucgguggccggcaucucggcgucccgcgugucgacgccgccgcccggagccgcgccugcugcgcucuggcccgcccgagagugggagcuacucauuuugaggcgcgagaagccgggggggcggugcugcagccucggcgaggggacggcccuuuaauuaaagucgcaggcaccuaggcgcgcgggaggcgaggc

SEQ ID NO: 21573 - RNA, 22828 nt, Homo sapiens
gccucgccucccgcgcgccuaggugccugcgacuuuaauuaaagggccguccccucgccgaggcugcagcaccgcccccccggcuucucgcgccucaaaaugaguagcucccacucucgggcgggccagagcgcagcaggcgcggcuccgggcggcggcgucgacacgcgggacgccgagaugccggccaccgagaaggaccuggcggaggacgcgccguggaagaagauccagcagaacacuuucacgcgcuggugcaacgagcaccugaagugcgugagcaagcgcaucgccaaccugcagacggaccugagcgacgggcugcggcuuaucgcgcuguuggaggugcucagccagaagaagaugcaccgcaagcacaaccagcggcccacuuuccgccaaaugcagcuugagaacgugucgguggcgcucgaguuccuggaccgcgagagcaucaaacugguguccaucggugagggacgccccgaagcgccgggcgggcgggggcggggacuccgugcguccuuccaucuccccgggcggaccccuccaaaccacccccuuccgggccgcagcgcaacucccgaggccuccggcugcucugcuccacgcgggccugcagaacaaaggcgcgcgggcuggcuggcuggccggccgggcgugcgaaccgcuacgcgcccccgcccgcugcgccccggcuggccggcgcccaggcugaacucacauccuccgcaggccgcgccuccgcggcugugcucgcggugggagugggccuggggggucgggcacugggcaggcuccuggcccugcgccccguccccgaggaggaggaggcccgggcucuccccccacagcuguuuagagagggcccucuggccuucagaggcccguugguucugaaguguggguuggagcucgugcgucccauugucuggggcucugggcucuuugugucccuggaggaugggucgcccaucggagauggcuccaaccaccaguuuagaucuacccccccacacacacacaggcaaccugggggccagaaagaagcauaguuagcaaaacugcacccggggugaguugggcgugguugacugagagaccuggcuuguagacuacuuggacgccaacuuuucucuucaucuugggccaaacucuugcuuccauguaggccuugcuuuucugcguguagcacgcaggaguugguugguagaugcuccagcgugcauugugccagcccagugucugugucacuggacuggagaggcuggcauugaccaggccugcugcagcagcccaauucguucucaagauaggggcugcaugagagggcaggccccagaaugggugacucgggggugauguggaacagggagaggagagggaugaugagucuucucuucuucagaauugagaggccuuccaguuacccugcagcccuggaauggcccuugcugaacccaagaaagugagggaccaagacuuggguucccccagccacucagagggcagaucccaagaaccaaaguucuuucuuuggaaugccaguugaggcgaggggcaggcccacccccacaagucccagccucagucuagccaagcugagucaucucaguccuggaugguagggggggcgaccggauguggggaggcgggccacaccccagcucuuuagggggggucuccucccuccucccagcuccccuccuccuugugagcuggcuggagcaggccuaguucccagagcuuugccauauaaggcaaaaaaauguuggaaagcagcagugauuaggggagggagggguuggcuggcccaggggcuggggaaaggggggugggauggggcggggccauccagccagacagucucccagcccugggcccugguccuucccucucucuuuugggagggggauggggacggaguaggcuggccuaacauggaccuggugggccugguugcuccccgugugggggucguugaggggucugaggcuggacuggggugggggccugaugggaagcccuggcuggccuuguucccuggcccugcacccuugguccucuccgagucccccucccugcugccauuuggggagagugaaaggcagccucguggggccaggaccaaccugggaacuggggaggccacucugagcggcucaccuggcccuccaggugcugccugcugggcugggaagcagcugccauggacagcccagccccuccucauaggcccgcccccuaguugacucaccagagaaguauuuugucugauuaugggggaggcugacagggcuucuaaagaugagccauccugccuugagccugagacccagaaguagccuuggguggggcccagagcccagcaggguugccauggugauggggggugucagggacccgcccuaaccacuuccccuguggcgagccugccgaggcccagaggcccguuagguggcaagugggucaggcaguggguggcaaggggguucccagugucuccugcugccaccccggcaucucccgaugggccccagugagucagggccauguggcccaacugcugguuccuuugggcucugggccccuccccuggcuaggccuguggccucccaacuccaagcuugagucuucgaggugguagaggaagugggggugguggcgggggucacaaucccucacccaaagggcguuugcccaacucccccacuuccccugccucaccccacccacccuggaacaacaguuguauuucccaaccacccagggccacccaccuuccucuuccucagccccagccccacuccaggucaugggcccuggauucugggccagcuggagucagccuccuccuccugguuccccauaggccccugagguguguggcggaccccugcucuggcagcuguggacacuguccagcuguucuccagagcugcccaucugcaggcugggucugcccucugcccuuccucugggcccagggcuucuggcaguaaucauacccugcuggcaucgugugugugugucuguguguaucugcccucaccccaaagucuccuucaccucugaacacccccugggacccugggcagagagggccucauccacauccuaccacuggccaagagggggugucuaccuccuccuuggccccugcuaccccgugcugccagacccugaccccaaagccugggaucggccccucccgcacagccgugugcccagcguggccacucuucuacucacagacagcaaggccaucguggacgggaaccugaagcugauccugggccucaucuggacccugauccugcacuacuccaucuccaugcccaugugggacgaggaggaggaugaggaggccaagaagcagacccccaagcagaggcuccugggcuggauccagaacaagcugccgcagcugcccaucaccaacuucagccgggacuggcagagcggccgggcccugggcgcccugguggacagcugugccccgggugagggggcgcagaggcaggagagacugggcuggggucacccauggguggcccuugaggggguucugcggcccccagacucacagccucccuugcgccacaggccuguguccugacugggacucuugggacgccagcaagcccguuaccaaugcgcgagaggccaugcagcaggcggaugacuggcugggcaucccccagguacacccgcccggccuggcuacagcuguaggggaccggaucggcaguugggagagacucggaggcccgauggcuccuguuuucugccugugacaggugaucacccccgaggagauuguggaccccaacguggacgagcacucugucaugaccuaccugucccaguuccccaaggccaagcugaagccaggggcucccuugcggcccaaacugaacccgaagaaagcccgugccuacgggccaggugagggagccccaccaggggugcacccgugugccaacgucuuccccauaagacagugucccaucuaaacguggcgguccccaggggucuuggguuacauggcggcuaggugaucaagccacccaagagucagacaagaguggguuuuugggacuagugaaaacgacaagagaaugcuaauagguuccuccagucacagaagccugcugcgugggguccucggggagguagcauccagcggucuuuauuauaaauggagaugaaccaggucucaguaacagggaccuaaaacccagucaaggcucacacaggaacaagggcccagugcggugagaaugaauguuccagaaaacaggcugggccugucccagcagcgagagcacagcugggucccgaggccaggcucugugccacagcucacacugaaugaacuugcccaguuuggaaugugccugacuuaggggccagcagggagggcugaaggguggaggggugaggcuguggccuuaacagcuggcccgugguuggcucgccuuccccugccaggcaucgagcccacaggcaacauggugaagaagcgggcagaguucacuguggagaccagaagugcuggccagggagaggugcugguguacguggaggacccggccggacaccaggaggagguagggccagcugcuggcagcagaggccccgcagcgcucccuuucaguggggcugcucuuagcaaaggcucacaggcuccuucccacugcaggcaaaagugaccgccaauaacgacaagaaccgcaccuucuccgucugguacguccccgaggugacggggacucauaaggugagcccuuggccaggggggaggcuugugaccucaggcaguggcuggaggcccccagcccuacccucacggcccacccuucuggggacagguuacugugcucuuugcuggccagcacaucgccaagagccccuucgagguguacguggauaagucacagggugacgccagcaaagugacagcccaaggucccggccuggagcccaguggcaacaucgccaacaagaccaccuacuuugagaucuuuacggcaggugaggggaggcugccaaggcccagcuggucuguggggagagccgcacuggggccugggagcugagcaggugccucguggcaggagcuggcacgggcgaggucgagguugugauccaggaccccaugggacagaagggcacgguagagccucagcuggaggcccggggcgacagcacauaccgcugcagcuaccagcccaccauggagggcguccacaccgugcacgucacguuugccggcgugcccaucccucgcagccccuacacugucacuguuggccaagguaggcccggcccugacugcccucugcuguggcacugcagucugggccucccacaggagggggacccccugggccagucccgcugcagcccgccccggggccccuacucuuugagcuucuacugucugggcacaugcuguuuuuccuccccugcuggggcccuuccuccucuccucuccucgccccucuccaucucucuccucacgcuuucaccuucggaagagcucgcuccagcugucuagaaaccugcugcucucugcucugcccacagggucaacgguacuuggaucugucuucuucuuggaagggggaggcuggggggcucugggcugguguggagcaggugggaggaggccugccauguccuggcccaggccacaguuccuggggucacagucccuuccaguucugucuugcaugucccccuccagccaagcucugagggacccaccaauccugacagcccggcccugugggaggcaagggaggggucgcccagccgagcugcuggugcucagcuggccccucugccugcagccuguaacccgagugccugccgggcgguuggccggggccuccagcccaagggugugcgggugaaggagacagcugacuucaagguguacacaaagggcgcuggcaguggggagcugaaggucaccgugaagggccccaguaaguuggccuggagccaggccaggauggguggcggcagcccccggguucacugcugggcaggccugaggcccuccuugucuuggcagagggagaggagcgcgugaagcagaaggaccugggggauggcguguauggcuucgaguauuaccccauggucccuggaaccuauaucgucaccaucacgugggguggucagaacaucgggcgcaggugaggcccccaggcaucccucucccagcucugcacacucugccucuucucuuccuucugccuccccaccugaugaugaggggccacaugggcucuuccugccuggccgccacaguggggcccacgcuggcucauguggugauccucgguguucccuguguggcucucgcauuugcagucccuucgaagugaaggugggcaccgaguguggcaaucagaagguacgggccuggggcccugggcuggagggcggcgucguuggcaagucagcagacuuugugguggaggcuaucggggacgacgugggcacgcuggguaaguuggaggcugcagcaugggcaccuggggacagacgauggcaaggacggcccacccugaggcuccagggcacugaggggacugguggcuguugucaggcuucucgguggaagggccaucgcaggcuaagaucgaaugugacgacaagggcgacggcuccugugaugugcgcuacuggccgcaggaggcuggcgaguaugccguucacgugcugugcaacagcgaagacauccgccucagccccuucauggcugacauccgugacgcgccccaggacuuccacccagacaggguaaagagcaggcugugauggccuaagucucgcccugcugcuccugcuuggggucugguggggauggcacucugugucccuggccacccugccuggguuguagcucuggcagccuggaccuggcccccugacagcuggguggucucccgcuaggugaaggcacgugggccuggauuggagaagacagguguggccgucaacaagccagcagaguucacaguggaugccaagcacgguggcaaggccccacuucggguccaaguccagguagagcacccacggguguugggggcagggcaggugugggcacccaggccugggcacugaccagcaggccaccugcuccuaucugccugacaggacaaugaaggcugcccuguggaggcguuggucaaggacaacggcaauggcacuuacagcugcuccuacgugcccaggaagccggugaagcacacagccaugguguccuggggaggcgucagcauccccaacagccccuucagggugagccaaccuccaccggccuuuaguccaucucgauagcauucacguagcacacgauucguccauuucaagugguuguggcacaccauccugacuccccugucccacagcuccuggugaccacuaaccugcuuucugcuguggcuuugccuauccuggacauguucuauagauggaacugugugccauguggccuuuugugucuggcuucuuucgcucaccacgaaguuuuccguguuuucguucauguuuggcaugucuuggcacuuuguuccuuuauaauuauuuuguuuauuuauuuauuuauuugagauggagucucacacugucgcccaggcuggagugcaauggcgcgaucucggcucacugcaggcucuuucucccagguucacaccauugucuugccucagccucccggguagcugggacuacaggcgcccgccacccccccggcuaauuuuuuguauuuuuaguagagacaagguuucacuguguuagccaggauggugucgaucuccugaccuugugaucugcccaccucggccucccaaagugcugggaugacaggcaugagccaccgcgcccauccugguuuuuuuuuuuugagccggaguuuugcucuuauugccaggcuggagugcaaugacgugaucucagcucacugcaaccucugccugccagauucaagcaauucucuccugccucagccuccugaguagcugggauugcaggcauacgccaccauucccagcuaauuuuguauuuuuaguagagacgggguuucuccauguuggucagacuggucucaaccgccugaccccaggugguccgcccaccuuggccuuccaaagugcugggauuacaggcaugagccaccacguccggccgcuucauuuauuuuuauggccgcauaauacuccauuguguggccagaccacauuccauuuuuccguucacuugcuaacagauauugaggaugagcuugccuuuggugaucaugaacagugcuguuaacagugaguccagguguuugcguggacauuugcuuucauuucucuuggguaguugccucggagugaaccggagcaucacacagucccucuguggucaacugaggaacugccagacucuucccaaggcagcuggaccauuuugugugccugccaguguagcugagggagcuucugagucuccuccaggcugcucaugcccuugcccuugccccugugcccugcaggugaaugugggagcuggcagccaccccaacaaggucaaaguauacggccccggaguagccaagacagggcucaaggcccacgagcccaccuacuucacuguggacugcgccgaggcuggccaggguaaggccuggcugugggugggagggcagguggcuggggugucccugcgaggucucagccuccgcuccucuccccgccgcaggggacgucagcaucggcaucaagugugccccuggagugguaggccccgccgaagcugacaucgacuucgacaucauccgcaaugacaaugacaccuucacggucaaguacacgccccggggggcuggcagcuacaccauuaugguccucuuugcugaccaggugggugcugcgcuccuggccgcuaagaugucauugcggaugacgucugcccuccucuaaggccuucuccucccacugccugcaggccacgcccaccagccccauccgagucaagguggagcccucucaugacgccaguaaggugaaggccgagggcccuggccucagucgcacuggugaggacagguaccccauggcagguugcggggcaucaaggguaggagggcuuggggcagggugccccuacauggucccuguguguuccucaggugucgagcuuggcaagcccacccacuucacaguaaaugccaaagcugcuggcaaaggcaagcuggacguccaguucucaggacucaccaagggggaugcagugcgagauguggacaucaucgaccaccaugacaacaccuacacagucaaguacacgccuguccagcagguagccacacccuccacuacagucaccgaguccccagccuccucaugcagcagccuaggggacagcuccgagggacuuucugcccacucucauuccuuaccugggagaggacaggcauggagguccaggaggggguuggggagcaauucuggugucucuaaauacccccuucccuucugcacccuucccaggguccaguaggcgucaaugucacuuauggaggggaucccaucccuaagagcccuuucucaguggcaguaucuccaagccuggaccucagcaagaucaaggugucuggccugggagagaguaaguaguuggggcccuugucgcaaaggccuuugucacauccagggauuggcugagcugggugucaugucucucuccuuccuuucaucguuuccacagagguggacguuggcaaagaccaggaguucacagucaaaucaaagggugcugguggucaaggcaaaguggcauccaagauugugggccccucgggugcagcggugcccugcaagguggagccaggccugggggcugacaacaguguggugcgcuuccugccccgugaggaagggcccuaugagguggaggugaccuaugacggcgugcccgugccuggcagccccuuuccucuggaagcuguggcccccaccaagccuagcaagguaauugggguaugggaggcccuaaggguagaacccacugugcucucugagggccccaaagguaccccaucuucuccagaccugcccuaaauccuuuuuuuuuuuuuuuuuuccugagacagacugucaaccuugacccuguuuaagugagaguaaaggggaggagggaaauagaaacccacaaaaagucaucaggguugaagaauuucuuuuuuuuuuuuuucuuucuuuuuuuuuuuuuuuuuuuuuuuuuuuuuuuuugagaaagagucucacucugucgcccaggcuggagugcaguggcgcgauauuggcucacggcacccuccgccuccuggcuucaagcaauacuccugccucagccucccaaguagcugggauuacaggugcccgccaccaugcccagcuaauuuugguaauuuuaguagagacgagauuucaccauguuggccaggcuguucucaaacuccugaccucaggugauccacccaccuuggccucccaaagggcugagauuacaggcgugagugaccgcgcccugcccuccuuuuuguccuuaugacugauggauggcccaucuggcaggcagccugggcccgcccgugucccuguuuggugagggcaggaagccagggcaaggggaggcagguggaaagucaagcaggaggucugggaucggggcauaguguggccuuggcuccugaccccuucuucccucaggugaaggcguuugggccggggcugcagggaggcagugcgggcucccccgcccgcuucaccaucgacaccaagggcgccggcacagguggccugggccugacgguggagggccccugugaggcgcagcucgagugcuuggacaauggggauggcacauguuccguguccuacgugcccaccgagcccggggacuacaacaucaacauccucuucgcugacacccacaucccuggcuccccauucaaggcccacgugguucccugcuuugacgcauccaaagucaagugcucaggccccgggcuggagcgggccaccgcuggggaggugggccaauuccaaguggacugcucgagcgcgggcagcgcggagcugaccauugagaucugcucggaggcggggcuuccggccgagguguacauccaggaccacggugauggcacgcacaccauuaccuacauuccccucugccccggggccuacaccgucaccaucaaguacggcggccagcccgugcccaacuuccccagcaagcugcagguggaaccugcgguggacacuuccgguguccagugcuaugggccugguauugagggccagggugaguugcccugccgugggguaugugacgggggacagggaccagaacccccgagccccaagccuccucucugugccuuugcaggugucuuccgugaggccaccacugaguucaguguggacgcccgggcucugacacagaccggagggccgcacgucaaggcccguguggccaaccccucaggcaaccugacggagaccuacguucaggaccguggcgauggcauguacaaaguggaguacacgccuuacgaggagggugcgugcuggggacucccacaggcuggcagacggggugggugggguggcccgggcuccuccugaccuggccugcacuccuccaggacugcacuccguggacgugaccuaugacggcagucccgugcccagcagccccuuccaggugcccgugaccgagggcugcgaccccucccgggugcguguccacgggccaggcauccaaaguggcaccaccaacaagcccaacaaguucacuguggagaccagguaagggagcccccaggagcccguguggcuggugggccugggaaccccaggaaugaccggcugucuguuuggaccaggggagcuggcacgggcggccugggccuggcuguagagggccccuccgaggccaagauguccugcauggauaacaaggacggcagcugcucggucgaguacaucccuuaugaggcuggcaccuacagccucaacgucaccuaugguggccaucaagugccaggugaggagguggcggccagggcagggcugggacugucugcucguccccacccugucucauacagccgccaucccuuugccccaacccucaggcaguccuuucaaggucccugugcaugaugugacagaugcguccaaggucaagugcucugggcccggccugagcccaggcaugguucgugccaaccucccucaguccuuccagguggacacaagcaaggcugguguggccccauugcaggucaaagugcaagggcccaaaggugaguguuugcaugccuggagccaggggucaggagggcaguguccuguuugagggccgggaaaggaaacuggaggcccaaagugaggaccagagugcagagguggugcaaguguguagguguuuuuggaagagccucaggugacagugcagccaggugggggacuuggaggagguagagcagaugggacuggucacugagcagauguggcaggaaggcaggcaggcaagggucccagcuggcacccagaugggugucuuucgugccagagggggucaaggccauucccagggucggguggaugaggauaaagcgaggucuaggccuggggcuggguccuggccguccaguguggugggguaggaauggaggcccaggagacuagcugaugcucugucccuggggcuggggccaggccugguggagccaguggacgugguagacaacgcugauggcacccagaccgucaauuaugugcccagccgagaagggcccuacagcaucucaguacuguauggagaugaagagguaccccggagguaagaggcagggccugcugccuguggggaguggcccaggcuggaugcugagaaccugucugacugcucacaacaccaaucccucacagccccuucaaggucaaggugcugccuacucaugaugccagcaaggugaaggccaguggccccgggcucaacaccacuggcgugccugccagccugcccguggaguucaccaucgaugcaaaggacgccggggagggccugcuggcuguccagaucacggugagcuccgggcacaggcaggggaggcaggggggccugggcggcuggagugugggcugcggguggcuggugucugaucucccugcggagcugcaccaaggagggcagggaaggacagggccccugucuuugguuugcuaagguugugacuaccuuaggaugguggugacaggcacaggcuuccccagacgugcacuugcugcuaacuuugagcacgucaccaaagccuucugugccucaguuuccccaccuguaauauucucauggggcagguauaggauagaagcuugagaucaccccggugagcuccuccuagugcuggccaggcccuggggcugaggaugggugccaagcuggcuggccgcgccuguugucaugugggaagugugggauguuuuagucuccauucuggacucugccaggugcaggcagcccuuuugggccauagcaguuaagaugccugaggcccagagacugucccuguagcagcagcgcugggcacucugggagcgccugaggcaggcccggggcuacucgggcuugggccaacugccuccccugccucugccacacaggaucccgaaggcaagccgaagaagacacacauccaagacaaccaugacggcacguauacaguggccuacgugccagacgugacaggucgcuacaccauccucaucaaguacgguggugacgagauccccuucuccccguaccgcgugcgugccgugcccaccggggacgccagcaagugcacugucacaggugagcccgcccgcuguuggccgcugcggcgcucggcacggggcuuggguugugccugugugcaagggcucgcugcuuggggcggcgugugggagugggggccgcccccuugagugacucaccugaccuuucuccuugcucucugcccucucaccucagugucaaucggaggucacgggcuagguaagcugcuugcuggggccacucccaaugccccuccugcccagaggggcagcuuccuuuccucuuggggccgauucccaggacaguuccagcugcagcucuaggcagggacagaguuggguggggugcagaagaugaggccgugggcuggagggcgagggcccagggaggcuuccggagcugagcaugaccgcuccagcucuuccccucucugggccuuuauuuccccaucugagaacucggguugcagcugagagcuuuggggugaggugcauccugagaggcaccccacuggggacuuuggggucucgggaucuuggcacccagggaggcacaagggcuccugcgugggcugagggaacaaggggucuccccaacucaaugggagccccagcccuggccagauccacagacccccauccccaccuuccaggggccucugcgucccgggccgggggaggugcaugagcggguggggcuggcugguagugcaguagcgccagugucgacugcuugggcggccagcauggcggggcccggcccagccucagagccccaaagugcauucuguggcccgucucccuccuucccccuuccccuaucccccagcagugacguuauucagacauuccccaacaggcauggagggucaccugccccagccagggacacccagggaugcugaugagaggcuacaggccuggcacuugggcgagguggcuaaggaaagggugagaggguggcuagaguuuugcggcaggagcgagauggcuuuauagagcaggccguaggauccgaugugugugugacaggcgugugugcgcagggcgggggaggcuggggaguacugauugcagggccuugggggcuuugagggugggagcaagacucaguaaccucaguuucccuggcuacuguuugcagaauggagacagggagcccgggguggggaagggggcgcugaaguugcucucuggcaagcuugacggccacggggcuucagugagagccaaauuaggaggcauacuuugaggauggaguggcugagaccugcgguuggcugggagccgggcagggaaagugggggcagucggguaccugugagguuggggcccaagccacuaacuagauggcauggggugcacaugagugaagccucccagggcagcgugggcagccggcagccaggucuggagccugggagagcugccuggccgcggcaggccagcauggagccuagugcagcaggagcccucggccgauagugggacuugguggcagggccccucgagcuuggccuucaaguagguuucgugcuccuggcugcuucccuggcaggaggccaggcugcagggggcacucucacugccaggccucacagcccacagccccccaagccuccacggcggagacccagaucauaacgucacugucucuccccuuuccucgggcacucuggggcccuggagccugcucagcugcucugcccucgcaacccagcagugguggcuguagcuugggccuccuguucccugucucccugggugcuauccccgcucugccaagccugcugcgcugcgcuacucgggugcuaaccccgcugccucccgcuuccccgcucccacuccugucugcaccgggcugcuuuucaccgcgagccuucucaguugucaggaaacuccgguuucaccaucaggccugggggguggggaggcaagugucacauccccccacgcugcagcaggacuccgccucaccgcguccacacacagcaaugggggccggggccaggccagaagggcgcaggcagccgugugcccagccagaugcuggcguucagcagugugggccauggugcuggacgaggcugaguaggcaagggaguggcugucaacacuuaggcuggagugggcccuuccuuuuccucccaggcaccugggugcuacugucgggccucucccacaugggcacuugagguggucaggagaaaccuuccugccuucugagaaaccacucgccaucccagcuuggaggggcagggcggggcaggaggccuggcggccuggcugugcuuggugguggcaaugagaggccugugugggcggcaggcggacgggaacaaccugaacccgagcucacacgcuggccccccuuuggggacccacccugccccaccaggugcuggcaucggccccaccauucagauuggggaggagacggugaucacuguggacacuaaggcggcaggcaaaggcaaagugacgugcaccgugugcacgccugauggcucagagguggauguggacgugguggagaaugaggacggcacuuucgacaucuucuacacggccccccagccgggcaaauacgucaucugugugcgcuuugguggcgagcacgugcccaacagccccuuccaagugacggugaggaggggugggggguaggucagcaggggugucuggcaggucccggccuguuccccuggggccccucugugacaacagacucuccagcagcucucugcuuugcccugcaggcucuggcuggggaccagcccucggugcagcccccucuacggucucagcagcuggccccacaguacaccuacgcccagggcggccagcagacuuggguacggccuggccagcuagggacacuggggcuagccagcuggguguucugugagccccuaguuuaccaugugugaggagggaccccagauccucccacugucccucacccaugcccugugucuccacugcaggccccggagaggccccuggugggugucaaugggcuggaugugaccagccugaggcccuuugaccuugucauccccuucaccaucaagaagggcgagaucacaggugaguggggacuugggaaggagcucgggagccaaggaggccagacugugccaaugagcugcccugaccucagccccacugccccacaggggagguucggaugcccucaggcaagguggcgcagcccaccaucacugacaacaaagacggcaccgugaccgugcgguaugcacccagcgaggcuggccugcacgagauggacauccgcuaugacaacaugcacaucccaggugggccugcccugccucugcccacuccaccgccaccaccucacagagagauggggcugggggacacacgaggcugccauuccacaaggcccuucuuccugccucaggaagccccuugcaguucuauguggauuacgucaacuguggccaugucacugccuaugggccuggccucacccauggaguagugaacaagccugccaccuucaccgucaacaccaaggaugcaggagagggugagcaauagcucuggucuugaccugcucugugcccgggaugcccucaccgggguaagggcuggacucaggagauacuccugaauggggcucccugcccugcugcccuggccaucggagcuccucagugcaggccaacuggaguguccccagcauaguucccaugcucacccacggcucucuccagggggccugucucuggccauugagggcccguccaaagcagaaaucagcugcacugacaaccaggaugggacaugcagcguguccuaccugccugugcugccgggggacuacagcauucuagucaaguacaaugaacagcacgucccaggcagccccuucacugcucgggucacagguggguggcacugggagcagugacagaaacggguggcagggugggcauggucucccauggcuggacgcacacugauggcuggccuguccccaccaggugacgacuccaugcguaugucccaccuaaaggucggcucugcugccgacauccccaucaacaucucagagacggaucucagccugcugacggccacuguggucccgcccucgggccgggaggagcccuguuugcugaagcggcugcguaauggccacguggguaagcggcugaaggguccaggggguucagaaaggaggcagccuguggggagccaugcccucccugacugacagccaugcccuguguccagggauuucauucgugcccaaggagacgggggagcaccuggugcaugugaagaaaaauggccagcacguggccagcagccccaucccgguggugaucagccagucggaaauuggggaugccagucguguucgggucucuggucagggccuucacgaaggccacaccuuugagccugcagaguuuaucauugauacccgcgaugcagguaggcaguggcugcccaccagcuggggcgggagcacugugcauagcaccgaggcucagggguauccauccccuaggcuauggugggcucagccuguccauugagggccccagcaagguggacaucaacacagaggaccuggaggacgggacgugcagggucaccuacugccccacagagccaggcaacuacaucaucaacaucaaguuugccgaccagcacgugccuggugagugcagcagugccucggcagccccccucacuacaccagggcccacaggcaguaugugacuggaggggcgugggccgugcuuucuuccugcaggcagccccuucucugugaaggugacaggcgagggccgggugaaagagagcaucacccgcaggcgucgggcuccuucaguggccaacguugguagucauugugaccucagccugaaaaucccugguaggggcugugggaagccuggggagggguccuggggcucaagcagccccaagaggagggguggagcccagggcugcugcucacuagcccauccccacccugcagaaauuagcauccaggauaugacagcccaggugaccagcccaucgggcaagacccaugaggccgagaucguggaaggggagaaccacaccuacugcauccgcuuuguucccgcugagaugggcacacacacagucagcgugaaguacaagggccagcacgugccugggagccccuuccaguucaccguggggccccuaggggaagggggagcccacaagguccgagcugggggcccuggccuggagagagcugaagcuggagugccagguaggccugcucacaccccgagugcucgcucuccugcguuggccagggugggguuggggguggaggaaagagccggcaggcaugucuaccuuggcuaugccuggagggggccgaggcuggugaagcagccuucagugaggacaaacuguucucccacagccgaauucaguaucuggacccgggaagcuggugcuggaggccuggccauugcugucgagggccccagcaaggcugagaucucuuuugaggaccgcaaggacggcuccugugguguggcuuaugugguccaggagccagguacugggaacccggcugggguuggaggagguggggccugaguguggguauuggacccagggcuggcacagauagcccugccuggcacucacucuucacuuugaggucacagggccacccaggcuguucgugggaggugggaggcccaaaggcugaugagccggucuuacacucuuucccugcccaggugacuacgaagucucagucaaguucaacgaggaacacauucccgacagccccuucguggugccuguggcuucuccgucuggcgacgcccgccgccucacuguuucuagccuucaggugaggcaccgagagaaaccgcccaccuggggcuccugggcccggacagaccagagccaccgcagagaccaggccuuggcccuguguucagugaccccccuggcccagcucuggguuccaggccucugcucuggccgggugcagcccacgcuuggggucggcaggaaauauccugcccaccacguggaguuuuucucgugucucaggucuaaaggcuuugaacagaagccugugccccuugagcaccagggcugcgguuuaaagagggacagccugccaaggcugggugcugcccacaggguggggcagcccucccuuccugccaccugggugugugcgacggcagagugugggggcaggggcggggaugugcgccuguggcuugcugccccuugcaaaucaguggcucucccucuuuaaaccaaguuggacgccagauggguaagugcgacccgcgggccucuugcuccuggggccuuuccguccucccuugcccuggcucaagcacccccaucuaaccaugucugcugugcuuccaggagucagggcuaaaggucaaccagccagccucuuuugcagucagccugaacggggccaagggggcgaucgaugccaaggugcacagccccucaggagcccuggaggagugcuaugucacagaaauugaccaaggugaggcccugucccugcccggccgcccugcccugcuggcuggaagcaggcugagaguacaaaaggaagguaccgcuucuguaagcagccaagacggggccccaacuccugggcccccuaagccaggcaacccuuucccaauuggugacccaagccgcuggggauguggcucgccacccacagcuauuaggaaggccuucuacccugcaguaccaugccaucuccacagggaaagacucaaaguccagccucagugcugcccggcccuucagccacggccaugguacuugugcacaggccuggggcagccuuguggguaggaggagcccagugggcuucauuucacggccuaguccugcccuucccagcugcaugaccugaagcaaguuccugcccgucucugagccuguuaacaugcaggggauaugguguucacgguaaccuuucuuaggaggcagcaaggccuggguuuggcuuguaaaagauuuccgucccaaugcacccugacggugggcagcuugagugucuaaaccuucggcccucaggaggucugcugcggggugcaggugcccagcguggcugggcucacacugauggaccggcaaaauggggagggccaggguugaggcuguuccucacagacaccaucugcugguuugaggaggggccccaggcccacagcaugacucccugcuccucagauaaguaugcugugcgcuucaucccucgggagaauggcguuuaccugauugacgucaaguucaacggcacccacaucccuggaagccccuucaagauccgaguuggggagccugggcauggaggggacccaggcuuggugucugcuuacggagcaggucuggaaggcggugucacagguaagucugucggugcggcugcacgugugcacacagcugcuaggcccuugccuccaagcucuuggugacaacaggaggcaccuggaggugacaagccugugcuggguggccgaggacagggaggcaggccagucuggcucugccugaccuccugugcucccagggaacccagcugaguucgucgugaacacgagcaaugcgggagcuggugcccugucggugaccauugacggccccuccaaggugaagauggauugccaggagugcccugagggcuaccgcgucaccuauacccccauggcaccuggcagcuaccucaucuccaucaaguacggcggccccuaccacauugggggcagccccuucaaggccaaagucacaggugagccuggggccaagcuauuggcaucugcccaacgcccggcaccacagccaccucuuagccccacccacucugccuugcaggcccccgucucgucagcaaccacagccuccacgagacaucaucaguguuuguagacucucugaccaaggccaccugugccccccagcauggggccccggguccugggccugcugacgccagcaaggugguggccaagggccuggggcugagcaaggccuacguaggccagaagagcagcuucacaguagacugcagcaaagcaggugggcaacccgggcccccggcccaccuucccaccaaaaugaggccagaaaucacaggauggccagugucugggagagcagggaccgccuuuggggcguggcuuucacuucuagagccaccucccugccaccuccuggaccccucaaacaaagaccagggaggagcuggaaucugcuaagcuggccuggguuggggaggugcuggcagcucuuuaggaagagagaacugucaccccagaacuggcuuagggacaggagaggagagcaggacaccagcgggaggaagggggcugggaccugggacugaggaccccucuugccucaggcaacaacaugcugcugguggggguucauggcccaaggacccccugcgaggagauccuggugaagcacgugggcagccggcucuacagcguguccuaccugcucaaggacaagggggaguacacacugguggucaaauggggggacgagcacaucccaggcagccccuaccgcguuguggugcccugagucuggggcccgugccagccggcagcccccaagccugccccgcuacccaagcagccccgcccucuuccccucaaccccggcccaggccgcccuggccgcccgccugucacugcagccgccccugcccugugccgugcugcgcucaccugccuccccagccagccgcugaccucucggcuuucacuugggcagagggagccauuugguggcgcugcuugucuucuuugguucugggaggggugagggauggggguccuguacacaaccacccacuaguucucuucuccagccaagaggaauaaaguuuugcuuccauucuccuuugcguggcu

SEQ ID NO: 21574 - RNA, 2533 nt, Homo sapiens
ccucuuucccuucgguguggugaguaagcgcaguugucgucucuugcggugccguugcugguucucacaccuuuuaggucuguucucgucuuccguuccgacucucucuuuuucguugcagccacugaagauccuggugucgccaugggccgccgccccgcccguuggugagucuugaauccguguacuuucacugcugggaaacgggcggggaaagaagugccuauggccgcugaaaacaauugugggguggagccucccccgugcggcggcccugucuugggaacugacccuauguuuuacaccucccggcuauuuuuuagucugcaauauuacugucuguuccuucguucccgugucgguguggaagcgacgguucccucguaucucugccuguguccugcaagcucaccgcauuuucgggcgcuagauacgcucuuggggccuuugugugcguucucugucuuauuuccgggcgacgugccgcgugcguugucggacgugaagggcaguccgggaaaaacgggugcggccgccuccuguguccuacagggggcgccagacgcauuuccacucggcuuggagguggauuuagugccacgugcccgaaagucuuaaauugggugaccugagcugugcaaugauaaugcggcgauuuuguaguacgcagugucuugaagagagaauuuuuaacuaggaaaguuuguugcaaaguguuuauaggaagcguaagacaaaguaacggaagauggugucuguuguuucuagucuuggguguugucuguguugcagcagccaacuguugcuuuguaguuuauuuccccgaauggaaacgguuuagaaguggacgugcauuccccacccuuuucccgucccucguuuggguuguuccuugaggggcaaagugccuguugggcuuucugugaaccucaccuaaccuguguuuuuucacuccccugcaguuaccgguauuguaagaacaagccguacccaaagucucgcuucugccgaggugucccugguaaguaguggaagagccccugcacugguuggcucugcggacuccgcguccgucugugacacccccugcacacuuacccaauccuuuuagaugccaagauucgcauuuuugaccuggggcggaaaaaggcaaaaguggaugaguuuccgcuuuguggccacauggugucagaugaauaugagcagcuguccucugaagguaaggcaggauucuuuguucgucaccccccaguccuuccuccgugcucccucaaccccacccacauacacugcacuggaauugggaguugaugaaacaugagccuuacaaaacucagccaacacaguuccccugagcuggagauagucguggugaauguuucucuauuaucuucucucacuuugcugcuuuucuucucccuaccuagcccuggaggcugcccgaauuugugccaauaaguacaugguaaaaaguuguggcaaagauggcuuccauauccgggugcggcuccaccccuuccacgucauccgcaucaacaagauguuguccugugcuggggcugacaggugagcuuggucugggccuuuuaaggcaguuggagucucuacauuauuaggcuugcauuauuuuaucagagcauagagguggccccagugacucagccacuauggcuacuagaaaagccaggcuggcaagugacuuucaguggucacucaggaccccuuccugcagauacaaacaaagcaugaguaagucuuagcaagcucuuccccacagguuaggggaaacacuggugaugggaguagcucuucuugcuuuuagcugaaugacaaccaucuugccagcagguagcugaagcuggcagaggagcccaguggcgccuuuucagugguucuugggaugcuccgcagccaauuaagccgacugaguuccuuuccucauggggacccagugugcgauggcugcacacagcagcuuccuugguaguguacgcagccuguugguuguauggguugcucuaagggaccuuggagacaggccuuucagguggauguucauguuucugaccuugcacuaccccaauguaggcuccaaacaggcaugcgaggugccuuuggaaagccccagggcacuguggccaggguucacauuggccaaguuaucauguccauccgcaccaagcugcagaacaaggagcaugugauugaggcccugcgcagggccaaguucaaguuuccuggccgccagaagguauguagugcugcagcccccuucucccaccuuugccccaggccuccugacucaguucuuuccauugcuccuuagauccacaucucaaagaaguggggcuucaccaaguucaaugcugaugaauuugaagacaugguggcugaaaagcggcucaucccagauggcuguggggucaaguacauccccaaucguggcccucuggacaaguggcgggcccugcacucaugagggcuuccaaugugcugccccccucuuaauacucaccaauaaauucuacuuccu

SEQ ID NO: 21575 - RNA, 20648 nt, Homo sapiens
auuagugacugagggguucccucuugaacccagaaguuuauuagcauucagcaaagaaguauauguuguuacaaacaggcagugcaucaagauauccagaugucagugagagcuagaaguggagaggucagaacccgggugauucugugaugucucagggauggagaagaggaagcucagguacagccaggggccacacuccccuuucugcacugggagagaaauaacucuuacaccuggggugaugauguacugcaguuccuaauuucuucccuccuuccuccagccauuuuauuuaacaugaccuaaauauacauuccuguuuuauucccccccacccccacccccauauacagcaggaaaaauaagcaccaauaauaauaacaauaauuaaagucccaccucucaauagacccaacccucacacauauacauaccauguggauuuucuucuuuggagugacuauaggauuggaaagucagggaucaggccagcaagccaucacccugaaagucacuguuccccaaaguaccauccacgugugagcuggagcagggcaggggagggggaauggugguaggggaggagauucccccaaagcagcaagaggggugaaggaguuccccaaagccucucuucugggaaaaugucacaaucaacugagcuccuaggaaguccuaugcaaggguuuccucaacgagaugguaaauuccugauagugcaagcaucauugucaucugucucccacagcuucuuggggaaaggggacaugguugaaacccccuuccuuccccauuggguggagaauguucccaaaaugcuccuuuggagaaacucaacaagacaaauagcacaacaugggcacucugauuucaaaacuaaagcacaaaacauaacgaggaaaaaaaauaagacacaugaguacucucagagggucuagacauggggaagaaggguucaaaagaaagaaaaacauaaaauaaagccagaaaaugacaagcugucuaccaggucccacacgccugagucacuuggcguuugucuucaguaccugggcaucuucugcugucccuaucauggggggagggaacggacagugugguacagcuaagguagggagaggggaaagagggagggcccuaggcaguugagaugccagcccucugcacaagcagcagcaauuuuugugucaucuuuguuuuguuuaaaacuguaaacagcaccgcuuaaaaauaaaucagaaaagaacaauugauaaacauuguuuuccaugaauauaaaaugcaaacaauauaaaaauagauaauugacuuuugauauauauauauauauauauuaaaaacaacuugaaugcaacauacacauggguaaacuugaagucucccugcuaaaccccaugccucccucuagcaacugggccugggggcugagggcagguggggugguggcacuggcacagguaaggaaagcugcuggcagcaggaugaaggguacacacccagccuccugagugugugaagcuacuucccuucuuggcauaggacuaaggagggagagagacugguguuuacugaacccauuauccgggcagucuuguggccugguacccaagcugaggccagauagguagggcuggcuugaacugggccccaaggcagugcuuccuuggagacucuaaagcaccaagaaacuggcauccuggcccugggagaggccuacuagguggccuucucuauccacauucacugguccuccaaggaccagucucaucugggaauucucaggaucacagcugucuggcacuaggccuauuggguaauaagaugaaggcagcuacuuccacuaagucccauuuucccuuaaaaucacauccaaaagcauuauuccaggaccuugcaauggagacauguuguucaucuaguaguacucuuggagguguggacaugauaucaacaguuuuaguggucugggguguauuugcugccacccaagccagcacuagucuguguuuggaaacaggccugaagcuuggcuggcucucccaaugucacccugugcugucaacaccauggguccccagacaggucuuccuuccuccccuaggcugccauuggguuucagccacaaacugcuuagcucuagaaauucaaaggaaccugcuucugcagccacauauccuggcugccccacuucaggugguaaggauccuauuccugggcuggcuagggcagugaagggacuugcaggcagcaaggcuguccaaaccaugaacucucacucagccccaggcccuacucuguggugugugaccuuccaaagcccaacaaagugugucagggcuaugccagugccccucagagacaaugccucaugcugccuuccugauccugagggcagcucucagcccuuagccaaagguuggccaccuccuuuuucucuucccagauaggcugguggcccuucuccagcagggucuggaggcuggugauggcucuaccgccugcuguggcuggcacaguccacauguagacaggagcucaagcugcccugaaagaagaggcaagagguggguucuucccuguuguaaaggcauuuggugaguguuuacuuccugccaaauagccaggccaauuucagccccaccaucccagagcagcuuugguaagaggccagaaaguuggaauuugggcacuucucucuuggaaugcugugcuugggguaaggagggccuuccucacccucuuucauucuccagcuccacaacagauacauuucuucacaauguaucuguagccaaagucagccugaagagcuggucugggucccuugaguggugguguuagugccaugcaaauucauguggugcuuccaggggugcagcuucuaccagccaggucugcuauuugugaguaagggcacugggccaaccccaaucugagaaauggugacaaagaccagcauggacacauccccuggccaagaaacaguuugcccacaaagucaccuugacuuagggggcaaacagcaucuguucccaagcuaaauugccauaucucaggaauggcaagaacccuguugacuucuucucucaacaggcauggagauggugggaugugagggcgagggugcaauaaucauaauuugagugaacacagccaagcaaaaaauguuccauaugccauuuccaauaaagacauguaaaaggaacccucuccuacaggugauuaaugagagguugagcuuggcaagauuagccuguuccaaugucuuccugacagcaagcucuuccccaccaguauuuccaaccuaguuuaacaugaaaacugcauggaugcaggagaagggagggugccauucauuccauaaagggcugcaacugccaagaagcccugucauuugaugaugcuaaggacucggcuaauuggaagauaaaagcucuuuaaagggcccagaacagcagcugagaugccuuugguauccugucuugggagugcaaaccuggggccuuauuacagaguccaaaugaugggaugggcaaggcuuaaggaacauuuuguguugggaggcuugagaagggaguuuucccuuuuaagaaacugagauaccuuaagcucugcauggucugaaauccccuuucuugcuggcugugauaaauggacccucauuuucuaucuuuccccuacacuccacaaaaaccccagccccuauagucaagccuaauuuagguugcuucucuucccuuaucucaauuaaaagaccguguuccuugugaugagauuaugaaaauuuccuuuagaggaaaaaagaacaaaaauucaaaagcaucugcaacucagguagucacaagcuuaaaagaaggaaaaaaaauccuaucauuccggagcucaacacucuauggcaguguccacaacagaaccuuguuuugucuucuguuugcaaauggaugaauuuuaucacuccaucaaggggauuagcauuuuugucuuuaacccaagcuauggcaggacaguuaaaaggcccccaucuggucaugaugccaaaguccacagcgauaggcugugagacacacgcuacuugauccucucuaaggacagcuagcugggaugaauagcuuauagucaucugauauaaugauggcagcuaugccaggccaaaaggaauagggguggggaggaucuguaccauaauuucacauugcuaauagcaaauaagccccacuuccccaagcgggaggcaaugcagacuuggcugcuaaucagugguucaucauucauugggggaaaggggcagggggcacuaaagguuuagccugugucaaggaugcaugcuauauaugugugugcauguguguuuguguguguguguguauguauguguguguguguguguguguguguguguguauauauauauauauauauauauauauauauauauauauauauaaucacuaacuuggcaacuggaauaggcacaaaauuacagcaucccaaacccagcgugggucacaagaagaaaccucgaaagcaaaaacuggagugcaguagcagcagcagccucccugggcagaugcacuugaguugaacguggccauagauggcagaagaggcaagugggaaaaccaaggugaaaacucacaggaguuuuccuuggcccaaaggguuuucaaguuaaacaacaacccccacccccccacccuucugcccaaccccugauccccauucacaugcucaggccccgugucccuacuccagaauugauaauaacuacuuggcuagguuuccauucauggcaguggaggaguagcugguggcaagagaggcaccuugcucagcccucuccuuugacaggucaaggcuggaaggcccauagugagugggcugaggcugggggugcucaggccggacccugggcagcugaggaaugccaugggugaugcccacaggcuuggccugugguagagggcuggggcugaagccuccagaacuggaagagcaacugggcucaucaacaggcagcagcacaucucgaggccuggcccucaugcucugggaggccuguggcuggagguuauagcaagggcccaugggcagguguaggugugagggacgagcuaguugaggcccagauuccccaggugcccuugacucuggcacugauagugauauugacauggucauaggagguaugcaacagguugccugccuauauggagacuggcuggaaggccuguccaacugguuggggcuuauccaggcaggaccuggccccacuggaagaggacagggagcccaagcaggccaaucauaggccccuggggguucaguauagagggaaaggggacugucucggcuccauucuccuucuuccuccucuucguccuccucaucugaaucuuccugcugggccugcagcucaucagacucgagguagcccuggaccaagugggaauuggagagcuccaucuccagggucucugcagugucgagagagcggcuucuccuguugagggccauagcagcagguggaggucgagggugcaggccaggcagucccaaguaucgagggaggcugcucacaccccagggcaggccuugguagaaucgacuaugguaguuguugaaggcauguuugugauaguagcccagcucaaaggcuuccaaggaggcugcaagaucuucaucauuguggaacucaggauucucuucacacuugccuuccccaucccguuccacaucagcgaugucaaaggucaccaugggaggcagcucagggagguuuugagugaaagaugagucagagucagagcugcaggacaugcuggaaaagagguucccauugcuggugaacucuaccagggccugugagaaacucacaguggcauucccuuccuucucaaccuccucuuccucuggaucuucagggggugaauaaguaggguaggcccuccugggagauccuccaaaauuugcuucuugcaugucuggcucaaacauggcaucacucuggaagagcugcaucaggcagguacuuugaucuuucuuggagcagguuccuucauaacgcuucuccagaggacggaagucccuccagucuggcucgcugcuugcagugguggggaaagcugagguaauuccccggugggaaaucugagaggucccugauaccccugcugccaggcccaucacugaugggccuaagggccucaucugauacucuaagacgggcuucuccugccgggccugggucucucggacuugagucucucuacaacgaaccucucgggccugggcuucucggguucuggccucccugccaugagcuucccaagugugggccucccuggcauaggcuucccugccauaagccucucgaguauaggccucccuggcgugggccucccuggcaugagcuucucgggcacgugccuccugggccucaagcugcucccgccgaagcucccaauacaacaacuguuucuggauggucacuagccguucuuccucugucuccauugccccagguggccgggaggacaaaaagggcucaaaguuuaagaaggggucaaacaucucagagcuucgaccauggaggucauaaaggcagucaucuccagguggagaguucucaaggcugucaucuggcucauagaacucauauagggcaucuccacuguagcugucucgggguagacaaucccugcggacaagccccagggccucaccugaaucauccucaaauccaggugugguggagucauaauaaccuucaucacuauugggggcggauucuugcuggucacucugaggagucaaaaguuccccaggggcuaggccaggauaagaccuaacugggucaaggagcauguagccgugguggccuggggauguggugggaugguagcccagguucauauugggccguggauacauuugggcaguuucccacagauauucuaagucaucaucuucuuccuccuccuuaaccuccucuucuuccuccucuaauuccaccucuucuuccucuucuuccuccucgucaucaucaucuggcaaggccaucuccuccccaccuccuugguaggucaccaggcaggaacuucgcuuggucccaucucgguuugcucucuggcccccagaggccaugcugucugucauacuguccauguccuguucugcuauuaugucaccacaaccugucaaugaaucaaagcuuuucagggaugucacauccccaaacaagaggcucagugggucccccacagggccauuggguggguuuaccucuccugcuacuaccuucuccccuguuucugggcuauggggcuccucuaggcuacuggcuucaggggcaggcuuggguugcacaugugcugaggcacaggccuccauggguuuuucuggaucuuuacaggccauuuucucaguagcugguggagaagguucugguguuggagaaacuuuuggcccaggggcaucuuggggguuagcauuuuccuuucuaggggcuuggaaggucuccucaaagcagggcaccugaggggcugagcucacgugcucaugaggccuggcucugacccucucaggccccuuggccccuggcucacuuugcucagccccagugaccuugcucuuccggugacggcggauacugcuaaaaaagccuuuuaggccuuucuuuggcuugggcauagagggaaacuucucagccacagcuuucucuguggcuccagccacagaugucuuacaucuggagccugucuccaaagccccaugggcacucugagagcugggaaauuggcaggguaacucaggcaaaggcagggagaagccaguuccuucacugacaacaucuucagggccaugggcugcuucacucaggccaucgugggucuugcucuugcugagaccuuucuuggagcugccuuucccagaaccuuugcuccgucccccuccaaagaaacuaggcagaguacagauacccuucuugccaccaaagaguuucauggcaguuuucuucagccuaccugggccggaugaggauggcucugagguugguccuucugucgccucagcugccuuguucuuggcuccuuuuucugcuguuuguucacggguacucccagaggcugcagcucccuuggccugagcagcuucauccuuuugggucuccaugaugauggggacaacugagguacguccagcuggaaaugcagccucaggcuuccaggcacuguuauaacauuaucagucaggaagcaucacaguggggucuggaggagauaggagagacaaagacagagagacagauacuagugagcaagcauccaggcuggguuugcuuucaccggacgucaggcuugaguggaacaagaaagaaaaugauggaaaauguggggcaaaucuuaauccacucgauaugcuuggcuugcugggccagcucucucugggccccaaggaagcaaaacucuacacugagcaacaagaagccuucauccccuaccuucuugcuggguccacucccuucagaccauccuaagcucaggggaccacugggcagggggaccugcaguugugugaaaggccuaguggugcuauuggcugugggagguauuaucaauuaucaaaggggaugaggauagggagagacaagaaaggcaaaagggauguuggcuccaacaucacagaauuuuugaaaaccaucuggcaaaacaguccauugaguccucacagggcucuguuggauucaagcuucaguuucauauuagucugggcucucacugacauuuugucugagacugaaaaguggaccugaaguuucaccucccauccaaagcuuccuaaauugccugcagaaccaugcucaggcuucagaaucucagaauaggagccucacacauccacaaaguaggucugcaaucuagaaccugcuaagacaaugaaaugggagccucaagaaagguacucucugggcuucaauauucgccauucaagaggccuaucaauaucucucccucagagaggugauaugagggugggucuaagccagacccucuauuggcuguccugcugggaagauacuuuaaugcggucaucaauggaaccccaaauuccacuugagaaccaugagguggacuguuucuccucuacucuccuccucuuauuauuuuuguccccaucuagcucccuaucuaggaagggaacuccuugaaggcccuacaugauucauauuccuggugugugagauagguucccaauggcuuuuuaaauaaauaaaccuggugcaagccacacccuucuggucaaggcucucaauccuccaaaugcccaaauaccaacagagauggaauaaaaacaagaccuagccacuacccaccacaauauaccucugcaccucuggucauccgcuagcucagugaccagccugcuaaaacccaaugaccccucccugggaagucccucaccaauuuguccccucucuguagaguggcaccagcagaugggggaaucugggaggagaggggagaggggaaggggaaggggagggaaggaagaguaagagagggagagagaagcaagcacccuugguccaagaacagcuggacaguacaccaggccugugauugcuugccauaauaauaagacucacacauucaccuaaaguggaagacuguggaccagcacugagcauggaaagaggcuggcagcuacacucuagccuuggagccccugguucugucuugcaaacauuaauuuugugccugcugccuugcuuggcuugacacuugaaucaucagugugaugauccaagcuuccauaaagaacacucugcauaacugaauauuaaaauuggagcaagauaacagcugguuauccagaaaagaaaagagcaggugaaaaggaaaguucaucugaaccucucucugcagagaucugaauugccauuugcucagguuagagauuuuucuguaacauauuuugacaucacacuguuccaacucagcccugcaacugauagucccacaauagacagugcccccucccaccuccaaauacacacacaaucacaccuaaacacacaaucacccaguuuucugccccugggucuggugggaauaggggcccuaucaugucugaaugccccacuuuccacagcacauuuuuaccucagccuuaaaauuacugcuaagguuaucgucacgguguuggggauaggggaguuggggaggcaguacuggaguuguuugugaaauucuauuccccucuggaauucagugcuucagggcaggacaagaagggagaacucccagccuuugcuucuaaggagcuccuaggcuaacagggagaguccuauauguaacagucuguuagaaacuggaccaaacaacaggaagugaccggcaggcaggagggcaaggugaacauuaccugagcucugccuucugucagaucagcagaggcauuagauucucauaggagcgugaacccuauugcaaacugcgcaugcgaaggaucuagggugcacucuccuuaugagaaucuaacaaaugccugaugaucugagauggaacacuuuuaucccaaaaccuuccuccucuccauccauggaaaaauugucuuccaugaaacaggucccugguuccaaaaagguugggaaccgcugccuuaaagaauagccccuguuauuucuaaagcugguugguggaguaucauucuuuauaccuuguaaacauauuccaagauaaaugugaaagggagaaagacacuucuugggcaguaaggcugggccucaaggaaaaccucacagccaagugaaaaacucuaggaccuacacauccuugugaaucaaaggcugacuuguccugcuggguuuggggcuggaguuccugggaacagagugauuuggcaaauugaaucacaaagaaggcugcuuuccagagccuugacgccccaguuagaagacagucucuuugggcuuucccuugcccuugcuccuaugcucugugaggguagaggccagcccacucaccucucucuguauuguccccuuuccugucacagggagcugcaguguguuguggaaggagccauggaccacagggcugggguccaggccaugucagccucccaucugccaagggacccugaaugggccaguguagccugcugagacgcagguacuugugagcuauuuugagaucaaaacagcuccucuaccuauccuucuaccugcccacuccaacuacaguggugugaugaguugaugugauaauaggcacaaaaaaagcacuuuauaaacuguauaguacagugcaaaugagaaagacugucauuacaguuauuauuacuccuuccaggucagaucccaguuucuuaggaagcaacugaccauguguuaaaggcuguucauuugggaaagccauucacugugggaagcucagggacuugcugccuuggcccaugcugagagggagacagauaugaggggauuuuaaaaagguguguauaucuauacaaacuccucugcuaagagguuugaaaagcccucucuguguguugugggagacagaugaauuacgcagggugucccugggauggaguuucucuccguccaguucaggcccuucuccuaaccaaguccagagucaucuuugcuggcagauaccagccuuaaacugguacucuguguucucucucccagagccauguccccccacagucauucacaguaucucugccuaugucacccagaacacugggaaggaagguggcagggucacccauagcugguagcucccuagcguagccccaccuagcuaccucugccuuaggccucuucuccauacucuuugcuauccaaccaggugccaaagcuauccuuccucaauggguuaugcugccuuuacuuaggaccacaagaguucaccaagagagugagguggggcagaaagcaaaggagacagcaaaggacagacucugcagauccccuaggcugggacuggcuuucccuggggguccugucaagaaaguggcacugccaaaugcagggccccacaacccucauguuccuuaaccaguguggcugaguuucaggugggcuggggguuaagagaacccucccaagccacucuguggucccuugcagggacugccugcugcagcagcugcuaucauggcagaaagcaggcugugguagaaagcgcuggggccauuccagcucccugagccagauucaagccauucuggggccaguggaaggcuggcuacaaaggaagagcuucuuccuucuccucuccacuuaaaacauaggcaggaggccagccacauaccugcccuagagacccuucucaaggagaagggacagcugcaauaugagccuugcacauucugcuccaaaucagcuucccggggccagcauggccaacuugaagagggcugaauugggggaagaaaaagaagcaaguggauuuaugcaguagcuccagagacauggccuugaccagccauaguuccucaggccuguuccaaacagucuuccugaaagcaagcccacuucaggcccaccugcccuucuguauguuggggaggguugguuaaagaaaaaauggugaggauggcccuccagagagcuggccauuucagcgcuggaaucaacucugcccagcuaggggaaauccagcaaguuuuuucccauguuuaugccucaauuuccuuaacuguaaaaugaggucauugagagugccuaccucuuaaggcuauuguaagaaguaaaaccaaugcacauaauguaccaaaucaagugcauuacauagcagaagcuaaaaacauuauaguaaccaacuuuuauucauauuuuauucaaacugugguagaacaauuucuagaaguaaaaucaucucagucagguugaguagggugcucccuagggcucuguggguaagucaccaaaccuccuuggggcucaguuuucccaaauggcaaaugguaaaugaagauaacuguguggucaugucauaggaggcuuuacuugcucauuuagccaacuuuugauauucagggaccuaaaagagucagcuacuggcuagcagccaaggauuaucugggacuuucaacuagccagguucucuagcccaggucaaacucagcuaaaaguaccaacaucaaaggaaaugcaaaucaacagauauccuucacccucaggguauuuaccacuuuauaaagcacucccuacucccauacccccccauuugcccuccucagccacccauuacucaggccuggugggggauggcaacuccuugucacagagaaggaaacugugccuagacuugggaaaagacuuguccaaggucacauagugaaauggugacagagccacacuagcucccagaacuguugagucucaauuucaugccauucugcugcacugugcaggccaccaaucaaaggaggaagacugagcaagagaacugcaaaguuuacccucacaccagcaagaacuauaaucucccaaucccaucccaccucugucccagcccugcuaagccuucuuugccacauuuccaguccucacugguugccacuguuuggguccuaccaaacacauuccaggaagccugcugacaucagaaucuaggggccaacaacccagccuguggcugcucuccucaucagcaacccuaccaccacuccucucaaacuacaggacaugucacucuacuccccuuuuccuuaagagauagguuugaguggcccaaaaacgagaaaccugccaacguggacaaagaugcagaauuugagcuauuugaagaaaaugacuuaucagaugaucuggaacuugaaugauccauuuuuaacacccauagccaaguacugcccucaaaacuauuuggucagagccuaaaggaagggcugcuuggcuugguuggcugauggaguuguagaugcagcuggcagagccccuucagcuccuccccuaauuugcagccuuccugcugaggggcaccuccugcccagagggcaucucaccaacuccagaugcagcaagaccccaaauugggacuucucucuccugucccaauucccccaccagccccucucaacugauuuguuuacauacugagcuuuguauaauucauccugacgggcuuuggucuguucauucaucucucucaaauugacccuccuucaucuuacagucacuacaacuagcacacagcaggagcucaaacaaugcugauucaacugaauucuaauucaccugaaguuucuuggugcggaacuggaaugccagccucaccuucuauaggcugugugguuugagaaaguggccuaaccucucugacacucaaaugccuuaucuguaaaaugaagaaaaugcuaucuaccaugcaggauugugguaaggauuagagaugaucaauguaaaagcaaacugguaacuacauacuaagcagauauucaauaaagggcucuugugaugaggccacuuguaggcaccuuuuccucuccagcuccccaauugccaccccacauucuccgaagaugacacaagccucuuagcugagcucccucuagucccucccuaccgcagcacccccuggcuccccucucccaucucauucauccuguacguuguugccagauucauuuucuuacaacuccuguuucagcacuucacuccuccacuuaccaaauuauucugcauugccuacaggauaagggccaaaacccuaugucugauguuaaaggcuugcucucccugaaugcuccuuacaaguuucucagccuuguuucucugccucuuggccccagccccaaauacacagggguuugcccagucugggagauguggucacccagauaccaccucucccuagaaaugggcuuuccuggugagucuucuuagugccccagguuccuccucaggcucuugagguccccucccugcccagcuugccuugaaugacagggacuuugggagccacuuacuugccacucccaucuuaggcucccaaacuuucuuagagagaaguguaucugaaguggguaccaugcccgccugcauaggcuuccacuaagucaguacuagcccagcuagagcgagaucagacaggugccaacccuuccccaccccccguucaaaugaagaauaggagaggagcuaacuccagagaaacagaugugacagagcagccaaggaaacccuacagaggagcagcugggucaagugaacaauggauaccucugacuuuccuauguguccacuccccucuacuaaccaugcccugugugagaaaccaagugaggaaacugaagcuugggaggggacaaggagagugugauucgaggaagaacucuggaauugaauugcggaccaggagcuuuggacuucugaguuaacuugagcaaauccuuucccuguucuggaccucaguuucuucauauagaaaugggagauuggaccagggagucugcuugcuccaaguugcccugagaggcugggggaggaguggucuugugcccaguuuucuaauggcugcugagucagaaggcauagcagggggcacuggauuggcuuugaggguccuaggucuuacuguuaggccugguuaccuagcugguucgaccuaguucaccacuucaggacaaaggugcacuguggcccagccucacuccuuacaccaccccucaacauuuugcucuuucaaaaugcacugagucuggccugugaauauuuccaacauauccagaaaggaggggggccagaacuggucaugccauuccucauuccccugaaaagagccacagcccccagcaagaagggcugagcagauggagagggaggguugaggcauacucacuagggauggaggguuaguauccacuuggaagcccagcggggguaaaaacuguaggagaugaaagcaaugaaaccucuaugcugaaaaaaaaugcacaucaaagggucacaaaggccacugcagcaccaguaugccugccuaugaccacaccaagccccucaggucauuuucuccauuguucauauuuuccccuaauuccaaaaggggagguggagggagcaacauacucuuacugggcuagcaccuguaccucuguagugguucugguuccccugccugccuuugcuagaaauacacuuacacacgcacagguuugaaaaauaagacgaagcagaggagauggaagacucugagauuauuuaauucagagaacagaaguugggggugcagagagaguuuaaugccuaugaaaucuccaauagaucguuaagcagaagagcaaugguggccagcugcucgcaacuccuucccccaacacacacacacacacacacacacacacacacacacacacacaagguuuaacuauagcaugacaggcucagauuaucccugagaaagaacugggcaaugaggcaggugacccaggaaugagugacacagaaaggcuaugaaauauugccucaggggcuuaacccuuuaucacccacuguaucugcccagacaggauucagguagggaaauugaaauaacauuggacauucucucuucuagccucagauagccuaucuguuaagcaagggggcuggaaaccccuucucccucuugguucuaccugccaggcuugcuacuguuuccuaguggagcagaguuguuucuuccauacacacuaucuacgaguggagauguaacaguucuucaggaaauuucguguuucuuugagacagggucuugcucugcugcccagccuggagugcaguggcaugaucauggcucacugcagccuugaugucucaggcccaagagaggcuccugccucagccuuccaaguagcugggacuacaggugcaaaccaccacaccuggcuaaauuuuuguauuuuuuguagagaugagguuuugccauguugcccgagcuggucucgaacuccuggggucaagugauccacccggcuaggccucccaaagugcuggaauugcaggugugagccaccaggcccagcccuuaaggaauuuuuaauaccuccacuaugcuaggaggggaucauuagacugccaaauucuuccaacuaccuccucuccuuuugaaauuuucagucccagcaaagcuauaggccaagaccaagaggcaaaagagacauuaaacgagugagaggcuccccuuaugaaguucccaaguuaacucagccccccuuuccucuuagggaaugagggagguaagaugagggggaugguuaaugaaaucuacauugauuggaggcugcugguuccauggaacauaguggaaagagccacugcacgggaagcaggagccuauccuuaaauagcugugugaccuuaagcgagccccuguugcuuuccaaggcuaaggauucucaucuguaagcauagcaguucaaacuggugcuccccaaggacugcccaucugagaggaagguguucagcagaggccuggggaacacuucucagccccacuucccaccucuuccugcccuuuccccugcaaugccaaagggaggcugacauaguaaaacuuuccuuuggagguagccugcccgcagcucuacuuccagauccaaaggugaccucuuaacuggcugacuuugcagcaugcuucugaucccuuucuaagaccccauucuaaaacucauucaaaaaccuuguuuuuauuacugcuuaguuacauacaaaaauagcaacucccugucaauucccuacucuuugaugccgccuuccccuaaaaggaucagauuuccauuccacagccuggcauccgggaaaccccaucacugagccucaaucucuucucuaccucugagccacaccaucucaaccagaauagacucauucacucccuucacccugccugucaaucacuuucuccccucccauuccugggucugcuuaugcuuugccuacuaaaccccucuacuuucuggcagcuuccauggaugaucccccugcuuauacagaucuuucaucucucuccaaguaguuugucucuuggcucaugaaucagcaaccaaagauaugcauggucugggaucugagcauuccaaauccugggccuguuguugggggaagauauaucaugauuuuuuucuuguaguugcaaucaucccccuucuaauccauccucauuaggcacacucaauacauaucugagccuugaguaucauuucucuagccacuuucauaugaaucaggacaagcgcaaguuggaaagguaaaggucuucuggaaaacucuacaaagaaagcaaguccuuccggaacaaucauuaacugcucugcacugcuuggcuuugagaggguuguggcugagguccagguuuuauuuacuccuccaaaggguucugagagaacccagacauccaugauaucagacaaaacagaggcaggccaacuuaauuauagucugcauccuauuauaauuuaagccugaauaugcccaggagaaguaggcagcccuggaggaguucugagaagaaagaagucaccaugggugggcaagagccaggcagaaaggcaccaaggaaaaggaaggcccagaacugagguuugagaaggaagaagauuuggacagguguaggcugaguggguuuggguguggggaagggaguuacauagagcagauacauuaggugccugcuggccugagacaaggcagagggcagguccagcccugggcuagagaugcccagcugcaaguagagguuuguguuggggccuaaucaaggugggaggaggugacuguagugugauaucugugguccuggcuccugucauaaagguccagagcuagccuucccccaagugaggaauuuacugggucucguugccccuccucaaagugcccaagcuuugccugggcccugcagcccacagggcucuccacaccagagguuaaucaaagguccaagagcuuaccaagcccccaguggcuuccucuguccuauuccucaaaaaggccuagagagcccacugccagaggugcaccauggugcagugacugugcaguggguggugccgaaugaggggagccacacugggggagggggcucugcuggaaucccgguggggcaggcaguccaacagugcagugcccucugccuugcccaugcccacgccgcugcagcaggcaggcagagccgcagaggaagauguuuguguguggaacaaggcucgccuugaccccgcggcccuugccgaaagcagccuggccaaacggagaccagcucugcggggccaguccagcugccgccuaggcgcuugggcugugacgcauguagcgggcacagccccucaccaccgggggagccaagcaaaguccagcguucgggcggucaccagugucagaagugucuccagcagacaaugacaggggccuggcgggcuggguauguuaaguaacugcgaaguuggaggguuuggccaccucgcuagcucuccuguacacagagaugguaugauacguuccguacuacaaugagggcuccuucggccucuggcaaggaaaugccccccaaacaccgugccuauugcuauuuuuaaacgggaggcuggagaggaaaacgcggccaguauccuccaagggaaaaggaggugaggcgaggcgaggcgggagacaaagcggccuugcagcucuaacucaaggacuagcuugcgccgcugcucuaacccaaggaccagcaagagcccggcugccagccagccugcccgaccgcgggggcgggcgccagaugcgcccggaggcccaggaggaggggcgcggcuaguuggggccacaaggccaagguucugaagggaagugugcgacugagcucagcccacaggcccaacugagcuccucuggggagggggcagucuguggaugucccaauccacgccaaagccggucuccgucgggcccaagccagcacgccagcuugaguccgcagaaaggagggagaggcuggagaugcacaggggaggggaggggcggcagccaggcagccggagagaggggugagcgguacccgcguuacacagcuguuccagcaaaugugcuacaacaaagcugcagagcuccuggccuacaaaugcauggcuuggggugcuggcuggcggcgcccuucccgggacugugcggcagcacgugcgggcccauccccgcccccccgaaagccgggaggcuuggcccaggcuagccugccuuccuacccgcccuccccaaccccccuccccccagccguggucgcuugugcccaggggacucaaggccgcucugccucuccacccgacaguccgcaaagcggguuccaaaggagaggggcgagcgaccgggacuccgacccgccuaguccuuagugcccuccuccaguccguaggagcagagcacgcgggaaugcacccgaccgcgggcaggcggaggcuccuggcuguacgcaacgcuuacccagcccggucagguuccuagcccgguuauuguccgcugagccgcccugggccgggcugcagccucggcugccacggcugagagcgccgccaccgcagcugcugccgccgucgccgcggcuccagucaccuccagcacugacuccccuuccccaggcuuuggguagcucccccauacccccucccccagu

SEQ ID NO: 21576 - RNA, 20648 nt, Homo sapiens
acugggggaggggguaugggggagcuacccaaagccuggggaaggggagucagugcuggaggugacuggagccgcggcgacggcggcagcagcugcgguggcggcgcucucagccguggcagccgaggcugcagcccggcccagggcggcucagcggacaauaaccgggcuaggaaccugaccgggcuggguaagcguugcguacagccaggagccuccgccugcccgcggucgggugcauucccgcgugcucugcuccuacggacuggaggagggcacuaaggacuaggcgggucggagucccggucgcucgccccucuccuuuggaacccgcuuugcggacugucggguggagaggcagagcggccuugaguccccugggcacaagcgaccacggcuggggggagggggguuggggagggcggguaggaaggcaggcuagccugggccaagccucccggcuuucgggggggcggggaugggcccgcacgugcugccgcacagucccgggaagggcgccgccagccagcaccccaagccaugcauuuguaggccaggagcucugcagcuuuguuguagcacauuugcuggaacagcuguguaacgcggguaccgcucaccccucucuccggcugccuggcugccgccccuccccuccccugugcaucuccagccucucccuccuuucugcggacucaagcuggcgugcuggcuugggcccgacggagaccggcuuuggcguggauugggacauccacagacugcccccuccccagaggagcucaguugggccugugggcugagcucagucgcacacuucccuucagaaccuuggccuuguggccccaacuagccgcgccccuccuccugggccuccgggcgcaucuggcgcccgcccccgcggucgggcaggcuggcuggcagccgggcucuugcugguccuuggguuagagcagcggcgcaagcuaguccuugaguuagagcugcaaggccgcuuugucucccgccucgccucgccucaccuccuuuucccuuggaggauacuggccgcguuuuccucuccagccucccguuuaaaaauagcaauaggcacgguguuuggggggcauuuccuugccagaggccgaaggagcccucauuguaguacggaacguaucauaccaucucuguguacaggagagcuagcgagguggccaaacccuccaacuucgcaguuacuuaacauacccagcccgccaggccccugucauugucugcuggagacacuucugacacuggugaccgcccgaacgcuggacuuugcuuggcucccccgguggugaggggcugugcccgcuacaugcgucacagcccaagcgccuaggcggcagcuggacuggccccgcagagcuggucuccguuuggccaggcugcuuucggcaagggccgcggggucaaggcgagccuuguuccacacacaaacaucuuccucugcggcucugccugccugcugcagcggcgugggcaugggcaaggcagagggcacugcacuguuggacugccugccccaccgggauuccagcagagcccccucccccaguguggcuccccucauucggcaccacccacugcacagucacugcaccauggugcaccucuggcagugggcucucuaggccuuuuugaggaauaggacagaggaagccacugggggcuugguaagcucuuggaccuuugauuaaccucugguguggagagcccugugggcugcagggcccaggcaaagcuugggcacuuugaggaggggcaacgagacccaguaaauuccucacuugggggaaggcuagcucuggaccuuuaugacaggagccaggaccacagauaucacacuacagucaccuccucccaccuugauuaggccccaacacaaaccucuacuugcagcugggcaucucuagcccagggcuggaccugcccucugccuugucucaggccagcaggcaccuaauguaucugcucuauguaacucccuuccccacacccaaacccacucagccuacaccuguccaaaucuucuuccuucucaaaccucaguucugggccuuccuuuuccuuggugccuuucugccuggcucuugcccacccauggugacuucuuucuucucagaacuccuccagggcugccuacuucuccugggcauauucaggcuuaaauuauaauaggaugcagacuauaauuaaguuggccugccucuguuuugucugauaucauggaugucuggguucucucagaacccuuuggaggaguaaauaaaaccuggaccucagccacaacccucucaaagccaagcagugcagagcaguuaaugauuguuccggaaggacuugcuuucuuuguagaguuuuccagaagaccuuuaccuuuccaacuugcgcuuguccugauucauaugaaaguggcuagagaaaugauacucaaggcucagauauguauugagugugccuaaugaggauggauuagaagggggaugauugcaacuacaagaaaaaaaucaugauauaucuucccccaacaacaggcccaggauuuggaaugcucagaucccagaccaugcauaucuuugguugcugauucaugagccaagagacaaacuacuuggagagagaugaaagaucuguauaagcagggggaucauccauggaagcugccagaaaguagagggguuuaguaggcaaagcauaagcagacccaggaaugggaggggagaaagugauugacaggcagggugaagggagugaaugagucuauucugguugagaugguguggcucagagguagagaagagauugaggcucagugaugggguuucccggaugccaggcuguggaauggaaaucugauccuuuuaggggaaggcggcaucaaagaguagggaauugacagggaguugcuauuuuuguauguaacuaagcaguaauaaaaacaagguuuuugaaugaguuuuagaauggggucuuagaaagggaucagaagcaugcugcaaagucagccaguuaagaggucaccuuuggaucuggaaguagagcugcgggcaggcuaccuccaaaggaaaguuuuacuaugucagccucccuuuggcauugcaggggaaagggcaggaagaggugggaaguggggcugagaaguguuccccaggccucugcugaacaccuuccucucagaugggcaguccuuggggagcaccaguuugaacugcuaugcuuacagaugagaauccuuagccuuggaaagcaacaggggcucgcuuaaggucacacagcuauuuaaggauaggcuccugcuucccgugcaguggcucuuuccacuauguuccauggaaccagcagccuccaaucaauguagauuucauuaaccaucccccucaucuuaccucccucauucccuaagaggaaaggggggcugaguuaacuugggaacuucauaaggggagccucucacucguuuaaugucucuuuugccucuuggucuuggccuauagcuuugcugggacugaaaauuucaaaaggagaggagguaguuggaagaauuuggcagucuaaugauccccuccuagcauaguggagguauuaaaaauuccuuaagggcugggccugguggcucacaccugcaauuccagcacuuugggaggccuagccggguggaucacuugaccccaggaguucgagaccagcucgggcaacauggcaaaaccucaucucuacaaaaaauacaaaaauuuagccagguguggugguuugcaccuguagucccagcuacuuggaaggcugaggcaggagccucucuugggccugagacaucaaggcugcagugagccaugaucaugccacugcacuccaggcugggcagcagagcaagacccugucucaaagaaacacgaaauuuccugaagaacuguuacaucuccacucguagauaguguguauggaagaaacaacucugcuccacuaggaaacaguagcaagccuggcagguagaaccaagagggagaagggguuuccagcccccuugcuuaacagauaggcuaucugaggcuagaagagagaauguccaauguuauuucaauuucccuaccugaauccugucugggcagauacagugggugauaaaggguuaagccccugaggcaauauuucauagccuuucugugucacucauuccugggucaccugccucauugcccaguucuuucucagggauaaucugagccugucaugcuauaguuaaaccuuguguguguguguguguguguguguguguguguguguguguguugggggaaggaguugcgagcagcuggccaccauugcucuucugcuuaacgaucuauuggagauuucauaggcauuaaacucucucugcacccccaacuucuguucucugaauuaaauaaucucagagucuuccaucuccucugcuucgucuuauuuuucaaaccugugcguguguaaguguauuucuagcaaaggcaggcaggggaaccagaaccacuacagagguacaggugcuagcccaguaagaguauguugcucccuccaccuccccuuuuggaauuaggggaaaauaugaacaauggagaaaaugaccugaggggcuugguguggucauaggcaggcauacuggugcugcaguggccuuugugacccuuugaugugcauuuuuuuucagcauagagguuucauugcuuucaucuccuacaguuuuuacccccgcugggcuuccaaguggauacuaacccuccaucccuagugaguaugccucaacccucccucuccaucugcucagcccuucuugcugggggcuguggcucuuuucaggggaaugaggaauggcaugaccaguucuggccccccuccuuucuggauauguuggaaauauucacaggccagacucagugcauuuugaaagagcaaaauguugaggggugguguaaggagugaggcugggccacagugcaccuuuguccugaaguggugaacuaggucgaaccagcuagguaaccaggccuaacaguaagaccuaggacccucaaagccaauccagugcccccugcuaugccuucugacucagcagccauuagaaaacugggcacaagaccacuccucccccagccucucagggcaacuuggagcaagcagacucccugguccaaucucccauuucuauaugaagaaacugagguccagaacagggaaaggauuugcucaaguuaacucagaaguccaaagcuccugguccgcaauucaauuccagaguucuuccucgaaucacacucuccuuguccccucccaagcuucaguuuccucacuugguuucucacacagggcaugguuaguagaggggaguggacacauaggaaagucagagguauccauuguucacuugacccagcugcuccucuguaggguuuccuuggcugcucugucacaucuguuucucuggaguuagcuccucuccuauucuucauuugaacgggggguggggaaggguuggcaccugucugaucucgcucuagcugggcuaguacugacuuaguggaagccuaugcaggcgggcaugguacccacuucagauacacuucucucuaagaaaguuugggagccuaagaugggaguggcaaguaaguggcucccaaagucccugucauucaaggcaagcugggcagggaggggaccucaagagccugaggaggaaccuggggcacuaagaagacucaccaggaaagcccauuucuagggagaggugguaucugggugaccacaucucccagacugggcaaaccccuguguauuuggggcuggggccaagaggcagagaaacaaggcugagaaacuuguaaggagcauucagggagagcaagccuuuaacaucagacauaggguuuuggcccuuauccuguaggcaaugcagaauaauuugguaaguggaggagugaagugcugaaacaggaguuguaagaaaaugaaucuggcaacaacguacaggaugaaugagaugggagaggggagccagggggugcugcgguagggagggacuagagggagcucagcuaagaggcuugugucaucuucggagaaugugggguggcaauuggggagcuggagaggaaaaggugccuacaaguggccucaucacaagagcccuuuauugaauaucugcuuaguauguaguuaccaguuugcuuuuacauugaucaucucuaauccuuaccacaauccugcaugguagauagcauuuucuucauuuuacagauaaggcauuugagugucagagagguuaggccacuuucucaaaccacacagccuauagaaggugaggcuggcauuccaguuccgcaccaagaaacuucaggugaauuagaauucaguugaaucagcauuguuugagcuccugcugugugcuaguuguagugacuguaagaugaaggagggucaauuugagagagaugaaugaacagaccaaagcccgucaggaugaauuauacaaagcucaguauguaaacaaaucaguugagaggggcuggugggggaauugggacaggagagagaagucccaauuuggggucuugcugcaucuggaguuggugagaugcccucugggcaggaggugccccucagcaggaaggcugcaaauuaggggaggagcugaaggggcucugccagcugcaucuacaacuccaucagccaaccaagccaagcagcccuuccuuuaggcucugaccaaauaguuuugagggcaguacuuggcuauggguguuaaaaauggaucauucaaguuccagaucaucugauaagucauuuucuucaaauagcucaaauucugcaucuuuguccacguuggcagguuucucguuuuugggccacucaaaccuaucucuuaaggaaaaggggaguagagugacauguccuguaguuugagaggaguggugguaggguugcugaugaggagagcagccacaggcuggguuguuggccccuagauucugaugucagcaggcuuccuggaauguguuugguaggacccaaacaguggcaaccagugaggacuggaaauguggcaaagaaggcuuagcagggcugggacagaggugggaugggauugggagauuauaguucuugcuggugugaggguaaacuuugcaguucucuugcucagucuuccuccuuugauugguggccugcacagugcagcagaauggcaugaaauugagacucaacaguucugggagcuaguguggcucugucaccauuucacuaugugaccuuggacaagucuuuucccaagucuaggcacaguuuccuucucugugacaaggaguugccaucccccaccaggccugaguaauggguggcugaggagggcaaauggggggguaugggaguagggagugcuuuauaaagugguaaauacccugagggugaaggauaucuguugauuugcauuuccuuugauguugguacuuuuagcugaguuugaccugggcuagagaaccuggcuaguugaaagucccagauaauccuuggcugcuagccaguagcugacucuuuuaggucccugaauaucaaaaguuggcuaaaugagcaaguaaagccuccuaugacaugaccacacaguuaucuucauuuaccauuugccauuugggaaaacugagccccaaggagguuuggugacuuacccacagagcccuagggagcacccuacucaaccugacugagaugauuuuacuucuagaaauuguucuaccacaguuugaauaaaauaugaauaaaaguugguuacuauaauguuuuuagcuucugcuauguaaugcacuugauuugguacauuaugugcauugguuuuacuucuuacaauagccuuaagagguaggcacucucaaugaccucauuuuacaguuaaggaaauugaggcauaaacaugggaaaaaacuugcuggauuuccccuagcugggcagaguugauuccagcgcugaaauggccagcucucuggagggccauccucaccauuuuuucuuuaaccaacccuccccaacauacagaagggcaggugggccugaagugggcuugcuuucaggaagacuguuuggaacaggccugaggaacuauggcuggucaaggccaugucucuggagcuacugcauaaauccacuugcuucuuuuucuucccccaauucagcccucuucaaguuggccaugcuggccccgggaagcugauuuggagcagaaugugcaaggcucauauugcagcugucccuucuccuugagaagggucucuagggcagguauguggcuggccuccugccuauguuuuaaguggagaggagaaggaagaagcucuuccuuuguagccagccuuccacuggccccagaauggcuugaaucuggcucagggagcuggaauggccccagcgcuuucuaccacagccugcuuucugccaugauagcagcugcugcagcaggcagucccugcaagggaccacagaguggcuugggaggguucucuuaacccccagcccaccugaaacucagccacacugguuaaggaacaugaggguuguggggcccugcauuuggcagugccacuuucuugacaggacccccagggaaagccagucccagccuaggggaucugcagagucuguccuuugcugucuccuuugcuuucugccccaccucacucucuuggugaacucuugugguccuaaguaaaggcagcauaacccauugaggaaggauagcuuuggcaccugguuggauagcaaagaguauggagaagaggccuaaggcagagguagcuagguggggcuacgcuagggagcuaccagcuaugggugacccugccaccuuccuucccaguguucugggugacauaggcagagauacugugaaugacuguggggggacauggcucugggagagagaacacagaguaccaguuuaaggcugguaucugccagcaaagaugacucuggacuugguuaggagaagggccugaacuggacggagagaaacuccaucccagggacacccugcguaauucaucugucucccacaacacacagagagggcuuuucaaaccucuuagcagaggaguuuguauagauauacacaccuuuuuaaaauccccucauaucugucucccucucagcaugggccaaggcagcaagucccugagcuucccacagugaauggcuuucccaaaugaacagccuuuaacacauggucaguugcuuccuaagaaacugggaucugaccuggaaggaguaauaauaacuguaaugacagucuuucucauuugcacuguacuauacaguuuauaaagugcuuuuuuugugccuauuaucacaucaacucaucacaccacuguaguuggagugggcagguagaaggauagguagaggagcuguuuugaucucaaaauagcucacaaguaccugcgucucagcaggcuacacuggcccauucagggucccuuggcagaugggaggcugacauggccuggaccccagcccugugguccauggcuccuuccacaacacacugcagcucccugugacaggaaaggggacaauacagagagaggugagugggcuggccucuacccucacagagcauaggagcaagggcaagggaaagcccaaagagacugucuucuaacuggggcgucaaggcucuggaaagcagccuucuuugugauucaauuugccaaaucacucuguucccaggaacuccagccccaaacccagcaggacaagucagccuuugauucacaaggauguguagguccuagaguuuuucacuuggcugugagguuuuccuugaggcccagccuuacugcccaagaagugucuuucucccuuucacauuuaucuuggaauauguuuacaagguauaaagaaugauacuccaccaaccagcuuuagaaauaacaggggcuauucuuuaaggcagcgguucccaaccuuuuuggaaccagggaccuguuucauggaagacaauuuuuccauggauggagaggaggaagguuuugggauaaaaguguuccaucucagaucaucaggcauuuguuagauucucauaaggagagugcacccuagauccuucgcaugcgcaguuugcaauaggguucacgcuccuaugagaaucuaaugccucugcugaucugacagaaggcagagcucagguaauguucaccuugcccuccugccugccggucacuuccuguuguuugguccaguuucuaacagacuguuacauauaggacucucccuguuagccuaggagcuccuuagaagcaaaggcugggaguucucccuucuuguccugcccugaagcacugaauuccagaggggaauagaauuucacaaacaacuccaguacugccuccccaacuccccuauccccaacaccgugacgauaaccuuagcaguaauuuuaaggcugagguaaaaaugugcuguggaaaguggggcauucagacaugauagggccccuauucccaccagacccaggggcagaaaacugggugauuguguguuuaggugugauuguguguguauuuggaggugggagggggcacugucuauugugggacuaucaguugcagggcugaguuggaacagugugaugucaaaauauguuacagaaaaaucucuaaccugagcaaauggcaauucagaucucugcagagagagguucagaugaacuuuccuuuucaccugcucuuuucuuuucuggauaaccagcuguuaucuugcuccaauuuuaauauucaguuaugcagaguguucuuuauggaagcuuggaucaucacacugaugauucaagugucaagccaagcaaggcagcaggcacaaaauuaauguuugcaagacagaaccaggggcuccaaggcuagaguguagcugccagccucuuuccaugcucagugcugguccacagucuuccacuuuaggugaaugugugagucuuauuauuauggcaagcaaucacaggccugguguacuguccagcuguucuuggaccaagggugcuugcuucucucucccucucuuacucuuccuucccuccccuuccccuuccccucuccccucuccucccagauucccccaucugcuggugccacucuacagagaggggacaaauuggugagggacuucccagggaggggucauuggguuuuagcaggcuggucacugagcuagcggaugaccagaggugcagagguauauugugguggguaguggcuaggucuuguuuuuauuccaucucuguugguauuugggcauuuggaggauugagagccuugaccagaaggguguggcuugcaccagguuuauuuauuuaaaaagccauugggaaccuaucucacacaccaggaauaugaaucauguagggccuucaaggaguucccuuccuagauagggagcuagauggggacaaaaauaauaagaggaggagaguagaggagaaacaguccaccucaugguucucaaguggaauuugggguuccauugaugaccgcauuaaaguaucuucccagcaggacagccaauagagggucuggcuuagacccacccucauaucaccucucugagggagagauauugauaggccucuugaauggcgaauauugaagcccagagaguaccuuucuugaggcucccauuucauugucuuagcagguucuagauugcagaccuacuuuguggaugugugaggcuccuauucugagauucugaagccugagcaugguucugcaggcaauuuaggaagcuuuggaugggaggugaaacuucagguccacuuuucagucucagacaaaaugucagugagagcccagacuaauaugaaacugaagcuugaauccaacagagcccugugaggacucaauggacuguuuugccagaugguuuucaaaaauucugugauguuggagccaacaucccuuuugccuuucuugucucucccuauccucauccccuuugauaauugauaauaccucccacagccaauagcaccacuaggccuuucacacaacugcaggucccccugcccagugguccccugagcuuaggauggucugaagggaguggacccagcaagaagguaggggaugaaggcuucuuguugcucaguguagaguuuugcuuccuuggggcccagagagagcuggcccagcaagccaagcauaucgaguggauuaagauuugccccacauuuuccaucauuuucuuucuuguuccacucaagccugacguccggugaaagcaaacccagccuggaugcuugcucacuaguaucugucucucugucuuugucucuccuaucuccuccagaccccacugugaugcuuccugacugauaauguuauaacagugccuggaagccugaggcugcauuuccagcuggacguaccucaguuguccccaucaucauggagacccaaaaggaugaagcugcucaggccaagggagcugcagccucugggaguacccgugaacaaacagcagaaaaaggagccaagaacaaggcagcugaggcgacagaaggaccaaccucagagccauccucauccggcccagguaggcugaagaaaacugccaugaaacucuuugguggcaagaaggguaucuguacucugccuaguuucuuuggagggggacggagcaaagguucugggaaaggcagcuccaagaaaggucucagcaagagcaagacccacgauggccugagugaagcagcccauggcccugaagauguugucagugaaggaacuggcuucucccugccuuugccugaguuacccugccaauuucccagcucucagagugcccauggggcuuuggagacaggcuccagauguaagacaucuguggcuggagccacagagaaagcuguggcugagaaguuucccucuaugcccaagccaaagaaaggccuaaaaggcuuuuuuagcaguauccgccgucaccggaagagcaaggucacuggggcugagcaaagugagccaggggccaaggggccugagagggucagagccaggccucaugagcacgugagcucagccccucaggugcccugcuuugaggagaccuuccaagccccuagaaaggaaaaugcuaacccccaagaugccccugggccaaaaguuucuccaacaccagaaccuucuccaccagcuacugagaaaauggccuguaaagauccagaaaaacccauggaggccugugccucagcacaugugcaacccaagccugccccugaagccaguagccuagaggagccccauagcccagaaacaggggagaagguaguagcaggagagguaaacccacccaauggcccugugggggacccacugagccucuuguuuggggaugugacaucccugaaaagcuuugauucauugacagguuguggugacauaauagcagaacaggacauggacaguaugacagacagcauggccucugggggccagagagcaaaccgagaugggaccaagcgaaguuccugccuggugaccuaccaaggagguggggaggagauggccuugccagaugaugaugacgaggaggaagaagaggaagaagagguggaauuagaggaggaagaagaggagguuaaggaggaggaagaagaugaugacuuagaauaucugugggaaacugcccaaauguauccacggcccaauaugaaccugggcuaccaucccaccacauccccaggccaccacggcuacaugcuccuugacccaguuaggucuuauccuggccuagccccuggggaacuuuugacuccucagagugaccagcaagaauccgcccccaauagugaugaagguuauuaugacuccaccacaccuggauuugaggaugauucaggugaggcccuggggcuuguccgcagggauugucuaccccgagacagcuacaguggagaugcccuauaugaguucuaugagccagaugacagccuugagaacucuccaccuggagaugacugccuuuaugaccuccauggucgaagcucugagauguuugaccccuucuuaaacuuugagcccuuuuuguccucccggccaccuggggcaauggagacagaggaagaacggcuagugaccauccagaaacaguuguuguauugggagcuucggcgggagcagcuugaggcccaggaggcacgugcccgagaagcucaugccagggaggcccacgccagggaggccuauacucgagaggcuuauggcagggaagccuaugccagggaggcccacacuugggaagcucauggcagggaggccagaacccgagaagcccaggcccgagagguucguuguagagagacucaaguccgagagacccaggcccggcaggagaagcccgucuuagaguaucagaugaggcccuuaggcccaucagugaugggccuggcagcagggguaucagggaccucucagauuucccaccggggaauuaccucagcuuuccccaccacugcaagcagcgagccagacuggagggacuuccguccucuggagaagcguuaugaaggaaccugcuccaagaaagaucaaaguaccugccugaugcagcucuuccagagugaugccauguuugagccagacaugcaagaagcaaauuuuggaggaucucccaggagggccuacccuacuuauucacccccugaagauccagaggaagaggagguugagaaggaagggaaugccacugugaguuucucacaggcccugguagaguucaccagcaaugggaaccucuuuuccagcauguccugcagcucugacucugacucaucuuucacucaaaaccucccugagcugccucccauggugaccuuugacaucgcugauguggaacgggauggggaaggcaagugugaagagaauccugaguuccacaaugaugaagaucuugcagccuccuuggaagccuuugagcugggcuacuaucacaaacaugccuucaacaacuaccauagucgauucuaccaaggccugcccuggggugugagcagccucccucgauacuugggacugccuggccugcacccucgaccuccaccugcugcuauggcccucaacaggagaagccgcucucucgacacugcagagacccuggagauggagcucuccaauucccacuugguccagggcuaccucgagucugaugagcugcaggcccagcaggaagauucagaugaggaggacgaagaggaggaagaaggagaauggagccgagacaguccccuuucccucuauacugaacccccaggggccuaugauuggccugcuugggcucccuguccucuuccaguggggccagguccugccuggauaagccccaaccaguuggacaggccuuccagccagucuccauauaggcaggcaaccuguugcauaccuccuaugaccaugucaauaucacuaucagugccagagucaagggcaccuggggaaucugggccucaacuagcucgucccucacaccuacaccugcccaugggcccuugcuauaaccuccagccacaggccucccagagcaugagggccaggccucgagaugugcugcugccuguugaugagcccaguugcucuuccaguucuggaggcuucagccccagcccucuaccacaggccaagccugugggcaucacccauggcauuccucagcugcccaggguccggccugagcacccccagccucagcccacucacuaugggccuuccagccuugaccugucaaaggagagggcugagcaaggugccucucuugccaccagcuacuccuccacugccaugaauggaaaccuagccaaguaguuauuaucaauucuggaguagggacacggggccugagcaugugaauggggaucagggguugggcagaaggguggggggguggggguuguuguuuaacuugaaaacccuuugggccaaggaaaacuccugugaguuuucaccuugguuuucccacuugccucuucugccaucuauggccacguucaacucaagugcaucugcccagggaggcugcugcugcuacugcacuccaguuuuugcuuucgagguuucuucuugugacccacgcuggguuugggaugcuguaauuuugugccuauuccaguugccaaguuagugauuauauauauauauauauauauauauauauauauauauauauauacacacacacacacacacacacacacacacauacauacacacacacacacaaacacacaugcacacacauauauagcaugcauccuugacacaggcuaaaccuuuagugcccccugccccuuucccccaaugaaugaugaaccacugauuagcagccaagucugcauugccucccgcuuggggaaguggggcuuauuugcuauuagcaaugugaaauuaugguacagauccuccccaccccuauuccuuuuggccuggcauagcugccaucauuauaucagaugacuauaagcuauucaucccagcuagcuguccuuagagaggaucaaguagcgugugucucacagccuaucgcuguggacuuuggcaucaugaccagaugggggccuuuuaacuguccugccauagcuuggguuaaagacaaaaaugcuaauccccuugauggagugauaaaauucauccauuugcaaacagaagacaaaacaagguucuguuguggacacugccauagaguguugagcuccggaaugauaggauuuuuuuuccuucuuuuaagcuugugacuaccugaguugcagaugcuuuugaauuuuuguucuuuuuuccucuaaaggaaauuuucauaaucucaucacaaggaacacggucuuuuaauugagauaagggaagagaagcaaccuaaauuaggcuugacuauaggggcugggguuuuuguggaguguaggggaaagauagaaaaugaggguccauuuaucacagccagcaagaaaggggauuucagaccaugcagagcuuaagguaucucaguuucuuaaaagggaaaacucccuucucaagccucccaacacaaaauguuccuuaagccuugcccaucccaucauuuggacucuguaauaaggccccagguuugcacucccaagacaggauaccaaaggcaucucagcugcuguucugggcccuuuaaagagcuuuuaucuuccaauuagccgaguccuuagcaucaucaaaugacagggcuucuuggcaguugcagcccuuuauggaaugaauggcacccucccuucuccugcauccaugcaguuuucauguuaaacuagguuggaaauacugguggggaagagcuugcugucaggaagacauuggaacaggcuaaucuugccaagcucaaccucucauuaaucaccuguaggagaggguuccuuuuacaugucuuuauuggaaauggcauauggaacauuuuuugcuuggcuguguucacucaaauuaugauuauugcacccucgcccucacaucccaccaucuccaugccuguugagagaagaagucaacaggguucuugccauuccugagauauggcaauuuagcuugggaacagaugcuguuugcccccuaagucaaggugacuuugugggcaaacuguuucuuggccaggggauguguccaugcuggucuuugucaccauuucucagauugggguuggcccagugcccuuacucacaaauagcagaccuggcugguagaagcugcaccccuggaagcaccacaugaauuugcauggcacuaacaccaccacucaagggacccagaccagcucuucaggcugacuuuggcuacagauacauugugaagaaauguaucuguuguggagcuggagaaugaaagagggugaggaaggcccuccuuaccccaagcacagcauuccaagagagaagugcccaaauuccaacuuucuggccucuuaccaaagcugcucugggaugguggggcugaaauuggccuggcuauuuggcaggaaguaaacacucaccaaaugccuuuacaacagggaagaacccaccucuugccucuucuuucagggcagcuugagcuccugucuacauguggacugugccagccacagcaggcgguagagccaucaccagccuccagacccugcuggagaagggccaccagccuaucugggaagagaaaaaggagguggccaaccuuuggcuaagggcugagagcugcccucaggaucaggaaggcagcaugaggcauugucucugaggggcacuggcauagcccugacacacuuuguugggcuuuggaaggucacacaccacagaguagggccuggggcugagugagaguucaugguuuggacagccuugcugccugcaagucccuucacugcccuagccagcccaggaauaggauccuuaccaccugaaguggggcagccaggauauguggcugcagaagcagguuccuuugaauuucuagagcuaagcaguuuguggcugaaacccaauggcagccuaggggaggaaggaagaccugucuggggacccaugguguugacagcacagggugacauugggagagccagccaagcuucaggccuguuuccaaacacagacuagugcuggcuuggguggcagcaaauacaccccagaccacuaaaacuguugauaucauguccacaccuccaagaguacuacuagaugaacaacaugucuccauugcaagguccuggaauaaugcuuuuggaugugauuuuaagggaaaaugggacuuaguggaaguagcugccuucaucuuauuacccaauaggccuagugccagacagcugugauccugagaauucccagaugagacugguccuuggaggaccagugaauguggauagagaaggccaccuaguaggccucucccagggccaggaugccaguuucuuggugcuuuagagucuccaaggaagcacugccuuggggcccaguucaagccagcccuaccuaucuggccucagcuuggguaccaggccacaagacugcccggauaauggguucaguaaacaccagucucucucccuccuuaguccuaugccaagaagggaaguagcuucacacacucaggaggcuggguguguacccuucauccugcugccagcagcuuuccuuaccugugccagugccaccaccccaccugcccucagcccccaggcccaguugcuagagggaggcaugggguuuagcagggagacuucaaguuuacccauguguauguugcauucaaguuguuuuuaauauauauauauauauauaucaaaagucaauuaucuauuuuuauauuguuugcauuuuauauucauggaaaacaauguuuaucaauuguucuuuucugauuuauuuuuaagcggugcuguuuacaguuuuaaacaaaacaaagaugacacaaaaauugcugcugcuugugcagagggcuggcaucucaacugccuagggcccucccucuuuccccucucccuaccuuagcuguaccacacuguccguucccuccccccaugauagggacagcagaagaugcccagguacugaagacaaacgccaagugacucaggcgugugggaccugguagacagcuugucauuuucuggcuuuauuuuauguuuuucuuucuuuugaacccuucuuccccaugucuagacccucugagaguacucaugugucuuauuuuuuuuccucguuauguuuugugcuuuaguuuugaaaucagagugcccauguugugcuauuugucuuguugaguuucuccaaaggagcauuuugggaacauucuccacccaauggggaaggaaggggguuucaaccauguccccuuuccccaagaagcugugggagacagaugacaaugaugcuugcacuaucaggaauuuaccaucucguugaggaaacccuugcauaggacuuccuaggagcucaguugauugugacauuuucccagaagagaggcuuuggggaacuccuucaccccucuugcugcuuugggggaaucuccuccccuaccaccauucccccuccccugcccugcuccagcucacacguggaugguacuuuggggaacagugacuuucagggugauggcuugcuggccugaucccugacuuuccaauccuauagucacuccaaagaagaaaauccacaugguauguauaugugugaggguugggucuauugagaggugggacuuuaauuauuguuauuauuauuggugcuuauuuuuccugcuguauaugggggugggggugggggggaauaaaacaggaauguauauuuaggucauguuaaauaaaauggcuggaggaaggagggaagaaauuaggaacugcaguacaucaucaccccagguguaagaguuauuucucucccagugcagaaaggggaguguggccccuggcuguaccugagcuuccucuucuccaucccugagacaucacagaaucacccggguucugaccucuccacuucuagcucucacugacaucuggauaucuugaugcacugccuguuuguaacaacauauacuucuuugcugaaugcuaauaaacuucuggguucaagagggaaccccucagucacuaau

SEQ ID NO: 21577 - RNA, 1505 nt, Homo sapiens
ugcuuuuuaaaggugcuuuauuaacuucacuauaaugagcaucuuuccaugcaauagguaaaauucuucugcuaacaaaaaucuuacagacugguucaaaaacacaauauucaauuagaagcugguaauaggagacccacguaaacaagugacagguaaagguuuacaacaagggcacaucaugaacauguaaauucgaaagcaggggucuguuuccguaauaacuuuagggaaaccaucaggauucagggcauaaggcaaaacucaucaugauggucauggugaggggggucagugcugacugcccgcagacuaugacucaacugcuuuucccucagcuuuuccaucagcugucucaccuccuccccaauccuuuccauauucucuucucucauccuugccugugguucuccaagccuaugcaucauaucccaucuauacugcaggaugggcugccuaacgcggaaccgccuacgauuuccucuaggcacacaguauucaccagcauccaaagggagggccaagggcuccccuuuauuagcaacuugcuccuuuucuucauuuucuugguuggcauuuuccaugcugagacuguuuacugcucguuucucuuuggacuccauuacuccuaggagacaaaaggagagagaaggggcugaacagcuggugaacgcuucaguaccgaggacagaggcacggcuacucauuuuucaggauuccgcgucauggcuaucaacauguuuuguuuuguuuaauuucacguuucccaccagagagguuucgugcgcccacuagggggcccccauucgagcccgcccccccccccaccucucgugucuuccccuaccugcccccaaacccaccauuuucccuacagauccaucccuagaucucggcaggcaccaaaauggaggacgggagaugggggaguugggaggggaccucagacuggacucugcacccgcccccaccaccgucccucgcacugaccugggccuauccuuguagucuccuccuucucccgauucucgccacgaggugcgccgccgggacacuuggccccgcagaccugcagaagggcugggguguggggagggggggcugcugcagcggaacgcuagcuccuucuccgccuagggcccuccucacugccagcgccccgcgucucccgccccccgcucccacccucggccgccucgccccccgugguguucaccguuuuccugcaaggacucgggaaugguuuuccaucgcucuugguugcucugcugccccuggagccccagccgccacugcuuccccaccccaggggaccacuauguucccaagaauguugggguguggagaaagcuggcggggauccccugcgcuguucugcgcucgucgggggggucggugagccucugcuggccuagccagggcgcgcgggccccggggcccuuaccugguccgcuuucccccgggccggaugccagcccgccgagcgcagggcagcggggagcugg

SEQ ID NO: 21578 - RNA, 10511 nt, Homo sapiens
acucaaucaacaaguguuuauugaucaccuacugugugccuggcacuguuacagauagucugggggauacagagaggucuaggauauggcccccacccaccgaaggguuuacaauauacuugugagaucggacacacacacacaaauaacgaucaaucaaaaauugugaaugcuaagcaucaagaagcaauuuauacauugaggguugggggagggagggguaggagagggauggagugaucagagaaggcucaaugaaggaggugacgcugaggaaguucuccaagccugaggaggacuuggcuaaggggagacggccuuccagguugggagagcagcuggaacauggcaagaagguggacaugugaaaggcauguuacagacaacagaugggcccucucugcugacaaugagguucgaggaggugugcuggaauuuuucagaagccagucaugccuagacuggugagggaaaauaccuuugguguaugaccccucacucccacuccaggguaaagggaacauuuucggaccuuagagguggaacugucuuccugggaaccauucuccacucccaccucagcugcaaucccaggcagcagugcagcuaucacucagaucauggacacagcaccgugggcauggauaugccaugcuggagcccuuagaugcccucuagccacucuggagcaucuuccgauggacagugggggaaucugaaggggcucgcuuggugcuauggucuuucagaggcucuguagugcucuguggguggacccugggggggccugaucucauuugagcugauuuuccauuacgccugaagaguuucuagggggcugccucucacuggcagaguagaaacacccacuggagccaccacacacauccaccuggcuucuuagacaccgucaaggaauggugucuuccucaguaccccacagcucccacacugucaucccccagccaagggccaucccuagaaaaacugguuuacuguuccuaaggaaaccauugucuauagcccuuagccuugugguuuaggcaagaggccaggucaggugcccuagagugaggcaggggcuucagccaaaguugugaucgcagcuucugaggcaguuccucaguggagucagaguccgcugccaccugagcuuuccaccagaucuucuuuccuuuccuugugcuuuccucaagcugcaggcuugaucccagcccacaaauaugagagaauucuggaaagugcccugagaaauggguucuggguuuuuuuuucauuuuuauuuuuuuaaaugucccaggcugccuuccuguccucccauccugcauccugcuuucuguucccuggauaccguaggaugguuuuauuucaguucaugcacaaauuagucuggacacuguggagucauaacaagagugggauggagguuccagggccaaucaguuucuuuggagggaagcuugagaaguagguuagagcaaugcccacaaaagccacugcuucuccuucccauccccagcaaugagcuaagagccaaccucagccagagagagggucuuugaucacagagggucagucagugggaugugauuaguggguuuggggauggagucccagguaaaccagagggcaaagggauccucugaguccuggcuuaagggaaugggguuucaaguugaggguuggggacuuagggcaggggagcagcaaggugaggaaaacagaaaggcuggcauggcgagcauccuuggcaauucaaccugcaugcuguuacacuagcccccauuucugccuuugcucaauccaauggccaaagucagucuauccucagcagcaccuucugacacgauccagugguagugucccucaccuguggcccucggggugcuguccacuguuuuucacagacccagccaccccccagcucuggccccugguucuucacacauacccugucaggcuguaggaauugaacucacucuugacuuugggagguugaccaggccuuggagagcuccuuguggcaagagguugggcuugguaggcaucguaguaguuggagcgauuucucugggaugagcaggaaaagcagaggaugauuccagcuaucagggagaacagggaagaaauaaugcccaaguaaagagccucuccaaucucaaauuucaugcugucaggcaccaguggugaguagaagucccguaggaucccaugaagauuccaggcaacaggaaugaaucccaggaggccuccaaggaugaaaaagacuccaccugcuaccgccacucugucuuuggcucgggauuccuggcagaagacugugcaucucaugcccaccacagagauaaugcaggccagggaggagauugcacuggaugucaccaucauggccugggcagccuggaugucagcgggcaggcccagaagggugcuauagaugucacacugggugaugccugugcuguguguggcacauuccauccagaggcccuuggagaagccaacugcugucacaaugcuggcaccgacauaagaacuuguuuuccagcuggggagcagcauggcaaccagugugcccaaaagccccagaaggccuaggauguagcccacaaguuggaggccaagagaggccauggcagaccucucaguagaagcgucuucagggacugcucccuugucuucaggcugaagcucuugcuccuugaacaccucuaaucccucauuucagagucucucugccaggcugacuucucuccuccuuacaagugucuguggguggccacaagcagccucaagaaggcaucuagaagaccuaaaaaaaauccauaaaccagauuaaauauugaccagaagcuuaugagaaaccagaaaacgcuggaugccuuuugaccuuuguuaucuuuagaaauaacacaugagaaaggaaaaaaaaaacaacuuugaacguggagccaaaaugucaucgccuccugcguaggcacaugccuuagguuggcagcuggacaaagccaggagccagacagguggcugcuuuccgggaaggugaugauggcaguggugguugugguggcuguguuaacucaagugcuagucuccaaggccugcuguuuaauacauugccaagcaacagugccauagggccccucaauugcagacugaggccaaacugcagacuacaucaggaggaacagauccuagaauguagucuuggacuccaguuuguuagaggccucuugaaucuccaggggccuagagaguaguggccuagcccuggaucauucugcccauggugaaaaucuacuccaggguagaugggggugggcagcaaagccuucuguccauacucugagaguucagauccucccagccaugcccaaaucccccucugcagccuagucuaaggccuccugcauguauaacaugcccagacauuuccuguccagucuccuaauagaugcucccaucaucagccucuuggaugaugagggagcacucuggaacaaggguuccaggacugagagggggcccugaaauucccugggccaucuguuaggggggacaagagucugccacagaggaaagggaaacugcucuagaauauagggcuuugcaugaggcagguaucugagucaaugcuuuggaaucucagagccauauaagauuuugccguguucaaggagcccucgguguugccaagauucaggacacuaagggucaagggcacaccuccccauucucuacaagacccucugauccacuaauuuuucuuucuuucuuuuugagacagguucucacuuuggcacccaggcuggagugcaguggcaugaucucggcucauugcagccucgaccuccugggcucaagugauccuccugccucagccccacaaguagcugggacuacaggagcgcaucaccacaccuggcuaguuugugugugugugugugugugugugugugugugugugugugauccuccugccucagccccacaaguagcugggacuacaggagcgcaucaccacaccuggcuaguugugugugugugugugugugugugugugugugugugugugauccuccugccucagccccacaaguagcugggacuacaggagcgcaucaccacaccuggcuaguuguguguguguguguguauuuuuuguagagaccagguuuugccauguugcccacacuggucuugaacuccuaagcucaagugauccaccugccucagccucccaaagugcuaggauuacaggcaugagccaccgugcccgaacuaacccacuaauuuuucaacccaccacaaucuggcuauuccauuuuagccuucuucaagauuucucuuucccuacucaucucuuaaaugugaguauuccucagaaguccauccuuuucucaauuaacacucugucccugagcaaacucaucuugcccccauaacuuaaucuacuacccauccacugacccucccaaaucugaauuuccaggauagacccuucugagcuucaagacuggcagagcaaucaccuagucagaaucuccacagggaaaucucauagacaucucgaauuugacauguccaaaagugaacucaucacaucccccaugcagcuuuccccaaacaguucuucccuguguucccuguguucacugaaugauaccucuauccauccacuugugccagaccaaaauccggaaagugaucuuuagcaccuuucuucuacuuaccuccugcauccuauagucccuaugucccaccaguucuaccuuaugaauauaccucaaauccaugguuccuuucucuccauuuccacugcuacuucccuaguucaguuucaccauucuuuuuuugagaccgaauuuugcuuuuguugcccagccuggagugggguggcgugaucuuagcucacugcaaucuccaccucccagguucaagugauucuugugccucagcuuccugaguagcugggacuacaggugcacgccaccacgcccagcuaauuuuguauuuuuaguagagacaggguuuugccaugcuggccaggcugaucuccaacuccugacugcaagugauccgcccaccucagccucccaaaaugcugggauuacaggugugagccaccaugcacgaccucaucauucucuuucaccuggauuauagcaacagcuuucuaacuugucuuucucccaauucauucuccacaucauugccaaggugaucuuucaacacauuaaucugaucgagucacuacucuacauaaagcauuccaguggcuccccauuugcuaaaaaguaaaguccaaacuugcuugguuuaccccaugaccucucaagcuucaucucuugccauuucccuccucauagucuguacuauuguggaauuaaauuacuuccaguucuucaaucaugccauguggucuuuugcucccaaauagaaauagaacagaauauucuaugcagaguguuauguauucuucuuccucuguuuagugccuucucaucuuuuaggauucagcacagaugucucuuacucuagccugggucaaguaccccuccugucuauucuuacaguaucuuguguuuacuuccaucauaguaauaauaauaauagcaacacuuauguaguguuucuuaugggaccauuauaagcacuuuuuacaugcuaacuuauuuagucgucacagguuuuuuugugguaggcacuaauaaucccuauuguauagaugaagaaacugaggcagagauaguacauuuugcauuauguugcaauuuccuguuuaaacccucauucuucccuauuagccugugagcuacuugagggcaagacuauaucuuauguaucucuguaucucaugugccuuacauacugcuuuauccagagcagcaauucaaaaacugucuucuuaauaaaugaaugaaguuggcaaagagguuugaggggcuccauaugacuaaaauauagggacuuuccaaaugagucaauaacgcuucaguguaagggucauugaagugcugcccaacguugggaaagaagaaagagagagaugggggaucagaggaagaaagagguaaggggggagagagagacagcagagcuucacuauguauauauauaauguauauuauauauauuuauaauauauaugcauuuguggaauauuuugucuccucaaccaaauucuaaacaauuuaagggugaaaaaauauauauuaaaugucuaucaugcuuccacagcauugggcacaugauugauagucaauacgauucaucagcauuggaaacaccaaugccaguguugaugcaaagcagugcagagcaggagccgauaaacauuugaugaagggagagaaacauaguuugaaucucaccucugucacucauuagcaagucuuucuugacauugguuucuuauugcuaaccuuggcacaauuguaccuguccugaucaugacuauguaucucauugaggccuucagugcugcuuggaaauccuucuacuucucccugguaagcacccuucugaugacugcuucaaacauuuacuacuacuuuuugagcucccuacucuaccuccucccugugcagcuauuacuccuaucuugaucauucucuuugcagccaagauccuuaaacaagccauucauuauugaugucuccacuucuucacccucccacucacugcucagcccucugcagucuggcuuccaccauuagcccuccacugaaaauauucucaccaaaguuaucaacucuuuucuugauccaaaauucaaugaucauaucucugucaucucaccuugucucucuccuucauaaaacuaucuucucccuuguuuucuguaacaccacuccauuuuaacuacuucucaaaaugauucuucuaguuuucccuuauaaguuccucuucuucugcucacucuuuaagucuaacuauccaucucugccccucuagccuccucaggguuucaucucgacuucuagauggcucuucuuauccuucacauucuucauggguuaucucauccucucugucuccaugccagugacuccugaauucauaucucugccacagauuucucuccugaacucaagauuuguguaguuaacuauuacuuggaauggcccuaccugaauguuuuaauggccucaaauucaacauuugcaaagcuggaaucaucugcccuuuuugcuccccaugcccaaacugcuccucaugcaguguuccuuaccucaguggggcugucacugaguuaauaacccaagccagucauccuugcuuuuucaccucuuguugacauauaauuaauuauaauguaccaucaggucugccuucaaaaauagacugugaauccaucuacuucuuucugucgccacugcccuaaaccauaguucagacuaugcaaccaucguuucuugucuauuugaaaaucucauagacaccucaaauugaucucucuaauuccacuucugccccaauccugcaauaaugaauuaccuacccaguagucaaagaucuuuguaaaguugaaaucaaauugugacuuucaccucacgcuuugccaugcuuaaaaaucuucaggagcucagccgggugcgguggcuuacgccuauaaucccagcacuuugggaggccgaggcgggcagaucacgaggucaggaguuugagaccagccuggccaacauagugaaaccccgucucuacgaaaaauacaaaaauuaguugggcgugguggcaugugccuguaaucccagcuacuagggaggcugaggcaggagaaucgcuggaaccgggagguggagguugcagugagccgagauugugccacugcacuccagccugagcgauagagcaaaacuuugucucaaaaaaaaaaaaaaaaaaaaaucuucagagcucuuaaguauuucaggaugaaguucaaacuugcuagcccaggaaaccaagaaagcccuccauuauuucaccccggcuuuucuucacagccucaucucacaccauuaaccuccaaccucaugcuuuaugcuccuauacauacacauaugauccagccaaaccuaagcacuugaauuucucugacugccuuucucucugucuccaagcccguaagcaugcuauucuaccauccaccauuugcuuggauaauugcaaaucaucuuugaggaugcauccuugccuugaaaccauccuugggcccucccugcuccucacccaggcuggguucaauacuuuuccuuucuuccuccuauuuguaucugagcuuucagugagaauuggugagauaccuugagguuuucaaggggaagaccuacugcuucccagaggagcagcuccugcuucagccuuccugggauggcagcugaagagucaagcuugaguuucccaagggaaucaacaguguccccaagaggaaagccucuccccagagccuguccuaaguaguaguaaguaggcaaguguuuuggggugagggagagggcagagucaagaaaaugccauuacugaggcuuggaaucucuagagucugacuuggcauagcagcaugcccaggcaggaggaagaacaaguuauuggagcuuauucaagugauagaaauggccccauggaggggggguucagcuuuccaccagaguuaggaagaccagcuaaauggcgaaugguuggguggugagacaggcuggauucagccagguuuuuguuugucugaugagcaguagaggugagggcagacaggguccugguguuagaaucaaaagaucuagcuucuuguugugucaguucugccuagaaccugcugaggaaguccuauagcuucucuaggcccuaguuugucaucuccaagauuuuuagucucaaauaaaggcauggggacaggaagccacuuugacaaauauagaagacugaagagcuguuauuagaagcagccaguuuuaauagaagccucucuuugagggauccuccuagaagucaaguacuggcugcguuggagguacagaggacucuaggccuugucagcugaauuugucuucugggcauagggccaacauacuccauggcccaaggacugggcaagaaaguuuaacuuaggauccuuacuuaaucuucccuaguggggagauuggagcugcaggagaggauuaggagggucaagauugaccgcagcuccugacuuaaccccuucucaccuagguacuuucccugcuauucuccccaucucuugcuccaagagucuugugcaugguacucuuucuuuggcaguacccuccuaagacuacaugggacagggcacuugggguucccaggcucaaggaaggaacugauguggccuucugggggugaugauggccaccacagcccucuucugucagucagccucauuucuauaucccuugaucucacugccccucauaagaaucugagacacuugcccccuucucugaaacucacuuccagcugccaagggcacuaguagguggcaaagccauucccuugaggcccuacuuucuugaaaguuuguccuuagagcaguucaucuuuccuucuacaucaauugauugauggcaguucagagaauugcaacuggauugagagauuuucuuauuguuugaaaaagaaguugauuuuuguccugaucaucaaaguaaagcauucucacuuuagaacacuggaaaacacagaaaggcagaauuuagaaaacaaaaaucgccuacgaucuccccggccauaagugcugugaauguuuugguuccaacugcauuuucaaagagggcacuugaagagaguaauaccucagucgaaagaaggaauuucuaaugacagacuugcagaccagugagggagaguccuugaaggaccucauggggaaacuuuaugacuucacuuaggaacccaccuucugcuaccucccugagccuucaugccaaggagggcacuggagcuggcugugagggagugccccuucugccacuccucaguccccuacacuuaggcagagggguaaacuguggcucccuuccuccaauuuuuaucccaguccuuuuaagcccccaaaccagaaaauaucugauuuggagagugcuuucucugguccugaaguuuuaaagauuugaaccuuugugauagcuuugagggaacaaauaccaccaacccaaaugccaccggaguuuccccucccauacccuucacucagaaacccaagguggcccagccuggcuccaccauggggugaauggauagugacuaggaaggaagagugcccaccucggugaauuuaaaaggcagcaacuauaucaggauggagauacuuacagggcaguucuuugcagagccuuggagggggagaugccccuggagagggagaaagggauccugagggaggggagcgaaguacaaggggccacgggcugaggugauaaaggauuucuaaucguuaaccacagcuuugcaaaauccaucugcaaaucugagccgugggucagagacuuauuacagaucagaauuaaaccccu

SEQ ID NO: 21579 - RNA, 152097 nt, Homo sapiens
cgauaguucucaacgcaugcgggagccggccgugguagguuggcuccgccccucacugcuucguuagguugugcgucauuugcuuuucgcuucgcguagggugaagcuguagcuacuucggcuuuggugggagggaggaggggucuggaaagggcugggcucaggcuuuucccguccgguagagguucucgcgggaucgcgcggaggcggcgguggcucgguuacugacugcaguagccgcggaggcggcggcaaggucuucggcucgugccguucuaagccggagaauucucgcgggagcaggguuacguccucgugggauucguuggcgguggcugagguagcucgcggguggggggugggggggcagugacuagggucgguccgccugcuguuaagauggcggcggaggcugaugucuguccggccaggacccagcacagagguguuggcuaucugccuuuaugacgccucugaggugcccagcguuaaggaggugacgauuggcgaaacgccggggugccgguaaacuagaccugaggcgaagaccaccucguuucuuguccguugaggcgacaccauuuccugggccucggccgcgugugggcccgccuuugccccaccgaucggucaacgccuccguugucgccgccgcagugggcggauugggaagggugggaggggagucuggaguucgcuggggagugggguuggggguuaaauugaacggugggaaagaggagcaaccaaugaagaguggccccuuuccccuaccuuuucugccggccaaccuccguucucagcaccuccgacgacccggaugaauacccugguuuuucucgagguggggucaucuucgccaacucucgcgguuuuagagcuaaggcuuaggguucaagcaguagugucacugguguacuccuccuccucuccccacaccccuccuaauucugucgucccaucuaaucuucaucuacguggauaguugaggcugguauuuaagggaggggggagucaaagcuuuucccugugacuccuuccccaguucuaaauucgaguuuagccuaaguccucuagcccgcucugucucccccuuccauugguccccuuggcgcaggcguugaauagagcuuauccuguugccugcauuuacuccaucuuuguggauggugccauaguagccuuccauuuccuuaagucuucauguuuguaugacucugauccggauuucuuagcucugcaugcugcuaaaccacuauuaagcgaaacuaugaacgggucgguguuuggauauugcaguuuaaguggccuuuucguuuacggccauuagccuugccuuccucauuccucccccucagaaggcuguagaggauaacucuccaguaaacccgcuuucugucuucccugccucuuccauuuccccugcaagccugggaaccgccccuuuucccugccuugcucugaguuucuggagccucuuggucuguggacaucuauuuuugcugcugagcaccucuuaccugcuucucacuucuuaaucuuucuaucccccacuccccauacuccuuuuccaggagcugaaucccuuagaaggaagauaacccuccucucaggcuccacuacauuuuaccccuuccauuuacuagaaaacagcauugauuguccugccccccagucugcccuguucuuuauuuccucuuccccccaugccaccguuacuauaggcaguuaauucccuaucauuuguuucuccuuuguagauuacauguucagcauuguuuucuuuuagccccaguguugcauagauugaggagauaccaacauuccccagucauaggcggcggucugguauggugaaauuaauaguguguguuuuggguguguuuuggguucacauugaaccuugugaccuugggcaaauuuucagauucucaguucaucuauauaaugggaauaguugugcuuacauuagaggauuguugcuagaauuaguuaaaauaaaauaaaauaaaauguuuagcucaugguaggcacauaauaaauuaggauuacuuuuugguguaagaaugcauugguagauguaccugugucauaugcuaauuuuaugaccugggaaagaguaagagauuuuuguuucuuuaacuguacauucuugguguauuucuaggccagaucuauaacguuuauauuuuuuuuccucauaggccaaacuuuuuaucuccagugguucaugauguuugaacgugauucccacucuuuguuuccuucuaauggucuaggaauuucagugcguaaucacuauccuggaaugaccaccagccauaauguuccugucaagaaccacacccaaguguucuaccuuuuggaaggggugccucaugcccugccuacucauuucuuccacuccuucaaaggcagucuguccugucauucacucuacaaaaguaauuuggugucaugcauuucacagugguaaaaggaacuucuguuagcuaguuuugaaguauucaugcuacuuuucaccucccucauuuguuugguuccucagaucaguguggggaucugcuauuuggcaucuucuuaccugagcaagauaauuccuguccgagagagaaagaucauuuggaauacccagcuucuuuuccauagcaaauuacugcuggcucuuuaauacacuacuuccuguuguguuauugccauuuuauauuuucuaacguacuuauuaaacagaugugacuauuugacuuggagaaaguuuuccuuacuuuuuuuuuuuuuuuuuuaagauggagucuugcucucgccaggcuggagugcaguggcgcgaucucggcucacugcaaccuccgccuccuggguucaagcgauuuaccugccucagccucccgaguagcugggacuacaggcgcgcgccaccaugcccagcuaauuuuuguauuuuuaguaaagacggaguuucaccacguuggccaggauggucucgaucuccugaccucgugauccgcccgccucggccucccaaagugcugagauuacaggcuuccuuacuguuaauauauugauuagaccaauauuaaaguguagcauuuuacaauuuuuuuuuuaacuaauucuagcaacaacccuuuaauacaagcacaacuauccccauuauuuuacuucggcugggugaugggaauugaaguagaaacguggugaaaaguuuacuaggauuuaaaauuuacaggagguaaccaucccacaauuagcuguauguggacucuaguuucgaacuucagggucugcuuuauuuaauuugaagugcuuuguagguaauaaaauuuucuuccauuuucauuggagggcaggaaaucacuuucuguuuugagauuuugcauuggugcauuuuaccguggguuaagcagugaucacaaauuuauuaaaccucaauuucaauuugacccuuauugagcaauagaauaaaucugggaaugauaaucuaggugugaccuaaaaguuuaacuuauucuagguagaucucugagaagagaggaaggagugacaauaccaaauaaaaacuuugucuaagguucaauggcaaaguucaaccugaguugccaggauguuuaucguuugucucccaauauggccaaaaagcauguaugaaggugaagaauaauuuuuauauguacaguuguuguuuuuuuucacagaaacaaugaaacaaauacguccuuaguguuuauauugaggguauaaacuugucuaaaaaauaaacugucuucuauaauuucauuuggguugagaacucaguuuucaggaauguugucuaagcguuagaaguauuagaguuguugguucugaauuccucaguuacuucucaaagcagguccuaaaaaaugcaaauagauauguaaggacuauugcuuuagaaauaauaacuaguuauguuugaacauaauagaaugguuaacccuccucacacacccuaauaaauguguuguguaucucacuccucucccccaacuuuuuuuuuguagguccuccagcagccugaccugaguggguuagugauccagagaaaccagcaggccaacuuggucaggaagguucgggaagcuguuggagcaguguggggaauuucccaccaggaugaguaugauuggcugugauuuuagguuaguuuuuguaaaucuugugggaaguauuuguauuuuacuuccuggaauggagauaguagggguggauguauucccauucuguaauggagcuacuuugguuucuuccauucucuggaucugaugugguacugguugcuucuuuuuuuaaaguggagcucauuacugaauuaaagggaauuguuuaaaugaaugaugucuguacaugauuuuuuaaaucacccuaggcaucguucaaaaaauaaaauugcaagucauuaugucuaaccaguucuuauuaaaguuacgaaaaauuucaaacaugcaaacauugaauaguauaauaauccccccacuuacccaucaccagcuuuaauaguaucaacuugcacauucuauuucaucuauacuucuguuuguuugguuuuuuuuaauuuuuuuaaauugagaugggguuucaucguguugccuagacuggucacaaacuccugggcucaagccauccucccuucuuggccucccaaaguguugggauuacaggcgugagccaccaggcccagccuguuucaucuauacuucuaaccacugccccccucaauggauuauauuggaauaaaucccugucauauuuauuuguaaaauacuuguuuguauuucuaaaaggcaagggcucuuuaaauauaagaucaaaacuauuaucacaacugaaaaaauuaacagauauuuaaaaauaucaaauauaaaauguucagauuucugauuuuuuuuuaagcuuuguuuuuuuucuuuuacaguuuguuugaaucaggauccugagaaagcacauuuauugcaaagcauugauacagcuguuaaaucuauuuuaaucugcagguucugucuuuuguuuuuuuuuucuuccaauuuauuuguugaagaaauuguccuauauauaguuucccgccccccauauuuggggauuacagcccaguaguggugucuaacccauucuugcucaauuaaagacccuggaggacccauuauaauggaacaauggcuauaaucuccuguauccuaguuggaguugauagugcugucauaggcacuauccuaaaauaacuagucauggauuccuuuuucuguggcaaagucugauuugauaccugacuucaguuccaugucuuggccuugcucauugcuccacaugaaaaguaggccuccugguggaagaagcuaguguuuccuaaugaccugauugugccuuugggguuuuucaugcaugguuucaauuuccuuaggugauuuaguuauuuuuauacuacuuuauaauguugcuuuuuauucuuuugauguuagugucucagcuguucugacccauaacuucuaagcuauuaagaccuaauaaugaguuccuggcugucauacaguucuugaaauggcaauacuaaaacaguuuuugagagcuucuacuuacauguugauuuucagcuauuauacacaaccuuaguuuuccuacugugauuuuucauuucauuucaucugaaauuuauguuuccuuagcauaaaguccuuuaaggacuuuuaggcugcuuuaugaugaucucacuaucuauaagguugauauucauaaguacuugggcuuuugguguuuugcuguauuauucguuguuuccucaacgacugguuacuagauguuuauauauguuaaugucaggaauaacucaacuuuuaagucguuugauguuucauaggugguguuguuaaaacuugauguacuuguugaccagcuuggucuucuggauauagaaauccuuucagguagugaagaaguggcucuaugaguaaaacaacuguagguuuuguuugggcuguuaaccugagcauuuucaacuuuuaaguucucuuuaaaaguuuuuagucauuuggcuuuaaaaauuacaguugguggcauagaaugaucccauaaugugauuuuacagaaaguuggaauguuuuaauuuauuaugaauguaccauuacguggagauugggauuguagaucugauucagucuggauugcugauugaacuagaugaauguuaaaauucuucaacucugagauucugaugguauaaucuuagguauugaaagacagcaguuuuuccuuucaguagucauuaaguaaauggugacuaaaaguagggagaugaauuauucuggaaugaccuuucacuauaaccauuuagauuuaaaagauugaugagucugaggauacugucaugaauuuauguaccaccuuuagcacaauccagguuuuagguccuugugauuagauaucagagauaauugccccagaagugcguggguauauuacauuugguggcuguuaauguuuuggaaugauuuuggaagauuacuuuggguacauuauuugcuaugauuauuuucuuauauuccugucuauuuuauagugaggcauguuucuccuggucuuugcuuuuuuuuuuuuuuuuuuuaaacuuccaauauucuuuauuacggcauucugacaauugaguucuuacagguggaaagaccuuucagcacagcgauuaagaacauggacucuggagcuagauucacagaguucaaguucugacucccauuucuuaccaggugugucauguugugcaaauuacuuaacugcuuugugccacacgguccuucaucuguaaaaugaugauaauacugccugccuuauagaguucugaagaaauuuagcugaguuaaugcauauaaagugcuuagaacaaugguucugaaacuuuagggaacaucagaaucaccuagaggacuuccuaaaagauuggcugguccccacucccagaguuucugauucuguagaucuaggaggggccccagauuuugcauuucugauaaguucccaggugauacuucucuauuuccugcaaauuggcagcuggauccagagacuugauaaauuucagguucguucccuuuggcaaauauauugcgggggggugggguggggggguguucauucacaacauugauuauguuacgaugacuugaauuuuuuggauccauuaauuuguuggggggcuacaaaauggugacguucugaugcuaucauuuuguuuucaucuguuagcuggaauaauuuuguuuccccucaucuuuuauuugguuacucagcaauauaguuuauauaggaagagcaggauaaauacucaauuuuuuaaaacauugcuuucaagaugaugaauugguccccugucaucuucaaaagguuacacauauaaguguauauauaacuaugcauccauagauguaaacauuugauggguuucaauacauugcaguucugauccuuagcgaaguucaaauugcccuucuuguggcuaguggaacucucuuaaaguuggcuccugauucuuacugacaugcucucuaguagucuuugauagcuuccuugcuaucugguaugucaagauguuuccaggcgcauucuugugcauuucugccccagaccuggaauuagcuaaugggauuaagauaaaaggugaagucaaaagaaauucuguuuuugccaaggguagcuuggaacuuucuaucaaguuccacuuuucucuuuccacuuaaccucccuagccugccucuucauucuucucuaccuuuuuauuagaguuaagguggaaagguuugagaagccuugauaaucauaggaagaucauggagcccaggcaguuccggauuuggggccuggccacuuacuaggucugucaguuugggcaaguuaaccuauaucaguuaugauguggggaaauaccuuauucauaugguuauuggaauuaaagagaaaauguaagguguuaguacaugguaggugaucaguagaugguaauuuauuuaauguacuauuuuacuuaacuccuucaacagcucagaggugggcagucaggguggugaaaauaauggccauuuaacaaaaugugucuggacccuuuaggucugugugggaucaucaguggugaggcaggauaggguuuguucuugaguuauuuugggucugagacuuuggccagugauaacugaauguuccauagaguaguuuuucacuuuggaacuccuuaggagucacauuuauacccucugaagggucuuagcuaguucuguaauguguauuacauugguuaccuugaucucucuccgucuauacuggccccuccuauucaagguguucaagguucuguuguaaccuuaguaaccuauaauaaguauuccuaauagucaucaguaucaccacuguuaacacauuugggcagcaccaugcauggcaggucagcaaacagguaaaucuuauuuuuuuaaacauuacacauaauaucuaaaguauaguauguggcauguaauaagugcugcugaauaaauggaagucauuguucaguuuuuagcuuaauauaucuuuuuuuuucuuuuaacauaacauuuacugaauguugcuaaguauaaggaguaagggacauaaaaugaaugagacuuggucucugcccuugagaaacucacagucgaguuaaggacugugaaaucauguuuaaaguuccuuagccuuuuccuuugugucaucauuucuuccccugcacugucuaugcaugauauagccuguccauuguuucucacagcuuuccuaauucugugugccuccccagccuuugagacugcugauaugugagaaagccaacaauugucuucuauuaauacaggguaauaucaagaaaaaccuuugggccaauauuggauuucagaguggcaugugcaguugacauuacaauaccaguuuauggucuuuagaugggccuguacaccugggcuccagccucuuuccugugccuuuaaacugccuuacuuccaucuuuccuccccuauacccuacccuuaauguacuugguacauaaaaauagaggcucccauacccagguagugaucaaguacaauguaaagaaacagcuguacuucauauaaacuaggauucgagugggccuaggguauaucacuaaauuuccauucuuaucuauaaaacaguaaucggaaagccuauuucauagguugcugugagcauuaaagcgagaugauguauuuuuaaaugcuuguaaaguacgaagauaaggucauuauaauuuauauaaaauacuuaguagcuauguuacuuggggcaaauuaccucaucacugagccaguuuccucauccuuuaaaugaagauggugauauucauuuaacaaauauuuauugaggacguagucauugcagcuacauccugggaauacaaagauaagugacuggagaauguaggacaguguggucuaggggaaggagacuugcaaaucacacaaaagggucaguaugguaauaugaggaaugaacaaaaugugcuauagcaguuuacaagaaggcaucagagaaugucacagaguuuuguuaggguuaagcaagauaaaugaaaaguacuucaugaauucaaaaaugcuauacaaauaaguuaguuaaacguaccccaaaugaaucaauagucucaaaccauuauuguuucauuucuucacaagacuuacucuuuagaugcauuuauuucuuugagcuagauuuuaugaccuccuuaaggguaaccuguaguagaguauccugaaaguuaaugcuuuugucuaaaaggauuuuuuucauccauuuuaucauuuucuaguuuuuaaucacugaauucaggaaaaacuagaaaaugugugcauauuuggggagaggauauacauaauuccaccacaauguuuagucacuguuaacauuuugguguauucacaucuuaaugauaaggguaguguuuaaggaauaagaaaagaaaucuaguaggaaauuuuaaggauaggcauuucccagaauaggaaacuaaaaacguccacuaacaagaaaugguacucaaacuaauaaucagaaaugcaaauuuaaauaaggucauuuuuagucauuagauugauaaaaaauaauuugauaauaucaagucaucguaaaagguauaaggaagagucuggccuuauaauacugccuacaaguggcguaaauugauacagcuauuuuggaggcaauuuuggcaaguugcaagagaguacauacuaugugaugcuauuuauguuuuaaaaaaaaccauggcaaacugacaacuuuauuugggaggagggaucauggggaacuuuaccuuuuucuguaauaugugcauuucuacuucugaaaaauauacugagaaguacagagaauaauacaacaaucccugucccuacccccacuccagaauugaucauuuuuaacauuuauuuuugccuuacauuuuuuuguggaguuggaaguaacacaaguugagugucccuaauccaaaauucaaaaugccccaaaaugaguuucaacacgaugccacaaguggaaaauucuacgccuaaguacuuaacacuuuguuucaugagcagaauuauuaaaaauauuguauaggguacaacgaacauuauuugggugaugguuacacuaaaugucuagacuucacuacugcacaauauacccauguaacagaacuguacuugugccaccuaaauuuauacgagaaauuguguaaaauuaccuucaggcuguauguauaagguguguauggaacaugaauggauuucauguuuaaacuugagccgcauccucaagaugucucaugauguauaggcagauauucaagaaucugaaaucugaaauccugcuggucccaagcacuggauaggagauacuuaaccuguauagguaaacaggagauacuuuuuuaauacccagcauucccuuccccccuuacaaucaguacaaugaauugcuugaauuuuucuacugugagaaugguauaaauuaugaauguaaguaaaaguucaaaaccgaugugguggccacacaaaaaccuauuauuaaauaauauuaaauuuguacaguauuuuagaguuuguaagaagcauucugauuuuaguaagaaugcuuugggaauagaacuuuuuuucguuugcucauuuucuuguuaacucuuguuugaaaacguuuuccugaauuuguuuuuaaguaaucuucaugacuguagaauuauacauggcuuauuguugaaaaauacagauaaacagacaaauuuccgcaaaccccaaacucacagauaaaauacucuuaacauuuugguaugcaguaucuucuucgaaggcuuuucuuaacugcucuguagccauauuauauauuuuuucagaaaugcucuuuuuaaaauguaauucauuaccucccuuccagcuuucaauuuuguaugaaaaauuucaaacaaaaaugcugaaaacauagcacaaugaacaucuguauaccaucagcuggauccaacaauuaaguauuugccauauuagauuuauauguacagauguguguuuaauuuuucucaacauuagaaguaaggaugacacuuuauccuuaaaucuuucagcugcaugucuuaagaaugaggacaucucagccgggcgcaguggcucacaccuguaaucugagcacuuugggaggccaagguggguggaucauuugaggucaggaguucgagaccagccuggccaacauggugaaacccugccucuacuaaaaauaaaaaaauuagcugggugugguggcaccuguagucccagcuacucgggaggcugaggcaggagaaucacuugaacccaggaggcggagguugcagugagcugagaucacgccacugcauuccagccugggcgacagagugagacucugucucaaaaaaaaaaaaaaaaguaaggacaucuacaaaaccacaauaccauuaucacgccuagggaguuuauuuuuucuuaauauuaucuaauauccgguucauauucacauuuucucaguuguccccaaacugucuuuuuuuccaagcuguuuucuccaaacuaguguagaaaugguauuuuuaacuuugcucuucccacauauugaccccuguuucaugucuuugucauuauguauacuucuguagcauuuuuaauggcuacauuguauucuauuguaugcagaauuuauuuaaccaguuugcuuuguucacaccuuuugcuguguucauacuuuucccucagguguccccaaacugucuuuuuucaagcuguuuucuccaaacuaguauagaaaugguauuguuaaauuugcucuucccacguauugacccguuccaugucucugucauuauguauacuucuguagcuuuuuuuuuuuuuuuuuuuuuuuuugagacggagucucgcugucgcccaggucggagugcaguggcgcgaucucggcucacugcaggcuccgccccccgggguucacgccauucuccugccucagccuuuugaguagcugggacuacaggugccugccaccucgcccggcuaauuuuuuuuuguauuuuuaguagagacgggguuucaccguguuagccaggauggucucgaucuccugaccucgugauccgcccgccucggccucccaaaguacugggauuacaggcgugagccacugugcccagcuucuguagcauuuuuaauggcuacauuguauuuuauuguaugcagaauuuauuuaaccaguuugcuguguucacacuuuuccagucccaguuucucaugauuuuaaguaaugccuccuaacauacagguaauucagcauucaguaaauaagugucgaaugaaagaagcauagguacauccuaauagauaaauauuuaugagauccauauuuaauauuuuuaauuuuuuauuuccauagguuuuuggggaacaggugauauuugguuacaugaguaaguuccuuaguggugauuugugagauuuuggugcacccaucacuggagcaguauacacugaacccaauuuauagucuuuuaucccucaccccuuucccauccuuucccccugaguccccaaaguccauugcgugacauccauauuuauauccuuaagaaauuucuacaaccggaauguaaaaauguaaggcuuuuaauacucauugcuaaauuggccuuuagaaaggcuaaccuugcauuuuucacugugauauguuuaguauaugauccaucaugauuuacaauauuguagcacaucaggauaagccuugauaaaucagaagaguauaaaucuggauauagccaguaucguuguagauggcucacugcauauauacacguauauacauauacguacguacacguauauacauagacauauacauaucugcugccauauuuuuccaggggcuaguuugacucuucuacuuuggagggcuuugcaguuuguuaacccaaucuggaguccaggccccggcuucuuacauuucuuuaaauaucuuggugagaccagccuuaaaaggaaguauagucuggagagaugcagacaucacuagaagauauccuuuuacguagagaauuuuagauuuuugcuuuuaaaaaguaaagacaggcugcuuuuaugggugaauucagaucucucccucuagcaaauuaccaacagcuuuaaaaggguagucuucauguccaacagaaaagcuggaugauacccuauauuuccuauuauccauaucaaacuccuuauuuuauaggcccaguuguaggaguaauaacauauccaugguaacauggcuggauaguggugaaauugagcaucaaacccagguuaccuaguccaguauuguuuucacuauguuuuaucucuccuuaaaacugaacuuuauuucuaaaugugccaucuggugucaucuguagaaauacaaaguaagugguccucuuccuaugagaaaguuacuccccaaauaggggaauuuuaaaguagaaagucaacgugagaaaggcaaaaauccaaagaaagcucaguuucuuugcccuuuuaaccguaguuacuacuuucugacaugagaucaacuuggagcucuuucauggaacaguucgauuuggccauguguuuucaugcauuuauggaugcuauaaaucaguagaugagacugaauuuccugcuuguaaaacuuuuucaaauuaaagggcugcuuucuaaguccaucuuauuuucccuuccuuuuuucaacuguuuuaaacuauaacauguuugcuauuuuuaaaaagauugaaacaaaauaauaguuuacaccuuuuagcauuauaguuaaguauuacuguguuaaguauauacuuauguuaaguauuuuuauacuauguuaagcuuuuuaugcugaaguaauggugugaaguagguguguacuuuuauuuucauccaaaugguuagccaguagcuccuguuuuucuuccuggcaaagucuauuugaucuuuaaaaauauucuuagcuuaaaagugaauuauuugcagaaguguaguuuuauuuuuuaaaaaccuaggaauuuguggcaaguagaaaacuagcaugguuacuuuuagcuguuuaguuuuugaaaauaauucagauuguucauguuuaauauuuaacauuugucuuagacugaaggcaaaguacuacagauagugcuuuaagggaucuuaguuauuguacuuccauuuuacaucauguuggaagcccagaaugucauaaggucuuaaagccaguugguggcugagaacuagaguaccuuugcauacuucacuuucauuucuagcaagcaucuuucauguaauagauauguuuuaaagcaguagauuguucagaauugucugguuuauuuaagaacauuugaaauaacuaugugucaggcuguguggagcaccauaaaauuuacucagacagccauuuuuuucuauauguugggacaccuuuguuuuuaaaggcuuuguuuuacaacuuucuuaucagugaacuaauuugagccucauaacaaaccugugaaguuggaauucuuuucaacauccuggaaagaguuugcugccagguugauaauugcuauaaauaacuugcucuuuuaaaccaugcaaaagaaucuuugucuccauuccuuccaaauucauuugaaccagcucaaaacaguugagacccaguuaaaauuuuugauuaaguggcauggccugcacauuauuuaguagacuguuuaccuuuugcagaacuguauaauuugagaaugaaacuggagccucccaaucucauugucaucaaaguagaguuuaaguuguugguugucugcaguuauggcuaacaguauggagauuaguauauacuguauguucuccuucauaugcagguaauguguagaaagauugagaaggccagcucuuuugcauaugaucagauuuauauaucuguauuucugucuuaucaaucuguagaauaccuagcauaagguuucugccuuuagauuaaucuggagccaaaagaaauagaacaaauagcaauacggcuuacucuuugcugggcacaauccuaugagauagacuuguuuauuuuacagaggugacuggacucagagauguauggcaacuugucuaagaucacacaccuaguaaauggaauuuaggcccagaucugucuguuucccaggcuuuuccauuaugcuguuguccuuuacuucauuuuuacuuuucuuccagugguagucuucagccucuacuuuuuuuuuuuuuuuuuugagauggagucuuacuuugucacucaggcuggagggcaguggcaugaucucgacucacugcaaccuccaccucccgaguucaagcgauucuucugccucggccucccgaguagcugggacuacaggugugugccaccacgcccagcuaauuuuuguauuuuuaguagagacgggguuucaccauguuggccaggcuggucuugaacuccugaugucaugauccacccaccucagccucccaaagugcuaggauuauaggggugagccaccgcgcccggccggggagguuugaucuuuagagaugcugcuuguuucucugcaaacccaaggacaugagagaauuggagcugaauaaugcaaaagggguggaauucuguuucuuugguaucugguaccaucuuuauuguauuugacaguagucuaucauguggcuuugggaaaaaaauaccauauaccuguguuucauaaaugaaagggaaauacaagggaaaacauugucauggcuagauagacagugucuuaacuuucuuuagggcauugguuccuaauguucuucaggucauagauccuuuuaagaagccaaugaaagcuguugaccgucuucugggaaaaagaccaacauauguaaaauuucccacagaauuucaggguuuuuguaguggucauccuucaguauaggaugaggaauucuaaagauuccucuacacuuguuuuucucuauaugucauuaagaugucuaaauugcuauguuguuuguucuuguauuucuuaguacaggcguccccgacuuaaugaugguucaacuuaggauuuuuugacuuuacgauggugugaaagcgaaacacauuuaguagaaagcauacuugaguacccacauaaccauuuuguuuuccacuuucagucgauauuaaguuacaugagacauugaacauuuauuauaaaacgggcuuuguguuagaugauuuugcccaacuauaggcucuaauguaaauauugcaagcauguuuaagguaggcuaggcuaugauguuuggucgguuggguacaguaagugcauuuuugacuuagauauuuccaguuuacaauggguuuacugggauauaaucccaucauauguugaagagcaacuguauauauuuuucuagacuuauuuuucuacacaguggucaaggguaagcuuggcuaacugugucacuuuugcuuaaagauauacucuguauuaugcaaauuuaauuuaucuucuguauugaucuuauaauugguuguguuuucagccuuugggcaugaggaaguuguaauucucuuuuuuuguguauugacuucguugccuuuauauuacgauugcuucuaaucuauuuuauuucugauuuuuuuccuuauuuucuacauuucuguacaccuggcuaucugaguauucaucucaaugcccugcauauaguauguuuauaauuguugaauggaaagaugaagguuaaaugaaucuaaauuguuuuuuucaguucaccaagaguuuaaugugacuuggauuuuuuuuaguuuuguuaagcauuuacuggauaguuauucauuuauuaaucugcuauuaauaaaugacaguucauaugcugguacaggaaugcaaagauaaauaugauacagucccacucuugcagaacucagcaagcauaguggggagacugucagguaaguaaagaggugugcugauugaggaucaauaugcaggauauaguuggggcuaaauaaagcauguggggagcugagggaaauauuauguaauaucauagcacugguaagagagguaagcagggaccagguccuagaggucuuggaugcugguuuaaauaaggaguuuguacuugauguagguagguuuugaguuuuagggagauugcucuggcaacaauguggaggauagaauggauggauccagcaggaaaaagucucacuuuaaaauaacuucaauuuaugagacuuuucaaaacauauacaaaaauagaaaaaagcauaaugaacacccauguaacugucacccagcuugaacagugaucaacacagggcuauuguucuauuuauaccccgcuccuccccucuauuuuuauuaaagcaaguuccuaagucacagaauggcaaagcauauauugaauaauaaucuaaugccauggcucucaaggcuggccugugcugccaaaucaccuguacagcuugaaaaaaauaauccccacuucagaccuacugaauuagauagcuuugaaaugccuguguggucaggcauuuuuaguuuucaaaauaagucucgggugaaguaaguuauuuuuaagauaauuuuaaaauaacuucugacaaaugaaaauacuuuccugaacucauugaaugcugccuguggcccuucugggugaaauucaccuauucgauacaggcaggcuuuucuuauaaauuuuuauuuauuuuuuguagagacggaggucucacucuguggcccaggcuggucucgggaaaacuccuggccucaagugauccucccaccucaggcuuauccucccaccucaggcuuccaaagugcugggauuacaggcaugcagccagaaacugacaauucuuaagguguagacuaggaauauuccagaguaccaauuuaaaauguguagacaaggagucuguuccucuccugcuuaauuugcuuaacuuacacuuaggcauugcuguuuuuauuuuuuguugagaauaccaagaagggcuccuuagcaugcugucauuuccucuguauugguaaaauugauaaucugcaacuuuggugagccauguuugguugccuaguucuucugaugccaguuucucuaaguaauugggaguauccgggaaggauaacucccagaucugcagcuuccccagacuguuugaauagaggauguggcaggagauguguucucagauacuauucucacguucaaagucaacauuggagguuucagauuccucuuucuuaguaucccucccugcccauauuuuccuugcuuaagcauaacugcagugcagagaaacacccagagccagcauaaacucuuaaucugagguauaguguguuuucagauuuuaaaugagagacuccuucaagguauuucugcaaauaauuuccagauuugucuugggugaguaaaggcuauuuuucaguugcuuuauuaugacacuuuacugucagugcccaguaaaaccuaggucagcaguucucagggcacuugagagucauguuuuauguggcuaaggauagggagacuggugucuguaggagaggggcguagcaaggugggcugugcauauagacauuaugugcaauguagaguuguggaacagauuuggguuugaauccacguuuuaccacuuaauagguauguggccacucucaguaaacugggcacagucuucaucuccaaggauuaaagauaaugcacaauagguauagaguaaguguuagcuauuuuuuuaugaucauaaauguuuuucacaauauuuguugaguggauauuaauguauuaauagauaaucagaaacuagauaggauggaaaggccugacaauuaugugguguccccuuuaacaaaucauaaucagugacaccuauuccucuauaaucaaauagugaauagcaggcuggauuucaagaugcaucuuacugcuuguugacaugaagaaugcucagggcagcucucaccugaauuuacuuucagagacuauaaggcaaaaggaaaucguugcaaggcaaaaaauaaaguauuuugcuuugugguacuuuggaguuuaguuuucucuaagcauuuuuuguuuaagaacugccguaaugcuuccaugauuucuauggggauuuuaggcucauuuugauucauccccacucccguacuuacgugcaacaucucuuaccugcuaauaaucaaccaaagugccuccugugugccaagcuccaaacaccagaagauguagggaagaagcuccuagaguaggcagcagcuaaucuaaggcauuuguuuagaugguguucuuaaucuggugcauguccuuuggcucaggggccaguguuuucuuccuuaaggaaaauuuuaggccuggcacaguggcuaacgccuguaaucucagcacuuugggaggcugaggccaggaggauuguuuuaacucaggacuucgagaccacccuggacaacauggcgaaaacccugucuguacaagaaauauaaaaauuagccaggcgugguagagugugccuguggucccagcuacucuggaggcugaggugagaggauugcuugagccugggagguugaggcugcagugagccaagaucaugccgcugcacuccagccuaggugacagaaugagacccuguuucuuuaaaaaaacaaauuacaaaaggaaaucugauuauaaauggauccaugauuuauaggaaauuuggaaggauuagaaaagcaugaagcauaaauaaaacuauguguuacccugccagcuagaggcaaccauuaaaggccaacuacuaauaauguguauuucuucccuucccagguuuuuuuuuuuuuuuaacuuucccacccuguggcagacauuuucucauaaauagggaagugauagguacagaguacaauguaaucacauauggugggauauccagucaagauuugagggguucgggagaagauuguccaaauucuggauaucauucuguucaaaccugcauaagugcuuauuauauuacagugaaauagaggcuaaaugguccccuacccccaauuuucaaagggauucuuacaguuacuccgucuuuucaagacaguuugcagccacuugagaacauaagcuagugucuuuauuuaccuuuuccucuacauuucagugaccccauaauucucugcuuccauuuacagccuauauauauauuuuuucccccgagauggaguuucacucuuguugcccagacuggagugcaauggugcaaucucggcucacugcaaccuccgccucccggguuuaagcgauucuccugccucagccuccgaaguagcugggauuacagacaugcgccaccacacccggcuaauuuuuuuguauuuaguagagacgggguuucaccauguuggucaggcuggucucaaacuccugaccuugggugauccacccgccucggccucccagagugcugggauuacaggcgugagcuacugccccuggcccaacauuuucagaagagguuuuuacacauaccauuuaugcuuucucacuuuccauugauucccugacucuagucuggcuuccauucccuccaucccacugaaacaauugcuugucaaauugucucuauuaccaauuucaguggacauaccucauuuugacauuugaugcaguugaucacucuugccaucuuucgucucucgugauagcauaauuagcuaguuuugcucuuuccucacuagccucuccauugcuggguuuuccuucuuuccuuaccuuuacacuuuuauuguauuguauuuuuuuugguagagaugggguuucaccauguugcccaggcuggucucguuuaaggaaucugcccucagccucccaaagugcuaagauuauaggcuugagccauuguacccggccccuucuuugccuuaccuuuaaaugcuagagcaaauaacucaguugcgggccuccuccuuuccuucuuuguaagcagucaucuccagacccauggcuucaaguaauauaugugugcugacaaucacagauuuuauucuuaaugcauacgucuuuccugaacuccauucuacaaauauuugcauaccuaucauguggaagauaccgugcuagguacugagagcuuaacaucuuagaaaaucaaaccaguaauuacaguugauacuuguuaugaaggaaauuggaaauaaacugggugcuauaauagaaaaauuacagugggaccaacuugagguggguugucauggaaagccucucugggucuuaguuuaaaugucaguuccucaaauggaacuaguugugggaaaggagggguggcaaaaacauuccagcggcgaacuuagaaauuagaguguuccaagaacuaaauggaaagaauaauuacacaguugaggaaacaagcauagagagguggauuugucugcgguuaugcagugaguaagugauauagcagggauucuagcccagguuuucugagucuguauucugaucuagugcuucucaaacuuuguuauauggaucaccuaaggaucuuguuaaaaugcggguucugacuccucauaucuagguggggccugaaauucugcaacuuuuaauaacucccaggugaugucagugcugcugauccuuggaccacacuugauuaguaaggcuagucuuucacuacauccaacugcucuugagccagauuugggaacuacagguguccugugcccuuaaacugauucaguauugaaagucauuauuuuuaaauauuaucaacuggaggugauuacuauagaauaugagucacgcuuugaguggcuucccucaggauauuuuaguuguguacacuuguucugcagguaaacuguacaaaaccaagauucaaaccucagggguguaaggaaagguugggggaauaaggaagugaaaaaaaauauuagauaaaaguauugaaguaaugguaauagauauggauggugauucauaguaauucacuuguuuucuuuuaaguuggcuaucuuucuaaccuaaguuuaggaagcaauguuuauuauauauagagauugcuuggugcccugaguucugguucugacccaacaaaggcaguaggccauuucuaggaauuuguuucaaacuaacuuauuuuuauggaaggauuuuuuuuuaaauguaauaggguuuucaccugauuaacuucuaagagguagaacucauuccccaguuacuguuccuuucauuagugaaauuacagcaucucagcuucucaucuugggcccuaguuuccucucuuggaguaauuuuuucaaacaaauaggauucagcagucuagaagaaucugucacaaauuuuuauucuuaucugccaauauuuuguaguaauaaaacugguuuuaaaaaaaggugaggcugggugccguggcucacgccuguaaucccagcacuuugggaagccgaggcgggcggaucacaacgucaggagaucgagaccauccuggcuaacacagugaaacucugucucuacuaaaaauacaaaaaauuagcugggugugguggcgggcgccuguagucccagcuacucgggaggcugaggcaggagaauggcgugaacccgggaggcggagcuugcagugagccgagauugcgccacugcacuccagccugggcgacagagcaagacuccaucucaaaaaaaaaaaaaaaaaagugaaucgcauguuauuaaagcauggacuugguagucagaccuggauuuagaucuuggugcuaacauuuacugaccaagaaagguacuuuuuuucucucuuacuucaguuuucuaucuguaaauagaggcaaaacuugacuugaguggugaggacuguaugaaaaaauaucauaugaauucccuagguagcaugucucaaacuguauucuuuggaauacuucaauuggacuuugaguagaugccacuugagaaaaugguucugugcgcuaauaagccuccuuuaccuaagaugucuuagagccauuaauaaugucaauuagcuaugugacugcccuaguggaagagaaauucugucuauaacauuucccaaauuacaggauucuugucucccuuuauagagcaagacauucuaacacacuuuggggaacuccagucucaguauugucuggcuuguaauggacacucaguauacuaacguuccccccucccacuguugaaaccaguuuuagaaauaugagaacacaacaacuucuaaauuuuuaaaguugaugucucauggacagugaugucuugguuuuuuaaacuacaaauguuucuugcaguagaauuauagacaccaagguaggacugcacuuguuaugggaacauuugugugugugcauucauauuggcucuguuauuuuauugggugcaucaaaugcuuacacuugggacuuagagucuagcgccacucaugcaaauaaccugagaugauuuagaauuaugccaccagcauaguuucuaggcauccagagucuuguguuggcagcagaaguaccccaagcuaagcuguuuccguggggggucuggcuguaguuccaggcucccuagcuuccuugguuccucuuaguuuucugcacguggagcucuagccuucugucaguucugugagcuaucagauacucuccaguaaauuacuuggcugcauuaauuauccagucuuucuguaguuacagacacuugacuaguauaguacacuaggucaaaacagcauuagagcaaguugcuuauuuguuugaagauucaucagugacucaucugcauuaaaaaaguaaaaugguugugauuugcuuauuucagugcauaaguuacucugugcucuuguuuuggaggauuguuuuuuuaaaauagacuuuauuuuuagaguaguuuuacauucccagcaaaaucgagcagaagguacagaaauuucccauauacugccugccuccacacaggcauagccucccuuguuaucaacaucucccacuagagugguacacuuguuacaauugauuaaucuacauugauacaucauuaucacucaaaggccauaguuaacauuaggguuuacucaugguguauacuuuugggguuuagacacauaauaacauguguccaccauuguaguaucauacagaguaguuucacuggccaaaaaauccucugcgcuccaccucuucauucuucccuccccacuaacccuccucaaccacugaucuuuuuacugucucuauaguuuuuucuuuucuagaaugucaugugguuggaaucauacaguauguagccuuuuuguacugauuucuuucacuuacuaauaugcauuuagguuuccuccauguuuguucauggcuugauagcucguuucuuuuuaguacugaauaauacuccauugucuggauguaccacaguuuauccauucaccuaccaaaggacauugugguuucuuccaaguuuugacaauagugaaugaagguacuauaaacauccaugugcagguuuuuguguggacauaaguuuucaacuccuuuggguaaauaccagggaguauugauugcugggucaugugguaagaguaguuuuguaagaaauugcugaacugacuuccaaaguggcuguacuauuuugcauucccaccagcaaugaaugaauguuccacuugcuccacauccucacaagcauuugguguugucaguguucuggguuuuggccguagugauauaucaucaugguuuuaauuugcauuuccaugaugccguaugauguggaguaucuuuucauauguuuauuugccaucugucugucuguggugagguguauguuaaggucuuuggcccauuggcccauuuuuaaaucagcuuguuuucuuacuguugaguuuuaagaguucuuuguguaucuuggguaacaguccuuuguaugucuuuugcaaauauuuucugucagucuggcuuguccacuuauucuuuugacagugucuuuuacagagcagaauauuuuacauuuaggucugugauccauuuugacuuaauuuuugugaaacauguaauuucgguuuagauuuuuuuuuucgcauguauguaucgaguuguuccagcaccauuuguugaaaaaacuaucuuuuguccauuauauugacuuugcuucuuugucaaagaucaucgguugacaauauuuaugugggucuacuucugggcucccuaauucuguuccauugauuuguucauucuuuuaccgguacaguacucuuacuuacuguugucuuaugauaagacuugauuuuggguaauguaggucuucugacuuuguucuucuccuuugauauuguguuggcuaucguggaucuuuugccucuucauauaaauuuuagaaucaguuugucaguauucauauaacuuguugaaauuuuaauuggaguugcauugaaucuguggaguuggaaaugacuuaacauuuuggcaguauugaaucuuccuauccauggacuuggaauaucucuccauuuaauuguucuuugauuucuuucaucagaauuuuauagucuuccuuguauagaccuuauacauauuuuguuagauuuauaucuaaguuuuucaguuuuggggugcuaauauaaauguuuuuuauuucaaauucugcuuguucguugcugguauauaggaaagcaauugacuuuuuuuuuuuuuuuuuuuuuuugagacggagucuugcuuugucgccccaggcuggagugcaguggcgccaucucagcucacugcaagcucagccucccaggcucaugccauucuccugccucagccucccgaguaguugggacuacaggcgcccgccaccacgccuggcuaauuuuuuguguuuuuaguagagacgggguuucaccguguuagccaggauggucucgaucuccugaccuugugauccgcccgccucagccucccaaagugcugggauugcagaccugagccaccgugccuggccagcaauugacuuuuguauauuaaccuuauauccugcaaacuuggugcaauugcuuguuaguuccaggguguuuuuccuuauuucagauuuucugcauguaugaucaugucaucucugacaaaaagacaguucuguaucuuccuucccaaucuuuauaauuuuuauuuccuuuacugcuuuagcuaggacuuucaauacaguguuggaaagcagugguaagagaggacaucuuuuucuuuuuugagacggagucucacucugucgcccaggcuggaaugcaguggcgcgaucucagcucacugcgaucucugccuccuggauucaagcaauucuccugccucagccuccugaguagcugggauuaagggguuuugccauguuggccaggcuggucuugaacuccuuaccucaaaugaucugcccaccuaggccucccaaaguguugggauuacaggcaugagccacugcgccuggccuuuuuuguuugugauuauuuaagggggaaugcuccuaguuccugaccauuaagauauuaguuguagcuuuuuuuguagauauuuuaaucaauuugaagaaguucucuauuccuaguuuacugagauuguuugacuuuucacuguugaauuuugagaguucuuuauguauuuuagauacuauauaugguuugcaaauauuuucuccuaguaaauuuuauuguccuauauuuaagugauucauuuugaguuaauuuuuuauauaaagugugaggcuuaggucgaaguucaucuuuuuugccugugcaugucugcuuucucuggcaccauuuguugauaaaacuaucuuuccuugacugaauuguuuuuuuuuuuaaccuuugucaaaaaucaguugggcauauuuguaugagucuauuucuggguucucuauucugcucuauugauacuuguauauauaucaguacuacuugaugucuguagcuauauaguaagucuuaaaaguggguaggguaauucaauuccucccucuuuuauuuuuuuccaaaauuguuucagccauuguuguucuuauacaacauauacacuuuagaauaaucucagcuuauuuacaaaaaaacaucuugcugggauuugaauaggaauuauauuaaaccuauauaacaauuuuaggagauuugacaucuuuacuagagucuuagaucucuccauguauuuagagcuuugauuuuuuuuuuuuuuuuuuuuuuuuugagacuggagucucgcucugucacccaggcuggagugcaguggcacuaucucggcucacugcaagcucugccucccggguucaugccauucuccugccucagccuccugaguagcugggacuacaggugcucgccaccacgccuggcuaauuuauuuuuuuuuauuuugagauggagucucgcucugucgccaggcuggagugcaacgguacaaucuaggcucacugcaaccuccgccuccuaguuucaagcaauucuucugccucagccucccaaguagcugggauuacaggcuuguccuuccacgcccggcuacuuuuuuuguauuuuuaguagagacgggguuuuaccguguuagccaggauggucuccaucuccugaccucaugauccgcccgccucagccucccaaagugcugggauuacaggugugagccacugcgccugccuggccuuuguuuuuuuaagauggagucucgcucuguugcccaggcuggagugcagugagccacugcgcccauccucugggaggcuuuuaaaauagauuucuuggguuuucuauguggaugauccuuugacaucugcaaauagggaccauuuuuauuuuuucuuuucuuaucugugugccuguuauuucuuuuucuuacuguauuauauuggcuagaacuuucagcaguauguugaauaaaagucaugauaacagacaucuuugccuuguuccuaaucuuagagggaaagcaucaguuauuugaguuguauugaggcuggcugcuacgucuugcagcaggggcaguuuaauagccucccugcaaaugacugaagcgacaauagugugacagccacuugcguaagacguuuaugagaaaaggggaggaaaaaagccuugagaguaagcguacaaauagcucagcuuauaguuuccaccacauggacaggauuguugccagaauccuguuggcuucauuugagauauuuugagguuguuggcaucaggcauuuuguucauuuuguauugauacugagauaacuuuuuaaaaaguaaucuggaauuacacacccuaaauaucaaccauagaaaacauuuuuucuucuuaaggaauggucucugcagaaauguuuuagaacguauucugaauuuuucacaaacucuuccuugaaugccugcugauugaauggauacaggucguacaggcaaauacacgcuauuuccauaguacugaguauauuggacuaaaucuaggcaaaaagcugccuaaaauuuauacuguaauuggucagcuuuauauuauggcagccuucucgggggaggaacauugauuucuagugacugccacugaguuaaauacauuguuaauagcagaaucuuuuguguguaaagagccugcaacccacuucuaccucugugcaugugucuuaguugcuaacaggagaaacuuauuucuucuugugcuuuggaggacuugucugccaucaaagaucuagggauuauacaguggaucugaucaggcuguugucugcuuuugagccuuccaaauuacauggcuuaauaaaaugauuguuuucugugcucagaauauuucuguugugauccuuauacuucauuuucuaguugaaaaaaguguuguuuugccuuugcucuuaugauacaacuaauacauuuuuauugguaggaacaguaaaaggugcauagguaaaacagucauacuuaauccuuuugguuaacaaugaauuaauauucugaugccuagcaccucuaagcuguuuucuuuagacauaaguuuuauaccguauguucuguguuguaaucuuuuuauuucaucaugaacaucuuuguguauuacauaguuugcaauauuuuuaacaguugugugacauuccauuuuaaaccagucguauuuuggacauuugaucuuuuuuuuagccuugugauggaacaguaggucuuuuucagucuuuuacuauuauacauggucaugcaguauggauucuugugguuaaauauuuguguacaucuuuacgacuuucuuuggauuaauuccuagaaauggaaguuaucaggaaacugcagggcuauggugaauuuuuccauccugagauguguugcaaacauuguacacucuuauuuucaauuaagaguuugagaugcuuguaaaagagaaaaaauuuucauuuugaccugauuugguuucagucuugugcaacauagggaugugggccaguuugaucuggagagauucuuuaccucucucuaccugauagcugugccucugaguuggcauagcaucauaacuccaguguuuuuacuuuaagcauuuugcauugcucuucauucuguauugucuguguccaagcuuguagagcucaagauuguagcuuuaaguucucacuucuuuugggauuuucuuuuuucagaucguaaagcugaaaauugaaaucaugaaaguagacaggacuaaacugaagaagacaccuacugaggcuguaaguauccaaaaguuuacuuugcuuauuuuuucuucauuaaaaaauaaaaaaauauuugugaacaguucauccaugcucuucaaaucucaucacccauauauacaaaaggcaguaaaacaacaacuugucuagaaacaguaagauuuucuuuugaacuucccuggaucaaaaaaauggauagccaagagaccaguggaaagugaacaccgaucaguuaguucuucguagcugugugugccugaagucagcucucaggcugcugugcaauuccuuccuaugcagaaaggaugugugguauaauggaaagagcagauauggguucagauuuuuaauguacuucugggaucuugcaauuuuguuuuuuagaaaaugaaagugguaacaucuuucuuacuaguuuuuuuguuaaggccaguguuuuagcuugucuuuauuacugauucuuaaucacacaauucagcuuaacuuguguauuggguggucauaucaauuaacccuuugucgacaguagaaaucccagcuuuaaucuaguaauauuccaccagcuagcuugaacugcuuucuaagguugaggaagugguauugcauugugauaguccuguugaccccuugugcuuaguucagagagcacaagcuuugaaauuagaccuagguuugaaucuuaccagacuuuuguggcugagagguuauuaacuugccugguuuccacagcugcaaaauggggcugaaaauuuuuuccuucuugaugugaggcaauugcuuagcauaguaucuggcacauaaguuaguucauaucguaaauacaagccacuugguuuucaaaaaauguaaaaguaccuggcaaguaucaccaaaagauaacaauaacauuuugcugcauuucuuccaguuuuuuuuguuuguuuguuuguuuugagacaggguuuugcucugucacacaggcuggagugcaguggcacgaucacagcucacugcagccuugaccucccagcucaagcgaugcucccaccucagcuuccugaguagcugggaccauaggugcaugccaccaugccuggcuaauuuuuuauuuuguguagagacaggaucuugccuuguugcccaggcuucuuccagucuuuuaaaaaauuauuacaugugcacacacaauuauccugcccuuuucauuuagcauuguacuaaugaguaugagcagcacuuucuucauauacccuugucaguauuacagauugucuuuuaaauuuuuguuaauuucauaaguggggaagaaaguauuucacuguucuauaucaguuaucuucuugugccauucauuuuguaucugacauuggaauaucaguguuucucuuacugaaugccauauauauugaacguacucauuuucauaucuguuggaaauaucuucauuugcuuuugauuuuguuuuugauguguuuuggcaucuagaaguuuugacaacuguguacuugaaugucuuuuacugaaggacaaaaagaaaacuugcuuaagaaacuauaauuuaaaaauuuaaaguggaaccaauguaagaaucuacugcuacgagaauagaagaccuagaaaagugauccuaguguauauaagaacuagauauaugguaauagagggauuauaaauuggaaagaagggacaguauuaggaaaccaugcuagaaugauuaucuuguagagcaugugggacuauuauauugcgauaaauuuuagauaaaccaaaagucaaauguuuuuaaaagaaauaagcuauaggagaaguagaacauguaggugaauguuuacuuugucuuaagugggcauggucuuuccaagcauuaaaacaaaggaaaaaaaccauaauggaaauguuaaauacuguauccaaaauuaaaaagacaugacaauagccauccuaauaggugugaaguaauaucucauugugguuuugauuugcauucccuugauuuccuugauagggagcaccuuuuuauauauuuuaaaacuauuuguauguaaauagacaucuggauaaaugucuauucaagacccuugcccguuuuuaaauuguguuauuugggauuuuuuugcuauugaguugcaggaguuccuuauauauuuuggaaauuaaucccuggaagacauuaggcaaagugaaauaagucagccgcagagggacaaauagugcaugaauccucuuauaugaggcaucuaaaauagucaaagguguaaagguaggcaguagaaugauaguuaccaggaaauggugggagagagaagggggaguugcugcucaguggguauaaaauuauaccaggcaaguucguuccagagaucugcuguagaacaacauagugccuauaguuaacagucagguauugaguauagucugcccuccguguguggguuccacauuugcagauggaaccaacuggauaguaaauauuugggggaaaaaacaauaaaaaagaacaauacaaaaguaaaaauagaaauuuugaagcaaugcaguguaacagcuauuuacaucgaauucaguauuguaauacuagagaugguuuaaaguauauaggaggauguguauagguuauauacaaauaccauugccauuuuauacaaaggaugagcagcauagauuuugguauucauggggguccuagaaucaauccccaguggauacagagggacuacucuacuuaaaaauuuguuacgaggguagaucucacguuaaguauucuuaccacacacaaucaugcacacacacguagggacacaaggaaacuuggaggugauggauauguuuauuaccuggauuguggugauggcaacgugaguguauacauacauccaaacucacccaguuguaugcaugaauuacgugcaguuuuuuuguauaccauuuaccccuuaauaagcucagguggggugggggagggggaagacacaugacaagcuggggaaaauauuuguaacccaguguaguuaauauuuucaguagcuaaaucaggagaaaugaauaucccaaugacaaaaugggcauagggcauuuaagaaaagaacaaacccaguaaacguccagcaagauucaacuuagcggguaauuggagaaaugcaaauuaaaaaacaauuuuuaaccuaguggauuguaagggguugcucuuggagucauauacugauuucuggcucuuauuuccuaguuacuagcaaguuacuuagcauaaacuccuagaaguggaauuuuuaugucacugguuauggacauuuuuaagacuugaguugucuauuuuccuugagcagcauacaugauugcccccauuucccauacuguggucaaugcuagguacuauuaugaaaggcuuuuauugaucacuuuguguaucaguagcugugcaaaggauuuuuuccccagauuugguaucuauugaaauaaaucacuguaaacccuggcaauuguuauugagcuaucgaacuggcaaaugcuuucuuauaucuuaacguugugcuugcugcuuucuccugcaaaaugcaagggaccuugauagucugauaaaacagagaccauaguacugguacauuaaauugaugccauuaugcuaacuggaucuugugagcagaaaacacaagcacaccuuagaugccucagacauauuugugccagagagucagaaacaaaccuuguggaagcuugagggccuuuucacauuaggaaaguuucuaguggccccaggguuugggaaauauugggauaucccuucuaaagugagagggaaguugcuguaccuuguaccacacacugugaagaaagaggaacaaugugugaugcguuuggauuuuggagccaacauauugguuggucacauuuaggcaugcuauuuugaccuauuuacuggauaaccucuaacacauuuaguggggaaccacuaaaguguuaguaagguuuggaucuagaaaagacucugcaaaagguccaggcuaugauacaaguugcccuaucacuuggacauuaugaccuaguagacccaggugacugacuuaggugucagcuaaagaugccauguugugcuuuuggcaagccccaauagaauuacaaguaagaccccuagauucuuggcugugcuguccucugccaccagcuauucuacauucacaaaagcagcuucuggcuugcuacugggccuugguaaagacugaaugccugguuaugggacauaccaaauuauuacaggauccaaauguucaucaugaacugcaucuuaccuacacaucguaaaauuggauuuguacagcugcauuccauuagaaauagaaguaacacguuugaugcuggacccaaguagguccagcaggcacaagugaacugcauaagcaggugguucaaauuuccauguuaucuauuucugcugcuucacugccucucccucaacuuacaucuuagaggagaagaggaaaaagugcaggccugguuuauggaaggauuuugugccaaggauuuuacauauauuuaauuaccaugaacauuugagguagaucuuaauaaugcuuagagggagaaaagguuuggacuuagcuuaaagaaaccccuguuagguuccauguuguuucagaugccgaaaauacguuucucccaguuugaaucucacgacagcauugcuggauauauagguacauguuaguuuauuuugcagaagaggaugcugagauucaaagagguagcuuaccaacuaccugauuccaagggucauacucuuuuuaauaguaugcugucucugaauauuuaagcuccuguaaugggagauaaguauuuuauguauguggcagacguuugaguuucauauuugugagguagcuauuaggucuguuuuucugauaagagagcuguggcuuagagguuagacuugcucaugaucaaacagcuuaguaaacaugaaguuaaaaagugaauccagacuuguuugguuccagaccucugguccauucccaggaugcuguacugccuuuauggaguuaaagaacaaguguaauaaucacuucucccagcugccauucauuaacggaaggcuucucucucccagccccuaucccuuucccuccuuccacuuucagaaacuugacuauaaaugcucaauccacuccuuguuaccugacaaauggacccauucaucaguagaagagagcagaaauguauggaaauaggaaccccaagaaagaauggaguccuaguuuuacgaaguucggaagcuguuuaccaucuuacaagugaaggauuuuauguaacagaaaaauauagcuagugcuaaucuucaccuuuaauugugaauucacuaggacuuuucagucucugauucaauauaaccuaccaggcauucugguuaacuuucagaccaugguauagauuccuuaauuguuuuuuuuuuuuuuuuuagauguuuaacuuauuauuguuuuuguugucagcaccuuuccaaauaguuugucugcaucuaccuuuauccaaauccaagguggguuuuuguuuuguuuuuuguuuuuuuuuguuuuuuuuuguuuuuuaagcccagguggauuguugggggaauaaaagcauuuucucaugagguuuccauuuuaaucccaagagauugucuggcacaucucguuuucuuaaguaguaaauccuagcaaaaggaaaauugcugugugagcuuaaggguuccuuuucugauucuccuuauuugcaacucccucauuccaaaacaucuuuugugaauacuuuucuuuucucagccugcagacugcagagccuuaauagacaaacucaaaguuuguaaugaugagcaacuucucuuggaacugcagcagaucaaaacauggaacauuggaaagguaugugaagucaagcucccaaaagacaggacucaccauacuaauacaucauuuuguaugcucugauauggaauaagaaaccacaaugggauagccucauucagcaauuaauaagcaucuagcaugugccaugugccuaacacagcuuuaaaccaguggcaaggaaaauuuugcuggcugaggauggagaauugauuucacaggugaugcuuaagaaucucaaucacagaauuccugugguuugacaauauaaguuugagauaauuucuggauuuuuaguuuagaagaauuuuuauuagauaacucuaaaaaugaauuuuucugauaaaauggauucuggcaaggauaguucucuugucuucguagaucuuagaauguaaccggaguucuccaucuaaagaccuagcucuagggguuuuauggugucuauugguguuagcacauauaucuagauggguaugacaaugaacuacagcacuuuuagcucagaguaugaucuuucucauaugggcaagggugggacgugaacuugucuaggugucaugcucagcaaucucuuguaacaaagcucaguuagaaagcacccaugcggcgcuucuaccuuauucuuacauccucuuuuuccuccccucuccagugcgaguuauaucacuggguggaccuguuggaccgcuucgauggaauacuggcagaugcuggacagacaguggagaauaugucauggaugcucguaugugauaggccagaaagagagcaacugaaaaugcuucucuuggcuguguugaacuucacagccuugcucauugaguacagcuuuucccggcaucuguacaguuccauagagguaggggagguuaaagccuguguacccuguucuugacuagaauuguguacauccagaaauaaggaaauugcuauuucuauugcuucuuuccuuuucauuguggagcucuggguuuuucauugucaaagauaauaguagaauguuucuuggauauagauacuauccuucauaggguugaugggaagauucuguacuaucaccuuugcuuugccuuuucaagauucaagaaaugaaugagaaauguuauauauguauuaaaguauuuaaggaaauuugcaugaauugauuuuugcccuagguuguuagagcagccccacauuacuuuuaaauuccuagaaauaguuugauuuucucaucacauuaauguacuuacuacuccucuaaguguuagugugcugcuuuaaagucucucuguacucugccacacccaucccaaaauauauauucauagcauccuuuguguccuugaagaguaagguaggugcagcaaucagugagcuuuuuaauugguuaaaaaucacuguaagaagaaauuauuuucuuuuuauagaagcccaacuuuagacuuuuuaucaucauuaguuaggugcccuguuaauuuuagguguguuuuccuacgucuucaguagagaaacagaaucagaacaaacaacuuaaaagaaaauggcuuaggaaaagaagugggauaacugaacuaaaggccuaacauacagagcuuuaagugggagguaaauaggcagucuguugaagaugaaauagauaugcugcccauggaaguccaugaccuucgguauaauuggcaacuggaaaugccuugguucauuucuagcuauauuacauacugauuuuaauucugaccaacugcuucaauguauuggugaauuuuaauuguauuuaaaagccaaaguaaggccaggugcaguggcucaugucuguaauccugacacuuugggagguugaggcgggaagaucacuugagcccagggguucaagaccagucugggcaacauagugagaccccaucgcuacaaaaaauacaaaaauuagcggggcgugguggugcgugccuguaguccuagcuacucgggagacuucggugagaggauugcuugaacccaggaggucaaggcugcagggagcuaugaucaugccuuugcacuccagccugggcaacagagagaccccgucuccaaacagcaacaacaacaaaauccagaguagucacucagguuccuuaugagcauauacuguacuguaacacuuauauguuauauaauugccacgagcuguuaucgauaucuuuagcuucuauaugaaggacccuguuuuaauuaauuucaauuuuauguuugucauaaaggauacagaagagaacauaaaauaucuuucuuucacaauacuuuuaguccaguuagagacuuaauguucuucuugagucccacauguguauuugucucuuuuccuuccugugggaaaaccugcgcaauuuugaaccacuauuuacguuuuuuacuuuuauugcacuuuauagcuaacugccagauuuuaagcuccuuggggauaagguugcauguuguagauuaucaaauacauauauauauauauauauauauauauauauuuuuuuuuuuuuuuuuucuuuuuuugagacagagucucccucuguugcccaggcuggagugcaguggcgugaucucggcucacugcaagcuccgccucccggguucacaccauucuccugccucagccucccgaguacaaauacuuauauauuuuuuguauuguugugacuaaacuucuugauagcuuuguaaauguugacaaguacauuuuguuuuguuuucaaggccaguugugccugauaccuugagcuuugcccuuuuuugucccuuuagcauuugacaacuuuauuggcuuccucugauaugcaaguggugcuggcaguccucaaucuccuauauguauuuagcaaaagaucaaacuacaucacucgucugggaucugacaagaggaccccgcugcuaacucggcuacaacauuuggcagaggugagucuugggugaagaguuggaggggugcaaaaauuggagcauaugguuccuuucaacagguguuucuuggaguguuaaaauauauuagaaucccuaaguuaacuucacuggccuaauugaguuagaacuauuggugcccuguuuuaaaaccuaaguauucucaguuauuaaguaauuuugaaggaauucuuuaaucucugcucaccaaacaaaaucucucuguucaaaaguggcaauuucacuucugaaaggaaaguucaaaauuagauucaauucugugugagaaggaaguauaaugcaauaauaagaucuagauuugaguccuggcccugcuuacuagcgccgacacugguuuccucuucugggaauuuaacauaucuacuucaggguugauuuagaaugaaaugaauugugggguacucagugcugugaucaguaagucguagugauuguaauugaagccagaagcucucauauaaaaguucagcucuaccaaacuauuguccaguguucccagaggcaacuucuuaauacauacuuagcuuugagagguaacccacuguuggaaagcuuucuuagaagaaaaguguuauggcuggcuuuuuaaaagcauauuuaaugcuuaccucaaaguaauucaaguuuucaggcuaauucaggugccaugauuacuuauaaauuaguuuuguauaauuauaaauauaacauguauucugaaaauucuaggaaaauguagacaaaaugucaaucaccuauaauucaucccuaugagaccucccuuaaaguuggagcauuuuuuucuugcauuuggaaacacauguauacaugcaugugaccuguuuucuuaagauacuguaaauauuuccucuuacuauuaaaaaccacaaggagguuuaacauuggauucccaaguccacaguuaaaaggaaaaaggaacuauuacucaauagaugcuuccaaagcacucgauaaaauuuaucucauuaacaaaagcuucauauaaacuuuaagaaaacuagaguuaccuaccagaagucauaaugggggagcugaggcauuuccauuggauucaaaagucacacaaaaaugucagacauuaacuucugucauuuacauuuguaguacagaugcuaaccaacagaaaagaaagaagcgaagaauacauauuaaaagaaaaaauuugggcugggcaugauggcuuaugccuguuauuacuggcacuuggggaggcugaggcaggcaaaucgcuugagcccaggaguuugagaccagccugggcaacauggcgaaaucccgucucugcaaaaaguacaaaaauccgccaggugugguggcacaccccuguggucccaguuacuugggaggcugagguaagaggaucacuugagccugggaggugaaggcugcaaugagccaggaucgugcuacugcauucuagccugggcaacagagugagaccgagacucugucucuaaaaaagaaaagagaauauuuguuacuauuuguauguaggugaugagucucuuuguuucuuggggagauaauguaaaauuauuauaacuaguaaaagcacagugagguagccaagagaucaauauacagaaacagauagcucuuccauguauuaauagcaaccaauuagaaaaugauuggugaggccaggcgugguggcucacgccuguaaucccaacacuuuggggggccgaggcaggcagaucaccugaggucaggaguuugagaccagcccggccaacauggugaaaccccaucucuacuaaaacaauacaaaaauuagcuggacgugguggugggcacuuguaauccuagcuacucaggacgguaaggcaggagaaucgcuugaacccgggaggcggaagcugcagugagccuagauugugccacugcauuccaggcugugugacaagagcaagacucuaucucaaaaaaaaaaagaaaaugauuggugaaaagaccccauucacaguauaagcaaauauucugucuguaaaauaagucauauuggcuaaaacuguaaauuuaagagcaguuaauguaggagguuguguuguaauaacaaugguggggaaagaauucuuaaaauccccauggcauaaaccugaaaguaaaauuuugaauauuguauuuaaaaauauacuucccaacaaaaaacacauagcuccaggcuacuccuuaggcccuuacacuagaauauaaaucaacacacugcuuccuucaucaagaaaaaugucaguuguacuaaauaguauaguuaccaauguaguuaaauaacauucugguacaaccucauuuugucauggaccaauaaaacuugcaaacaauugguguaauagcaagcagcuggucugcauacaaaauuaggcagcacuuuguacaacagaaguuaacagacccaugguagauuaaaaauguuuaacaguguuuuaaaacugaaaagggacugcuaauguagaauauccaaggaacucuuccagaucaacaaggaugagcaaaggauauggauaggcaauuuauagaacaggaaauucaugugaguagaugcccauacucaguaauuagagaaauaaaaauaaaacaagguacagcuuuguaagcaucagauuugcagaaauuagaaaacuauauaaugguaaguccuggcagguaugugaagcaaugggaacccucauacauuguucauaggaguguagacugguucucauggguauauauuucaaaggugagaucgcaucauuuccauaaacgugaucucugucagaguauugcaucaucauuugugguagugaggaguuggaagcaaccuugguauccaucauuaguagauacucaaauaaguaaaauguggcacaugcacacuauggaguauguagcaguuagaaacaguggaccaaauaauacagcaacauugauggcuucuaaacauagugguuagugcauaaaaaaguaaaagcaacaguuuucauugcucaguaccauuucugaaacuuaaaaagauguacacaaugcaacauauaguuucaagaaagaaaaauuaacagacaucaaaaguuauaccuuugauagaagggaaucugaaugggcaauaaugggacagauacaugaacaaguacaguagucuccccuuauccgagguuucgauugccaugguuucaguuacuugcaguauaauacaauaagauauauuaagagagaagccacauucacauaacuuguauuauaguauauauuaaacuuuaucaucaguauguauguauagggaaaaaauguguguguguguggguguauuauauaggguuugccacuaccuguauuuucggguauccacuaggggucuuggaauguaucccuauggauaagggaaaauaaaucuuaccagcaguauuuaagaucuguuagaccaacacuaaaccuuuacuuacagauuuaaaagauggucuaaauagagacaaguaacauuuuuuaaaugggaagacuuaauguaguagaagcccuuuaaugaaauuaggaccaaugauugguaguuuaauuauuuuaaaaaucuuguuaaagcaggaaauguuuaaaaagugauugauacauaugauuuuuuaaaaacuaaaauaauucccuuucccaucuuaugugggccauaagacuuaguaagaagcagucuguuuucugacauaaacuacaacuauaaucugugauuacuuuaugguguugcaccgauugaagaaaaggagccugcauacaggauucuaaauuuuuuagaguuuaccccugaaucucuucauaauuugacacuuuuuauuuuagcaucuugccuuuuagaugaauauuuugcaaaauauucgacuuaguuuuugugaaauaauucccuuucucauuuaaaucagucaaauugauuaaguggaagucuguuaauagcaucaacugagacacagaaauaaaugagaaaacacugauaaugaaucagggugaguugcuguaucagauaauaucauaaagcuauagugguuuuauuauaaagccaaguuuuuaucauaaggcuuuuuaugauuaagccaagucuugcaguuggcacaggaauagacaauacaucugcaaaaugaaagaguauaccuuauguugcuuagaacagugggacaguaggcuguuuugaggggaaaauguguuuagaacuuuucuucacacuugacauaaauccuaggaacguauuuagagguaaauacaggugacuuuuaagaucuuugauaagaguuugcuaagaaaguuaacagaccuagaagucauuaaaaauacagcuuugaucauguuaauuugguuauuuguauaggaccacaauagcaucugacagaauucacaucacccuacuuuuaggcugauacaaacacacuaauauuucauacuuuaauuaaauguucugacaauuuaaguagaaguuaaaaugcaaacuguuuuugguauaaguggcucacauauauaaaguaucggguauguuucuuuguuuuguuuuuuagguaauucagauccaguuguuguucuuccuuuggaugauuuuaccacagaaaggacugcuuaaaugauugcuuuuuugucccuuugcauuuuugacacuuuuuaccuuugagaggcuugcuacuuuuugcucugaauugaucuaaagagauuguagauuggagguuaauuucuaguccuggagaauuuggaaucuugacaggugcaguacauugcagccuuugguaauagauugauguguuuggugcuuugcaauaaaagauuuuuacagguuuuugagguuuagagauaauuagguauuuaguaaugguaccuccaauacuaauaucccucauuaaaauuuaaaaauuucauguuucucuaaaauguaaaauuucucuaaaaacuugacuuguucaugugggcuucuuuuauuuauguauuuauuuuuuuugagacagagucucacuccauuacccaggcuggagugcaguugcacgauaucagcucacugcauccuccgcuucccaggcucaauugauccucccaccucagccucccuaguagcugagacuacaggcaugcaccaccacacccggcuaauuuuuuauauuuuuuguagagaugggguuucgccauguugcccaugcuggucuccaacuccugagcucaggcgauccacucgccuuggccucccaaagugcugggauuacaggcgugagccacugccuguccuugugggcuucuuuaacaaugcucauagaaaucuugguucaugucuuuucagucuuuucaggcaacuuccuuugcaacaaacacauucacuugcauguguauaagaaccuggauuuggaugugaaaccuacuuuugccaacaaauauuaaccuguuucugugucuguaaauuggggguuacaauaucuaccucauaguuuuuuuaggaucagaguaaaggaagucauaaauaaaaccuguaggguuaaugccaucauguuggaaguacuuaauaaacagcugucauuuguagauggaugucaaccagagaaacuacaugccauucuuuuguauuugcuuucuuuuaaaauguuacacaugcauuauuuuauaagugcaugcauauugucacaugauuauuuucaguacagccuuuucccucuugguucaccuccccauaaccucaaauguauucuucucuauauauuaucuucauauuauauugacuguugaggguguuuuuguccuucaguuacaaaugcaggauaccuuacauccuuguuuucuuauuucagaccuuguucaaaaaucacuuuaaagucaccuguauaacuauaggguucuuuugauggcugcauaguauuccaugcuuuggauguaccauauuuuacucaaguucccuauugaugcauacuuauauuuguuaugaaugaugcuacauuaagcaaucuuauauaugaauuuaguuacugauacauuuaauaugauauuauaagagaugauauggagaucauaagauagagucccagaaaucucagugugacuuuauuggcacuucacugaucaguaaugauuuugagcaucuuuaugcuuggccauuaggauuuguucuugugaaagguuuuaucuuuuguccauuuuuccauuugguuacuuuuuccuacucuguaaaaccauauuggagauauuaguccuuugucaucuuaaaaguauuuuuuccccuaaucuucauguauauugucuuuguuuauuguguuuuguaugugauguuuucaaaaaugguucagucaaugcuuuuauauaaaagauugaauaucguguuuuggucuuuaugaaaagugacuuuggauauggugucuuuccucauaguaguuuuuaaugacuaggucaacccagugaugugggcuaauugugaaugugaacagugauuaguuaacuacagauguagggaaaauucuccagaaagacuuguugaaucaguugaaagccaguuggcuggcuuuugugaaggucugguauacucuaggucuaguaaacuugaggaugcaucagaaucacuuuauuaaaaaauauauuagucuuccucaccuccaucccaccuaacuccugaguugcugauucauuaggcuuggagugggccucagaauuugcauugcuauaaaguucccagguaauauuaauacuaaccugcugguccagggagaaccacuggccuagucuauuuuauuaaguuacaaacuuuuaucaaauucuuauaauuccaucuuagagagcaucaagccuuuuuccugaugucugaauauuuagcaaauccugucuagugugagguaguguuguauaugccucuguggcauaaugaauauaguuauuuauggguuaucuacuuaagggcuaggauguuacaguaacacuaccagauaggugaauacugugaggcucagaaguuacuuauguauuuuuuuuuuguuuuuuguuuuuuugagacggagucucgcucugucccccaggcuggagugcaguggcgcgaucuuggcucacugccagcuccaccuccuggguucaugccauucuccugucucagccucccaaguagcugggacuacaggcgcccgucaccaugcccggcuaauuuuuuuguauuuuuaguggagaugggguuucaccauuauuuuuggacaaaggcccugggcucuuugcuucugcuaaaaugugaagaauaauaucuguucuuccugucuuaggcauuuggggauucuuugagcauggucauguucguuuuuuuaaauaaaaacaagcuuacuuaguacuugagaaagcaagauaaauagauaauaaauuaauaauaauaagggcaaagaacuaguguuauucugaauaguacugacuaaaaaguacccuagaaucuuaacauuuaauauguugauuuuguuggcagcgaaacaaacuugucuuccugauaaaaauaggugcuugguguuuuauguaugcaacaaaauuuaucauaauuguguaucuacucauuuugguauauuuucuuagucuuuaucugaugaauauuucuucacaagaaacauuucuuuauauuucauauaauguuacuaguucauaaauauaacaacagcacagacuuucgugagucacguuugaguuggcaggguuuuuuaaggaucucagcuuaccaaaacuuucuaauuaaaggugcuuguuuuuuaucaaguugcaaaaguuggcaagaaggauuuuguggugacacuaauaaaaguauucugaaacaauuaguuggaauaacagaagaaacaaaaggaaaauaauuguguagauacacagccuuucaagcuuauucugccuugcagauucagacuuuugguuugacuuaccugucuguucucuguagcaucaagccuuuauacccucauccuuacuuuaugguuuucagcaaauugcaugugucuucgucuucacuagauguccugggaagagccaagaaaauauugaaaauguaaugaaguacuuauuagguauuaaaccauuuuauaaagcuauaguaauuuaaauagugugguaauuaagaguggaauugaccaaucaguagguuccagaagcagauccaauguguaagaaucgaauuuaugguuaagauggcauuucagauuagcagaaaaagaauggauuauucaaauaagaugguguuguaaaaacuggcuuacucuuugggaggcaauuaagguagauucuaccucaucaaaguaaaauuaagauguaauaaaaagcugaaauguuaaaaacaugaaguuauacaagcauugaaagaaaguauaacugcaugguuguaugcugcuugaaguggcaagauauuuucaagaaugagacuaaugccaugaaagaagaaauugauuccauuacaguaugauuuuauaccuucugucugugaauauuuuagguacugucaauugugccaucuaugguuaucucaauuuacuucacaguuuucuucuuacuuagguaauuuccaguauuuuucugugguaaauaaugcuacagugaauaucuuuaauacgugacuauuuggccauauuuagcaccagguguuuguuaccuuuuuuggggucucacucuguugcccaggcuggagugcaguggugcaauuucagcucacugcaaccucugccucccggguucaggccauccucccaccucagccucccuaguagcugggaccacaggcaugcaccacaugccuggcuaauuuuguauuuuuaguagagacgggguuucaccauguugggcaagcuggugucgaacuccugaccucaggugaucugcccgccucgggcucccacuggcugagugcugggauuacaggcaugagccaccgcaccuggccgucuguuaaacaucuuaaugaaugucgaaccuuguauuuuacagauucuugucucauugccuuaaacuucccuaguuguuuuaaacuucugauuauuuuuuagaguucugauagacuugaauuccgacagucaguuuauucacuguuuuugugaaggugugggcuuaugggguuccccauucugccauuuucacugacagcauuccuaguagaacagucuguuuuuaaccagcugggagugggggauauacauaucuguguccaggcagacuuucucacuuagguuuucacuagagaaguaagcccuaaugcccuaagguauccauuauuaauguagcaaagagacuucucucuugugcaucuaagguggugcuaguuauguaccauuauuuggagaauaaaaugaucauucaccauguucuguguuucauauaugauaccuggauugagaaaugcugccaguagaucaaguguaguuugagaaagcuuauuucucacaggauagucagaugauguuuuauuuauucauuuauuuauuuacagguuuagaaauagcauucuauaguauguaccuuugugacuggcaucuucagugguuuacacuguuuguuuuugagacuucuuuggcaaguagugauauaauagcauuuaacaaagaggaaacacuuagauguagagagagagccauguuaguucaugguggcagcccagauccgaggugauugggacccacacuagacaggaauaaaaugaagacauagaauauaaguagcauuuugugcuucaaucaugccagacuuaaaaauaugauaaugcuuggcugggcaagguggcucacagcuguaaucccagcacuuugggaggccaaggcagaaggaucacuugaggccaggaauuugagaccagccugggcaacauggcaaggcuccuacaaacauuuuuaaaauguagccuggcgugguggcagcauaugccuguaguccuagcuguguggcaggcugaggcaggaggauccuuugaccccaggaauuugaggcuguggugaguugugauugugccacugcacuccacuccagccuaggcaacagagggagaccuugucuaucucucacacucucuucauauauagcuacauauauauaauuuuuauuuuuauaaauuuuauauaaaauuuauauaauuuacauauuuauaauuuuuuaaaaauauacaaaauaucuuuuuauaugaaauguuuuauauuuguaauauaaaaaucucuucaguuugacauaacaaauuaauaaauuuguuucaaauaauaucucauuucuuucacuucgucaauuguuugccugaacuauaugccuugccccaugaggcagggagauauauauuuuuuacauauauaaauacauauuuuauguaauauauguaaaauaauuaugaaugauuuaaaaauaaaaauacguuaaugcucuuaauguuaaagugauauuuuaaaggcuguuaagaugcaggcuaguuaguaagugagacuauguggcugaaguuuuguauuuagaagccaguugagccacuccccccauuaucucaggagcuuguugaugagguuuuagauuugaguggcaaaguacaguaguaauaaauaagguagaaucugcuuuguaacucagcucaugucaaaaagagaggaacuggaaagcaugauuuccucccuagugcuuuccucccuagugcggaaggugaguaggcagagccucaggcaaggccugauaggacaggagggaccugucagcacacgugacuacagggguauggaauauaauggcuggcaguugcugcuugaguucuuccuaggagcauccucacugaacagugaaauugaucucauugaagaaaucaccuuuaggcagaccaucuugccuugauucuuaaguucuuauuucuguucguuuuuuccucuuguuugacuuucacauuggaugucuucucaacauuauguuccaagcagccacacacucuuaaauauauauauguauguguauauacauagagagaaagagagauaaggucucacucuguugccuaggcuggagugcaguggcgcaaagucaccauaagcacugucuuaacacuaucuuuuuccuuuuucaagagcugggguggaaaggagaauggcuuuggacuugcagaauguugcagagacuugcauaugaugguaaguaacucuuugggauaugggugucuuuugacagagcuguggccucucugugaaccuuacuuuacaaugaauugugguauaugaagugacgccuucacaucgagaccuuugaggaaccuaagaucaguucagacauagcugaaccacgucuauaggaagcagucuagcagugcuugggcucuugaugugcuggugguagauaaaaaaaucugagaaauagaguguguguucauacccaguucuugaguagguagcuguauuuguugaauuaauuuuaaugugauuuuuuuuaaaucccagaaaguauguucgcuugcauucucacacuggaacuauuguaucagaacucuggacaguguggugugauuuaggaauggcugcuuggagagcaguucuaccauuagguuuauugagaacuuauaauguuuuaugugcuuuccuuguuuaucucucugccuuucacccauguuuaaguuaugagcucaggccauccuccuuucugcuuugauauguugcuguggagcuacaaaacacaauuugauuuucaauaauuauuuugcaucuggaagcaacuauauuuuccacgugggauuugucuugucaguuugucguguuuagcacaaauggcugcagugaaauuuaguguauuuaucuuagcaagccuuuuuuuccuaaagagaauggcucuuuucuggucucagaaaaccacagauuagaucaaguuacuuucccacguuagcuggcauacuuuucuuuagugauuauuuuaugaagagauauugggugauacaguaggugaguguugucuguuuaauaaucaaaacuacauaaaucuugaaguauauucagaguuuggaauucuaauuaugacaacauaaagguuaacguguacuuuaaaaggaaguaauacauauacauguuaaaaaauucagaguauaaagagguaugcagugguaacuucuuaauuuuccagaggcaaccacugcaaguggugucuuucagugagacauuuuagugggcauucugcugucaucuuaauuuuguucaucauguugcuuuucuagaguuaaagagaauguuuugucagggucugguuuauguugucuugguaucuaccugugcagaaaacauaccaugagaagugguguagaaugguauagaaggaaaguguuugaagaauuaugaagauaugccuaugaggcauacuuugaauuaaauauuucagaaggcugaugauagguacaagguuuuucguaggaauguucuuuuccauucuuuagcugguuucugggcccugguauuuguucuccauccuuucuuggauucuuauucauuacugcuuggcagucuugccccucuuuucccccuugggaauagccacagucaaaauugaucucuuaaagggaaacuggaaauuuauaaguaugaaaugcagaagguuugggagcucugggcucuguccuuuugauucuguuugaaaagucucauccuaucugagcucugcucuaagacaaacaguuaaaggcacuguagguacugaauguacugcuuauucuucugccacaauaaguugaacaaguggcuaggacuuugagggaagaugugggggauaauguuuauaaucaguugaaacucaaugucugauucuuugaugugcuuuauacacagaaauauccacccagugcaacuacacuacacuuugaauucuaugcagauccuggggccgaggucaaaauugagaaaagggugagucugauucagauuuguucugacaaagucuacaauuuacuguaacugggauugccucuucuagaacuccucaguuaaaugaauaaaugguuuugagcuacacugcugcccucgcaaacuauaaauauaccuagcagcuccucaggaguguuaauugcauccccaacucugauaggguugggucuuauguugggagcugccaaaagaugcaagucccauccauuaugaggcacugcuaugaccuaugugcuuuucccacagucucugagaauuccaacauguaguauaguaguuuggauggugauggcucagguuucucuaauuaggaagccugcaaaagucuuuauguauuguggauaguguccugcuuaaauuaucuggucauuuuguauuguuugaggagguacuaaagaguuugguuuagaaguagcuuagugaaaauacaauuucucuucuaccuauacuauucaauaaauaaauaaucuuucuagcuuaauugccuugaaagcaacucuaauacauauucagagagaaaauauuuucaugaauuuggucuuugcuauuaauacugcuauggauauuaagucaguggaggguuaaaaaaggacaaagaagaauaugaaaugugccuggcuaugugcauuauaguuugauacuacugguuuuaaaggagcuuuccuaagaauauucuacauauaagauggauguuuuggaagauucucaauuuaccuugauuuuaagagcauucacuuaggcuucagccuauuaggugacaucuugguuuucagacagcccuuuggagcucuauggaaggggaagcuagaguguucagugacuccuuacagcucucuugucuuuuuuaauuuuagacaacuaguaacacacuacauuauauucacauagagcaacuugacaagguaagaggaaucuuugacucuuggcucguuucuuaauguuugguucacuuuuuguuccuaacuauaucuuuuuuuuuaauguagauuucagaaagcccuucugaaaucauggaaucucuuaccaaaauguacagcauuccuaaggauaagcagguaugauguggcuuuaaaacauccacaggaugugguuguuaucuaaauagauuaaugauauguacuggggugggagauugcauagcagaaagaaugucagcuuuggagucagaccaugggcaaauuguuagcuucucugagccuuaguuuccuugucuuuuaugagguuaacacuuaauaacuuccuaggccuuaugagaguuugaggaaaacauaaacuaccucaccgugagcagguaauaaguggugguagcuuucugaacacuucggauaucaaaggagaaaacguuuaguuguguuguuuuuugaguuagcccucauaaagaauauucaccuuuuucauugauguuuuuaaaauguaugucuuaucucucuacagaugcuguuauuuacacacauacgacuggcccauggcuuuucuaaucacaggaagcgauugcaggcaguucaggccagacugcaugcaauaucuauauuagguaagagaagaauacuuuaauuaccaggccguauuagacaguuugggccugauuuccuuugaacuucauucaucuuuguugcuaugaguccuauuauaguuaccuagguagcaacuuaaauacuuccaccccucccaguguucacuguauuuauucauuauccuugagcuccuuaauguuggacgagaaagaggguaugaugauguugauugacaugucaccuggguuuauucuugguauucgucucuuuuuuuuuuuuuuuaauagauaugcuuguagcuaucguucacugucccccuacucuuucucuugccauugugucuuccuccucucucauccuuucagggauaucauuuugaauuaagucacaaaauauucaguagucaauacugugcauuuaacuucuuuuacuguggcacaguaaaauggaaaacacgugguuuuguaaucaguccuguacucugucccugauucuguagauuauuagccacacuuauccucucagccucagcuuauucguuuaauauugagguacucaccguagaggcuggucuaaagauuaaaugaaaaccuagaaagcaaucuagcacagaacaagcacauagaagauauaaaaugguaaccauugcuguuauuauugauguucauuauguuaugacuugccuucucuuaaacuaugaguuucuuggcgugaaauucuugcucuuuuauguguacucauaucuagcaugauuucuggcauguuagugggugcucaggaaaucuuuguugaaaacuaaaugaauaugccuaaaucccauuaguuuaugcuucaggguacuguguccgguauuaaccucaucguggaauucauugaaugugaauuacacacauucugaaguuuuacuacagugucacacaaauuucugacuuacucugcaaugguccauaaauucuguucuuuacaaguguuuacaguaaaagcagaagcauaggaagaggcuaaaauggaaaucuuauauugaaggcauaguggaguuacaucaaguaguaauguuaugaaaaauuaacucagagcuuuuccuauuuccauccccaaaauucuuucucaagacuaauaauaccuuuaguaguggaaucugucaauucagugucuguuuagagauuaucaguuguauuugauccaguccuucagaauuuaauuuggugaugauucugcccuccauugcugguugggaauggaauucuuccccagaaccuauagauaccaaaaaguuuguuauugggcaguggcuugaccacugccuucuugccuaaaguguuuguuucuccuuuugcaguguauuccaaugccuugcaggaaucagcaaacaguaucuuguauaauggcuugauagaggaguugguagauguccuucagauaacggauaagcagcuuaugguaaguauuuuacagguugaguaacccuuagcuguaacacuugggaccagaaguauuuuggauuugagacuuuuuuggggggggaggggauauuugcauauacauaaugagacaucuugggcaugggacccaaguuuaaacacgaaauucauugauguuucguauacacauuauauacguagucuuaaggcaauuguauacaauauuucaaauaauuuugugcauuuuaacugugaccugucacaugagaucagguguggaauuuuccacuucuggcaugcagguauucccaaaguuuuggauuugggaauauuucagauuuuugaaucagggauccugcauuaauguucucuguauaucaggcuuauacuuguuugccuuuugguuuuucccagaggguuagaaagaacucccaguacuucccucuuuggguauuaaacugcaaaacuaacaaauacuagauuuucauuguugcucucaacagaccuccauccccucaagcaguuaccaguagaaugacuuauauuuuaaaguuuggauauuagcaacuggaacuugguucagucaucuuauuauauuugacacauuauguguuuaccuucuaauuuaauaggagauuaaagcagcuucuuuacgaacauuaacaucaauuguccacuuggagagaacucccaaacucagcaguauuauugacuguacuggaacugccuccuaccauggauuuuugccagugcuuguaaggaacuguauccaggccaugauugguaaguuuugauggugauuaucuuaggcaagaagaaacauuugcccucugccuuugucuuuuuaauauccugccugcuuaacagcaauuuugagcuuguuuuuguucucccucuccccaccucccuuguagauccuuccauggauccauacccucaccaguuugccacugcucucuucucuuuuuuauaccaucuggccagcuacgaugcugguggugaagccuuggucuccuguggaaugauggaagccuuauugaaggugcuguacuuuuuuuuuuuuuuuuuuuaaacuacauggggaaaucaacuaaggguguagagaugcaaguuugggguguuucacagugagggcaaauaauauaagaaagcuuauccagaaaaaguuauacuuaaguagaaggccaguuuggcuuucuaguuaucuaauuaacaauguuuaagagcagcuacuuccauuauugagacuuuuaucauaguguagaauggucaggaggucauggguucugguuaaaacauugccacauguuaucaugccuuuacacaaccauagggaaaauauaugucaggguacuuuguaaguuguguuguaguaguaauagccuuuacuaugugcagggcaaugagcaccagcuuuuuucucccuaaauaucuuacuuaauccugcaaaguaauugauguccccauuaccucagagguugagucgcagaagucauagaacugucauuuggcaggcaccaaaaauaaaacacauguuuucccccauacugugcugccuuacugaggccccagacuacauguauacaaaagcaugcaauuuuuacaacuuugugucuuuauaguucauuguuuuugccucuuuuucuccgugauaggucauaaaguuucuuggcgaugaacaggaccagauaacauuugucaccagagccgucagagugguugaccuuaucaccaaccuggauauggcagcuuuucaaucccauaguggacuuucuaucuucauuuauagacuugagguauuauuauacaaggaaugcuuugcacagaauuuaauacucagagcugaaccuaaggauuguccugauaacccuaaagagcgaucuuacagucucuucuguuucuagaaaucaacuguguaucugcuugcaguguuuuuccauuauaauaguuuuuaaucccugaaaaaauauauauauauauauauacuugauuuucuuauaaccuuucucuugauuguagcaugaaguagauuugugccgaaaagaauguccguuugugaucaagccaaagauccagagacccaauacuacacaagaaggagaggaaauggaaacugauauggaugguaauuaacaguuauuaagucaguauuuuugugcuugagauuuuuugucaucccaccccaguuuucauucuuccucauaaauuccaaaguacacaauuaacuugaguauauacuuucagcaacaaaaauuuuuuuucuauguaagugauuugcaaauuuguuuuucacaaagauaauaagaaaagaaagguacuaguucuuuggaguagagauggcagguaaagcagaugcuauagcugugguguuaaucuguuuuauuucaucacguaauuuucuuauguauuucuuauugucuuauuucuacuaaaauucaagcuccaugggaucaggauauugucuuuuucacugccgcagugccugauaacauccuagguguuagaaauaugcuugguagagagagagagacuaaaaugggaccuuuuaaaacuuuaccuauuuugagaagagaaaggagagguaaaaagguuguuggguaggcaacaacauccguuaggcuggcacaucacuugagcccagggguucgaggccagccugggcaacauggcaaaaaucuugucuuuacgaaaaauacaaaacuuagccgggugggguggcaugcaccuguggucccggcuacuugggaggcugaguugagaggaucaucugagccugggaguuugaggcugcagugauuucaaaauguaaauaguauuuuaucacugauggagccuuaauacauuuuauaaacuguagucaaugauuguguaucuuauacucaguuauucaaguguauaaaguaaaaaugaaugcucacuuaccuaccauagcuacuaguuucggugcggaucuuuccaggcuuuuuuaugcauauucaaauacauguugauguuaaguauguauguaguauuuuagaaugggaagaugagaucauaaacauacuguucaucuugcauugcucauucaguguuucauagacauucuuccagaucggaauauugaguauuaaucuuuucaugcuuuuuauauuuauuaauuacucuuuugaaaagcuguaccuauuuguauacuaccaacuaguaguauaugaaauugcacauuuuacuuaccacucucccccucuuccccaauuugguaggugagaaauauugaaggacuucuguaggauuguuaauuuacacacacacacacacacacacacacacacacacacguguauguauguacguauuaauacaugcaacuagugauauauuuucauuuugggguucaguauuccugaucuucauuuuuauauucauuucacauuaauggaagaaauuuucucaaacaaaauuuuucuuuuugugguaccuuuuauucuaguaaguuucuuuaucauaacuuguacuuuaguugcagauguggcuauggaaagcaguccaggcucauccaucucuauggagcacaggcuggauguugaauuaagggcaucagguuccagcagcagcacuaacaucucuucuggccccagcccuggucccagucccggcaccggccccggccccggccccggccccggccccggcccuggccccggccccggccccgguccuggucccggcccuggccccggcccuggcccuggcccccguccuggugcguacacacauagaugugcagucuuucagagugguagaguuauuaaacuauugaagaaggcggcuuuaggcagaacuuaaaugguacauuuggagguuagcaucccaugacuauucaugcuccuucaccauucugguguuccauuuucuuauauuaacaugucuuucauagcauuuuauacuuuuccaacaauuugcacauugauuaucaaaacagccauguuggagggcagauaauauccaaaaugggaacugagugagguaaaaaaaaaguugaaccuuuuuacuuuguaauuuuucuuuuuuacuuuagacuuuuaguauugguaaaauuaaaaguauuaguaauuuuuccaauuucaaagcuuaauuaaguauucuuccuaacauucagagaccucacuucgaaugucuucuaauuuuauuauaguguauuuggaucucuuaaaauuuuguuuuaugugcuugaucauugugguuuaauggcgaacucagcauaauucuuuugucuuucuucauugccaggaguccaguguauuccacaacgagcagcacuucugaaauccauguugaauuuccucaagaaggccauccaagacccugcuuucucagauggcauacgacaugguauuugauuccagauaacuuuuuuuggaggauauuuuacucucucaaagauugguucuuuucauacuauucuggcaccuguuguuuuacaaggcagucuuugguaaaggccaugccauuuucaauagcuuuuaguuguuuugugucacuuuuccuagauguaaguguugcuuagcuauuuucauaaugauuuacccuuuuuuuccccuuuuccagcuuucgacucugugcuuaauuccgucuuauuaccccuuucugacucuuaaguguuuguguucuuucuuuuuuuaacccauguuagaaagccuauugcauggacaaauaauaaaauaggaggagacaacugggggccauuagauuagaauuaacacaggcuuugaggaccacagugugauaauacauaacauaucacucaauuauccccacuccucacaccuuuccagacuauucguauucuccauaauguucacuuuucuuuuagugauggaugguucucugccuaccucccugaaacacaucaucagcaaugcagaauacuauggcccaucacucuuccuccuagguaaguggaguugauaguugguuauaacaauuugggauaaccuggcagagcucucucucucuguauuuacuuacuuacuuauuuacuuauuuauuuuugagacagagucucacucuauugcccaggcuggaauguaguggcgcaaucuuggcucacuacaaccucugccucccggguuaaagcgagucuccugccucagccucccgaguagcugggauuagaggugccugccaccaugccuggcuaauuuuuguauuuuuaguagacaaauaugaauaguaaaauccugcaaggauauaaaacacagagaggccgggcauggaagcuccugccuguaaucccagcacuuugggaggccgaggcggguagaucaccugagguaaugaguuugagaccagccuggccaacauggcaaaaccccaucucuacugucuaccuggacaguagacaaaugucaauaguaaaauccugcaaggauauaaaacagagaggccggguagauaucugucuuauuggugaugaaauaaaggucagaauucaguuuuaaguaaauaccuauuuucugggugcugaauauaccuucgauaaguaguacauuuguaguaaguaacauuaucauacauuuuguuuaucugugcuagaauucuuaaaacgcuaaaggaauuuaguaggagacguggaaauagggaaagucuccuuguaguagcaagcauuguguuuuacaguuugggguguuggggagacuaguuuuggcuacuacaacuuagauacuuccuugcccccuugcugaagaaauuuaggauuuuuguauauuaaccuuguaucuuuuaaucuugcacaguucacuuauuaguacauacuuguuuuguuuucuuagaauauucuacauaaucuugucaucugcaaaugcauuuuuacuuuguuuauggucuuugugccuuuuuuuuugucuuaugacauuagcaaagauuucugauacagugcuggauagaaauaagaaugggccucuuugcuuuguuccugaauuuagagggaaaagcauuuaauauuucaccauuaagaaugaaguuagcagagguuuuguguugaagguuuugucaauuuugucagguugaggaagucuucuugugguguagcaacucuaccaugcuauggaaaagcucucugcuaagguuauguucagauggcaaaauucagacaauaguucuuugggguuuuuuuguuuuuuuuuaagauuuguuuuacgguggggacgucucaaggccaggggcagggagaaugcccgucuucugggagaaaguccagaacagagagaaagagaaaaggauacacaggcauuuuucuauaaaugggaagcuuagaagaaggagcaauugccauugacagggauauuguuuaaaagagggaggcagcaagaggauauagugcuuaggugcugggauaguggugaggagcaggugagcccuaugaggaugaugccagaagugagggacacgggcaggaaaugagacuuagagcacuaaaucaaaggucagugaagguccaacuuccuucccuaugguuuucuuaauucaucccucacauuuaaauuagcauagcaaccucccaguuuucccauaaaauacacuuguacuugagagagaacaaauuugcaaagcgaaaccuaaauaauuagacuagccauuguuauuuuagcuccccaaaugauaguacagagccuuucacuccagguggaaggagauggcccaggaaagacaucagggaguucugagaaccucuuggaguauuuuaauaauauaauuggcaguuuggguuuauuuuuguugaacuauucuggauaccuuuucuuuauuaaugaucaugcaacaggaagucccuuuaaggcacaagcacuaucuugaaaugccaguagguaguuucaugccagucuguuaucaacuaucauaguaacuaaacugcuuugucccucauugagggcuucuuaggccugaacuguuugguuaauguggucugucaggaguuacaacaugucucgguaaccucuaugaguugagucuguguuacagaauuggaaauaccuaaacuugugcccguuacaccaaagauucugaugaggcccagaauagguaaaaagugcuccuuuuuguggcaagacuugauaaaacagcuagacuuucuaguugaauuugaggugcccugggcacuaaauguccauaguacauaggucagcuuguauggguagaagggaacaggaucgcugaauaaaauguauaacccugcugagcaggaguuguaacacagaagaaucaguagcccaagagguuggaaguuggaguuucuagggggcaaacuuauaucaggguggacauucucaacaggggggcaucauuguauguacuaucaguugguggcagaggcugggaaagacaugaaauccuuaagggggaaguuuaauauggaagcacccagugaggucacgauguccugcuuauaauuucacacucaaacccacuaaauauucugacuccuucucccucacguguccgaccucuggcucuucuaugccacuuuuagccaccuguauuucauuuguaguaucccauuuaacuuccccaacuccccucucuucuuucucaccuccugccuuaccccucauguuaucuguucgggucuguuuguagccuaugcuaaugucaucaugcuuaugauugaccacuuaaccagagaguguagcaaguugucaauaugaguauugaaauccuccaagggagcaagauauaguuguaugaguaguugccugggcuaggguaucuguuaguauugcuggagguuuaguauguagguggcauucucuguuacuaauacauagauacaaucuaucagguugagugaggggaagcaggaaauauagguagugacuggaauagugaaauuagaguguaaauagugaaaguggagugugggcugucaaagaguugauggggcaguggaguuaugaugaguuaugugggggcaguuacaagggcaguuaccaucuugaggguguuagcgucaaggcugggacugucaguuguacugaaaucaucaucuaggaugcuuugguaugcuggauggauagaagcccuaggcucgcacuugagaaauuauuauaaaaguaacucaguaucccuuugccuacaagaguuuuagaauaauuucagauagggaagcuaugcacugauuaccccuaaacaagugggaucacagcaugggcaaaaaggagcccaagaaguuuggcauugagcugggguaguaguaucccagacccagaccaugagccaaaugagguauagacaggccaacuagagccagaauauuccacaaagauauuuucaggccuguggugcguagacuuuuggcaugccgaagugccaguuuauuaugggaaucacaggcauugccaucccauauccugcaauagucucccauucaauaccucuguaauaaggugguuccagaacuggcuuccugucuaagaauguugguacuaggaacuaacuuaagauuuuucuuuccucuuuggaagaaccauacaguuguguaugucaacccaggcagagagacuaagaccuucauuuccuaugaagagggaucuccaguuagcaguccuuuaaaaccaucauauuaggaaaggacuuuggcagagaccuucugcauagucuuagagggugagggcccucaauuuucugugggucccauccuguuaccuacuuucaaccuaggcuccuguccaccguggaucgcaccaauaucaaaugaggaggugucguuaagugagggggauucuguuuggguauuauagacucauagauggaaaguaucucauuuugaggcuagaaaggggacaaaggaagcacuaauuguguuuuuucagaugucauacaacuaaggcaaucggcaaaagagagaucaauuuaagagaccauuguccauuuaguaaguuuaagagagcauugaacaagccauuaugccucuauuaggccugcuuucugugaacaguacaacagaugggccaggcacuggcucacaccuguaaucccagcauuuugggaugcugagacaggcagauugcuugagccuugagcccaggaguuugagaccagccugggcaacauggugaaauccugucucuacaacaaauaaaaauguuugcagggcaugcuggugcgcuacucaggaagcugaggugggaggaucacuuaaguacuggagguugaggcuguagugagcuauaauugcaccccugcacucuagccuggggaacagagugagaccuugucucaaaaaaaaaaaaaaaagacaaauggaagcuccaaggugaugccuuguuugaaaaggcccaugcccagacugaaugagcgguaacguacguacccuggucagagucgguguuaccagaagcccaaagggaacuaacugagggcuauaauaguggugguguuggcaguaguugggcaggaaggauaagccaagaaugggucuguauaacaaucaguugugagggcauagcgauuugugccagcagauuggggcaguggcccaauaaaauugauuugccagugagaaaaggaguguuuaccucugguauggugagcccccacuggugaugaugccgauggcacgacagggcacaaagaacauauugggaggcuaggguuugaguagggcuaguggcauggggaugcaauggcauuugggcccagggacugugaugaccuucugccuuccuuuacucucuucucuguaaccuugacuuuccaaacucuguuggauucauuuucaguucuauugaaguacaucuguggguaauuuuuaaggugucagacuucucuuucagaaguugguggcuguuuucuucauuguauucuaaugcuacauuauuguagauaaccauggugucacacugguucuuguucuuaucuguauauaguuccugcuucugccuuuuuuuuuuuuuuuuuuuuucuucuauuucucugauuccuuuuaacuuucuccuggaaacccuaauuaccuuuuuuccauuucuuaguugcuugguuccacacacagcugguugcucugugcguguauauacccuuuaauucuaauucuugguuaucaguguuuuuguauaggggucccagugcauagugucguugcgacuucuugauaaaauaacagguuugaugucuuaguaauugcuuguagaacacuaauuuuaguuuuuaaauacucaauuuuaguaacucuauagaauucauacauuucuacaaauguaagucaaucgaggggagugucauaccaauaggaaccccaaaaaggacuuaaauuuuucagaaguuuauagcccaugaggaaucccaaaggccauugaaaacuguugguccccgguaacugcuauauaucugccauuccccuagcauuugggauaaaggagagaugcuguauucaccaucuugaauagaaaauccucugguuucuuuuagaucuuaggcaucaccauaaacaaguuuguucuguauacaugguuuauggguguuguauguauauuccucuucaucagguuuuuuaauuaaaguuauuguaguuauuguagucuuaugaguugggaagcuuugucuuaauuauuccuagaagguuuaauaaaacuauuggcuuggugccucucuauuaccuggauuuuuuuuuuuuuuccccuuuuaaaaauucuggaacgggcacgguggcucacgccuauaaucccaguacuuugggagacugaggcgggcagaucaccugagguuaggaguucgagaccagccuggccaaucugguaaaaaccccaucucuacuaaaaauggaaaaaucagccaggcguguugggugccuguaaucccaacuacuugggaggcugaggcagaagaauugcuugaacccaggagguggaggcugcagugagccgagauugcaccacuguacuccagccugggcgacagagugagacuccgucuaaaaaaaaaaaaaaaaaagaaaauucuuacuggucuagucugcuuugcugucacuuccugagauuugauuuuuaugacauuuucuuauuaaacuauacauuucacuuguuggcauauaguuuguagaauauauuuuucuguaucuaguuaaaucuccuuucucauucauaacguauauuacugcucuuuuuucuaauuuauauuauuucacuuguuggcauacacuuuguagaauaaauuuuuuuuuucuguaucuaguuaaaucuccuuucucauuccuaauguauauuacugcucuuguuucuaauuuauauuauugcucuauuuucuauagguuuauaagcuuuuccagugucuucacaaagcuagauauuggcuucguuuauccuuuuugcuuucguuuucacugaauucuuuuuucuguuaauucuucauagcuuguuugguuacuuuuuaauaaauacuuuaaugcuguacuauuuccucuugaguagaguuuuucccauguuccagaagcuuugguaguuauuacugcacauuuuaaaauauuauaaugucaaaaacugaucagauuaauauucaaggacucuugcauugcuggugauaguuuaaaauuguugaauaaccuuuguaugaggcaguuuaucuauuuucaucaguaaagcuugcauuugcuuuaacccagcaagcccacaucauagauuuuuuuuccuguuaaaagcagacaaaaacggauauauguuuagguuuaucauuuucacaauugaggacugguuuuuauacaugugguacaugcauuuaguggaauaguaggcagccauucaaaaugaaugggucguugugucgggagaggacauuauacgguaugacaguugugggggaaaagcaaaauauauaaaacaguguaaccucauuuauguaaaaauaugcccauaaaaauccuguaaguguagucacuagauucuuuauaguauugaaucucugauggagcaguauuaggaucuuuaauuucauaguaagcacaaggguuuaaauugcuagacauugaguauguauuuuuuuuuaagcuuuugguguuuuguuuucaguuucugugaggaaucucucaguuuuccauauuuucucaucuuuuuuuagcuacugaaguggugacuguguuuguauuucaagaaccaucacugcucuccucacuccaggacaauggauugacagaugucaugcugcaugcacugcuuaucaaagauguaagucuuuucugcuacucuguaaagaaugucuuagggcgugaaaauccuaucucuucuguguguaguguugaaucuaauugggaccugguugucaaaauuccuucuaucucagcuugauacccauggccggauuuuccuagcaucuacacucuuuuagaugcauucaagcucacuuuguuuucucuuuagguuccugcuacccgugaaguccuuggcucccucccaaauguauucagugcacucuguuugaaugcccgaggucuucagucuuuuguucagugucagccuuuugaacgccucuucaaaguucuucugucuccagauuaccucccagccaugcggaggaggagaaguucugauccccuugguaaguuguuaagauuuauuuuauaguagaaaauugauuuaguuugcaaggaaacucuuccuugaucaucucucucaucguuuuacugguuaggugugcuaaguuuaaugggaauuaucaucauacauucuauuauacuucagaaggaauacuucagcuucucugcucauaauauuuccaugcuucucaacaguucaccauuguacuuucaugguacugguagaaaauagguauuaagaagcagugguagauuuccagguucaccaucuggucugcagcaaugagaaauauggaguccugagguguucaucugguaaucuaguguucugauguccaacucucuaagauaacgacacauggauauuuuuuuuuuacucaguauacuugagaccagauaauugagagauuauuagcaaaaagguagggcuccagaaagauuacaguuuucaaaaaugugcuuuguacuuuucaaccaccacuguagcauuuagacacuaucauucuuaacuggagcagccagaggguuaaugguuuguacaucuuucuucucucucacucuguaauacuaguuuagaucuugacagcaaagauugccagaguagagugcagcacacauaguuacuuuaaaauaguuuacuaaacugauuccuuccuuuucccuagugauuuggggggauaggggcuggguguaaauucauuaaagaaguuguggcauuagaaaaucacaaccaaaaaaaaaaaauaggaaaaaaauaucacaacagccuggccuggcacaguggcacacaccuaccauuuugggaggccaaggugggcagaucacuugagcucaggaguuugagaccagccugggcaacauggccaaaccccaucucuaccaaaaaaaaaauuucuccagucacggaggcgcacaccuguagucccagcuacuuggagggcugaggugggaggaucgcuugaguccaggagaucgugacacugcacuccagucugggugacauaaagucuuuaaaggaaagaaaaucauaaccaggcucaguuucuucuuuccacuuuauauguugguacagaaaagagcccaagcucuauuuucuucagucuuucuaauucuaacaguucauuuuuugccuuaaggggauacugcauccaaccuggggagugcugucgaugagcucaugagacaucagcccacccuuaaaacagaugcaacgacugccaucaucaagguagaaagugauaaggaugugaccaugagcaugagagagcagagaaggggaagguuuuagaagauuggccuacuagaggucauuaggauucuugggcuauagcuguaagagcauuaugucugccucauuguuuccauguccuuagguugguccuuuauaaaaagauguugucauuuuaguucaucuuagaaagaagucucuguuaaaauuuuuuuagccugggugcaguggcucacgccuguaauccuggcacuuugggaggcugaggcugguggaucgcuugaggccaggaguuugagaccagccuggacaacauggugaagccccguuucuaugaaaaauacaaaaguuagccggguuugguggcgugugccuguagucccagcuacucuggaggcugaggcaggagaaucacuugaacucgggaggcggagguuguagugagccaagaucaugccacugcaagacucugucuccaaaaaaaaaaaaaguauuuuagauugagaauuguuuuccuuaaaaauuuuuuuccauuuaauguaaccuguauauaaugauuucuuuuauauauuauauggacaagcagacauggcuuagauuaaguuuguaaagcauauuacccuuucuagucuccguuuguugaucccuguggcugccccccacccccgccuuauuagcucugccaguuuccuuuuagaauuguuguugaaauugguauauaaguuccuggugcuuggugaauugggacagggagucagguucgucagucacuuauacagccgugugacgcucaacaaauuauuuaaguuugcagcacuucuauucccuuguuuauaaaauguaauuaaugaccauauucugggaauuauguauauaacauguauacaaaguguuugggcaaauacacaacacauagaaaacgcucuaaauauguuagcugucuccuccuccccauuccaugauuacuaauaaguaaucuuauuuccugugccuuucaguuacuugaagaaaucuguaaucuuggaagggaccccaaauacaucugucagaagccaucaauccagaaggcagauggcacugccacugcuccucccccaaggucuaaucaugccgcagaagaagccucuagugaggaugaggaggaagaggaaguacaggccaugcagagcuuuaauucuacccagcaaaaugaaacugagccuaaucagcaguaaguguuuacagaacagaucaucuagccauauaaucgugggcauguuaucaccucucuaagucuuaaugaacacuuucaucuauaaaaagcaagagaguuguauuagaucauuuuaaaguucuaaccgguucuaagaauguauuaguuuuuccuuuuuugacccuugugugucauuugugcuuugguauuuaauuguauugguugccuuaggaagugaucuuuuuuuaaaaaaauuaauuaauuuuuaauuuuuauugauuuuuuugagagagaguuuugcucucguugcccaugcuggagugcaaugauguggucucggcucauugcaaccuccaccuccugggcucaagcaguucuccugccucagccucccaaguagcugggauuacagacaccuaccaccacacuuggcuaauuuuuguauuuuuaguagagaugggguuucaccauguugaccaggcuaaucucaaacucccgacgucaggugaucuacccaccucggcuucccaaaguguuaggauuacaggcgugagcuaccgcauccggccaggaagugcucauucuuaaaagcuguugaugaaauugaaucagaauuugguccaucaaguuaauggacuuugcacagagaccuuauuuucccuuuguugauuugauauuccacaucgacugcuugauuuuuuucaggcacgugugaaaaacaauguacuuuugaagccugucuccuaagaaguccuuaaggggugugugaagauuuguuguugcuuguuguuuuuuuauuuuuguucauuuuguuacuaucuguucguuccagauuaauuaguagaaggcuuuggaauuuacuauaugacuguaaauagucaagaauugacugcuuagauggaagcagggaguuugcuuaaaggcuuagugauugguaggggguaguccaccaggcucuuugagcaguauucacauaccagggaugaacuguaacuguauaccuguaacuuuuagucaccugcaugcugaaaaugggauugaucuuucuggacaguccugcacucccucauauaauaaguggucuuuuaguguguagguaagucauucugagaaaagcuugagcauuuuaggcacagcuaugaaugcauuugagcugguccugaauggcaccuugggacuuaaaauuuaagguggaguugacaacaggagcaaaggccuagaauccgaaacugguauguccucuuggaacucuaaauagugaugagccugugggugucaaguguuuuaaggagaggcauuaacuacuaaguauauugcuuuguugaacagauaccuuacccugucugagaaggcaaaccuaucuucauucuagcaguaucuuuuguucucuuuuaaauguucuuuuucuagaagaggaggacacccuggaaaaaagcacgacuuuuuuuuguagacgagucuuagugcuuccuuugucacacccuugaaugucagugacccuacuggagugugggguuccuuuuccuggcuacaaauaaggaaaaauuuuaagguguaggugguggugguuuuaauucaagcucauauauauucaucugcaugugacgucccuaccuggauauuuuccagaugccuuacaucugaugugcccagauuucaagcugacacaguuaaucagcacacuacccucauuugcuuacccuccuuuccuuucuugggcuaucauguaucacuguguucuauccacagccauccccauucccacaucaccuccuuuuacauccaccagauuucuguaaggcuaguucaaaugucuuauucuugaaggagguagguugguugguugguugguugguuuuuuaccuccaaaugagaacucaaucuuguguucucccaacaguuuuguuaaaauuauucauacauguuaaugguuuuccucacucaccuauaagcuccucaagagcaagacauugccucauucaccaguguaucccuaucacuuuguauauaguagguagucaguagguuuguuuauugaaaugaauaaagagccuuaaaugaaggauuccugaagucuuaaaugcuuagagagcuaggccuaaugagacaugaaugaaaaugaagagaaauuagaaauauaaacccaguagcauuaauauucuaccacagugauaguuauauguaacuucuaagaugcagaggacucuaguaguuacuguaccccaguaucaguaguuuucuacauucuggaugcucaucacugccucauuuggauaauccaggagucucacagauguugacacauacauuuuuucacuuuugccaucuucagaggccuagauugggucacuaaguaaauuauuagggaaggaagaaaaagcaagagacugucuaaacuuagcuucauuuugaaaaccacaauauauuaacagcaaaaguucuuuuuaucuucuaucccaggcaauuguuauaggggaauuguguacuuucucacaauauggugaaagggcuuagaaagauuuggaauaugugucacccuucuccccagaagucuugcccaucccuuccuccauauccauaguucuuccgaauuucuguuucccaugcucucauuuguuuuccaaugccuuauacacacauaaaaugauuaacuuuuaucuuuauuuuauuuuauuuauuuauuuuuuuuuuuuugagacagagucucacuacaucacccaggcuggagugcagaggcacgagcucagcucacugcaaccuccgccucccgaguucaagcaguucucgguccuuagccuccugaguagcugggauuacagacacgugccaccaugccuugcuaauuuuuguauuuuuaguagagaugggguuuugccauguuggccucaaacuccuggccucaugugauccacccacuucggccucccaaaguguugggauuacaggugugcaccgccgcaccuggccaauuuaucagcaguuuaaauucagguaugauuuccauacagauuuuacauuuccaguuucccugcccaaaauugagacuguuacucaucuuacuucugucaucauauuauuaugucuauuccagaauauguuuaaauaaaaugaccauauaaagucuuauguguauauuauaucugacguauauaccuucuuguaucuagcuucuuuguuugauguguuuuggagguucauccauguuauugcaucugucagcaacuuguuacuuuucauugcugaguaguauucuguuaugugauaauuguauagugauuauccauuuuccuguugauggacuuggguuucugaguuuuuuccaggcuuagacacuacccuuucuuuuuuuuuuuuuuuuuuuuuacaaaaucagcagcuaguauuugcaaaugguguuuguauuuacucuugaaauacaugguuuugugcuggagauuuggaguaaggaaacuuaggcacuauagucuacgccagguacguggggugccuuucuacacucagacucacucaccacaaguaguucuaaauaccugucuuuugcccccuuucuucugccuucugaauuguuugaucucagaaaaucugauauugcuggggaugaauauacuuagcaguuaaguaaccaggguuuguaguuggugcaucacgguucacuuugugguugauugcauuagugugccuagcuuaccacccaccacucaugagcagcuugaaagaaauggacuauauaaagucuuugucaucuuuagaacuugaauagcaauugucuggaauuuaaaggcaaugagugcagagacgcaguuguucccugaaauguggcccacugggagggcuccuuugucagagucagcugucuccucaaaagcuggaggaagcaccugaccauccccccaucccaaaaaaccccauauacaucauacuaugacacuaaauugauauccuccuuuacuuuugaugggggcaugagcuggggcuccaccaccauaaauacugaaaauugaccagaguuugggaauguguguauguuuggggaaagggagagagacaggaaguuuagaaggacuuuucuugaaaucaguugguaaguugaguccuguuggaaagaguugaucauuuugauuauuccuguauggcuucuugggccugagagccaaaagaugaggggaaggagaaaagugguuacugaacaaauuuauuccugaaauuauauuaagaaccacuauugguuugcuuucucucuguucuucuccccaguuuccauguagcaaaugaagggggcauauaggucucauuugauuuuacuacuuaggcucuuugccauuauaucuggcuucuucaaaggguugggugucucugggcgggauccacaccugcacuccuuaucgauagagguggaucuauauagguaauugauauaaguaacauggaaugcugcagugguucugaggaggaacuuaaagaaagguuuguggucuucucauggaaucauuucagucuugccuuauagguauacucccuuucuacaaaguucuuccccacauuuuucauugaggagguucacaacauccuacccaaaccugguucuggguauuuuugucacugaagucauucauaaugccucuccacucucuuuuccuguucuauauucugcugccaaauguucuugugccuggcaaaucuuuguuuacauuuugucuugcucaaagaugagaacuacuagcuucuugccaacuuucuugucuucuuccucuaccucucccucugucucugccccaucccgcucuccugcacccugugcccaaaucuguuucaagggccuguguccaaaauacuccauuuucuaaaguauuuguuccuuccugggguuuaucuuagagguauauuuugauucaucacaauauacuauauguguaguuuuuugcauugagcugcauuuucugcagcuguggcauguuguagccuucucaucugcugugcaauauugaagcaacugaaaagacaaaagaccugaucaguuuuuugauaguucaggaacugucaugcugcaaauaccaauuguuagggaagggagaccucagguguaugaaucuuugaacuaaauuaaauuguauuuccuacucuccauaacuuuaaacgugaugcaaaaacaucguaugauguuuaaguguuucuuugucuagccucuuucuucaagcaaauguugagucuuuuaauugaacuuauuuuuaguguucucauguggauaaauuucccuaacaguaguuugccaaagauaggauagcuucucuugugauguauacuaauguugaguuuuuaaaggcuugguuguccccuuuaugcuuucaaccuuggucaggcuuggaaagguagauucaggauugauuucagcuguuuuuuuccugcgguauaugagucuaaaggcucaucucuaccccauaagccugggaagcaaaggcugcagugagccaugauugugccacugcacuccagccugggugacagcaagacccugucucaaaaaaauaagcaaauaaauaaauaaauagaaaaaggccuagaauuuuauacagugccuccuccucuguucucuuaauauugguauugugaauuucuguguaacucacucuuuucuccccuaacaggguuguugguacagaggaacguauuccuauuccccucauggauuacauccuuaaugugguaagauucaacacagggcaaacugaguaaagauguauaugugcuuuucuggaaaauguguuucguuaucagaguccaguaauuaccguauucauuuuaauuggaauccaauuaagaggggaaagaugugccacccuuuuguuuuuguucuagacugguuugccagaaauuagccaacacaagccccauuauuuuguauuccagauuuuuuuguucacuguuaccauucuccauuagaauccagacaggaaucuguaacagguuuuguuuugccagucuaguacaggcugaucaucccaaauccaaaaugcuccaaaauuugaaccuuuuugaguaccaacauaacacugaagggaaaugcucacuggagcauuuucagccuguacuguauaaugcaaauauucaaaaauaaaaaucugaaacacucauggugcccaagcauuucgaauaugaaauauacaaccuguaauauguuuuccaaauguguccaacauauauuuucccccuuuuuucccauuacuuccuggguaucucaccaaaaaagugaagaguuugaauuuucccagaauuguuuaccaauaagggagagaccucuuagcauuuguuucagccuacuaaucacuuccaagacuuccagagauaguuugucuugugccuguguguuuauugcccacauuuuacuuuuuuacucuuaaaaaaauucuuuguuugaaacaaacucuuccagaguucaguguuucauuugcauuaugcguuucauuugcauuauaagcacauuugggggaaauuuuccaugauguuugccugcaggagagagguaggcaaggagcacuaaauagcaaauuaagagauuaaacaugauuguaccacuaauucauaauguggcccugagcaagucacuuaacuucucuguuaucucgaaauaucugauucuuggugugcuugaaaauggagauugggcagaaauuguagauauucuuuacuuccuggauguuuuagaauccguaucauacaucugguuuaucugagguuuugauacucuauagaaaacacuaauaucaugacuagaaggcuaccccauccuuauuccaggcuggccauuuaguuccaccugucaggcucuaacuucuuuaaaaaauuuuuauuaccuagaugaaauuuguggaaucuauucugagcaacaauacaacagaugaccacugccaggaauuugugaaucagaaaggacuguugccuuugguuaccauuuugggucuucccaaucugcccauugacuuucccacaucugcugccugucaggcuguugcaggugucugcaaauccauauugguaagaagcaucuggccaaauguuuucauuucuuucuggaaaucaauuuugcgauacuucuguauauauguuuuuacuauggucucccuucaacuaaaaaauaaugaauaaauuuguguuauguuguauaagugaauuuugugacuaauauauagugugccauguuauuucucauugaaaagucaaaguauuuuuucuuuguucaucgguuggguauguaguucuacaucauuagaguuuauuggagggaaaaguguaucuccaagaaagcuuuucuaguuggguuuuauuaguaccucucccuucuuuguuauaggugcauuuuaaacacauuuuauguuuaugguuauguuuaaccauguauuuuccuccccuuucaagcuugguagucauguauuuuaagcauaauugacauguaguucauugccgauacuuaauuccccccuuuucaagcccgauagucauguauuuuaagcauaauugacaugguaguucauugcucauauuuugccaaaaaugaagcuucuuuauuuuuucauagugguaaacuacacauaacaugaaauguaucaucuuaaccauuuugaaguguagaguucaguaguguuauguguauucauauugaugugcagccaaucuccagaacucuuuucaucuugcaaaaaugaaauucugccauugaacuucucauccuccccucuccccagaccuuggcaacuaccauucuauuuuuugucucuaaauuugacuacucuagguaccuuauauaagugggaucauaaaauauuuuguaugugcgaccggcuuuuuucacuuagcauaaugcccucaagguucaaccauuauguagcaugugucauaauuuccuucccuuguaaggccuaauaauauuccauuguguguauauaccacauuuuguuuauccauucaucuguugauugacacuuggguugcuuucuccuuuuggcuguugugaauaauaaugaugcugugaacauggauguacauguaacucuuugagacucuacuuuuaauucuaauuuucccacauccuagccaauacuuauuuucuguuuuuugauaauagccauucugguggguaggaaguguaucucauuuuguuuuucacuggcauuucccuaaugcauagugauaaugaacaucuuuucaugugcuuguuauccauguauauaucuucuuuguagaaaugucuauucaaauucauuguucuuuuuuaaucguguuauuuguuuuguugaguuguaagaguuguguauucuuguacacguauuaauaccugauacuaauuucuucucagguauaugauuugcauauauuuuuccuguucugugaguugccuuuucuugguugucuuuggauucacaaacauuuuuaaucuugauaaaguucagcuucucuuuuuuuguuuuuguugccuguguaaacaccuguguuuuuggugucguguccacaaaaccauugccaaauccgauguuuugcagcuuucccacuguggcuucuucuaggaguuuuauaacuuagcucuuauauucaggucuuuaauccauuuugauuagauuuuuuauaugguaaaagucuguccuuuccuauugcauggucuugguaccuuugucaaaaaucauuugaccauauauaugugaagauuuaauucugggcucucuauucuauuccauuggucuuuacgucugucuuuaugccaguaucacaguuuugaucacuguaacuuuguaauagaaaucaaaaagagugagaccuccaaaaauuuuuccccaacuuguuuuggcuauuuggggucccuuaagauuucauauaaauuuuagaagggauuuuucuauuucugcaaaaccaaaacaaaaaacagcauuggaauuuugauagugauugcauuaaaucugugaaacuccuuuguuagcugggcugcagagugauaaguaauuccugcugaaugagaaauccauuugcuuacagacuuggaaagauccauaauugugacgugacuucauuuaguuuauuuuguuuuacucuuugaaauauugaauuaaaugcucuucaucacagagaggggaaaauauccuauaagaugcuguggaaggauagauagauuuauuuaaagccauaggaaggcacaugauuucuccuaucuuugcauggcaagugaugguguuuuauugucagauuuuucuccagacuugagaggaaaucacaagggucguauaauccuuggguugucugauaaaaacaaauugccuaccugauuccuaucucagaauaaucgcuuuuguuuuaagaagaaaagaacaguguaauagugacucacuuccaugcuuuggaacuuugccuaacauuguuuccuaucgagcaaaauuuggaauuaauccuauaguguagaauccuugccguaacaguauucaguuugaccaucauaagcuuuuaaguguuauuggcucaccaaguuugaaaguaguguguugcucuagaaagagauguuaagguauguuguaccugacuucauauuuggguuccaccauuuaccaggugagagaccauggccauauccaaaaucugagaggcuuccauuuaauugucacuuccauugugacuauuaaaagacaugaugaauuugaaguucauuguauauuaacacuuuaauuauucuuccuguuucagacacugucacaugaacccaaaguccuucaagagggucuccuucaguuggacuccauccucuccucccuggagcccuuacaccgccccauugaauccccugggggcucaguguuguugcgagaacuggcuugcgcaggcaauguugcugaugcuacccucucagcccaggccacaccucugcugcaugcacucacugcugcccaugccuacaucaugauguuuguucauacuugcagaguuggacagguaaaaauaaccuuaggggugaacauauuaauuuaaaggcagugaaauaucuagggcauacaccuagcaggguuacuaugcuugaaaggaggucugccugagguagcagcuaaaagaacaguccaauuuaggaugagauuuuuuugacugucaaaaaguugagugacuauauaacuuauuaugugaugaaguggacuuucuugagagcgaaacauguuauuacagacaaacaucaauuggguauucaucuggccuuaguacuuucuaaucuuuccaccaguccuuauaggucugauaaugggauggcauagguaggacauuuuaccaaagaacauuuaaaucaauaguaauuaacaaauuacuaaaaauuuucuacauaucaaacguuugaccuguaauccauaauccauaguuccagaaagaaggcauuuuguguauguccucacaguuuuacuacauuuauuccucagauaauugauucuaaagauuuaugguaucaacauuaaacaaaacaggguucaacagcccuguuuuaugcuauugagcaggaguguguucucuguuaauugugaaucaaucaaaucugaaguuuaaaaaagcacaaguauaaaggauuuagaaaauuaaauuacuuaacaaagcuuagggauugauuuuuaugacuucuuuauuaaaugaaauaaaaugaaaaugaaacauucaaggaauuaaauaaaucuagguacuuacugaaguaaagaaauugaauggaaauaauaauaccccuaccaaauaauuuagaaaguaguuaaugaaccuguaaaaccauuucuuugauucagaaaaaaagaguagccucugaugccuuucuuucacuuuauaaaaaacaaugagaacggauguuguggaaauaguuuguaaauauuguaagaggauaccuuguggaacugucgucuugaguguggacauuuugaugagguggauaacucugagaauagcaaugaagaaaaaucccuuacccuuauaaaacuguugaaggucaauuuuuuuuuuuaaguauaauuguucagagaacaucccaaaggugaaauucuuguuaugauugcagagugaaauucguuccaucuccguaaaccaguggggcucucaauugggucugaguguuuugagcaagcugagccaguuauacuguucccuggugugggaaagcacuguccuccucucucuguguaccccaaacagguaagagaauggcucucucucuuauuacuuuguuaucuaaguucggugagccuggaggauugcuuugguuggggauaggaggguauggaagagaguucagaggccuccuuguccuucccucuucccagccuaggaacuugaugacaaaugcuuugucgucaugguagauguuuaaaauguguuccuguuauuagccagauacaaaaaauugaguuguggcuggacacgguggcucacgccuguaaucucagcacuuugggaggccaagguaggcaaaucaagaggucagguguucgagaccagccuggccaacauggugaaaccccaucucuacuaaaaauacaaaaaauuagcugggcguaauggcgggcgccuguaaucccagcuauuugggaggcugaggcaggagaauugcuugaaccccggagguggagguugcagugagcccaagaucaugccacugcacuccagcccaggcgaaagagugagacugggucuccaaaaaaaaaaaaagaaaaaaaaaagaauuggaaagcuuguggggugcuaccucaggaauuauagaugcuuuauuacauucaguuuaaccugccugcuauaggagggauagugucagccaagcaaauuagagaccauuuacaauauaagaggugaauuaucaguauauauauauauauauuucuuuugcucagcauuucucuuuuugcagccuaccaucugggugugaauuuggccaggcagauaugcagaaacugguuccaaaggaugagaaggcagguacgacccagggcggaaaaagaucagguaacucuaagaaacuaaaauguuagucauuacuucuaaguuuuguuccuacgucuuuauagguuuauuaugaaaauuuuuaguuaguucuaucauccauagucuaguuuucauccucucacuaauuuuuagucauuucuuccauaaaaacauauauacauaaugguaaaauuuagaaaauguaguugaaagaauuacccguauuucugccaccaaaaaaaaaaaaaaaacauuuuggaagugucugcccgucuuuuuucucugaauacauuugccagugucuuagauaaaaacauuucguagaucucuuucuucacuuaauguuagguaccauauaaagguacacgaauuaacuauucccuguuaaguuucuaauaugcuauuuuuaaaaaaugaacauuuuuguaucuacuuuucuacaaauguaaaauugauuccuagaaauuacuguaucagaggguauuaacaaauacuuuuuaauguggcuacuagaaaauuuaaauuauauauguguuucauguuauauuucuaucgacagugcuguuuuauaaagaagauugcuuuuauauuaucucaugauaaaaauuccaaauuuuggccgggcucgguggcucacgccuguaauccuagcacuuugggaggcugaggcggguggaucaccugaggucaggaguucagaccagccugacgaacauggagaaacccugucucuacugaaaacacaaaaaauuagccgggcgugguggcacauaccuauaaucccagcuacucgggaggcugaggcaggagaaucgcuugaaccugggagguggagguugcagugagccgaaaucgcgccauugcacuccagccugggcaacaagagcgaaacaccgccucaggaaaaaaaaaaaaaaaaauuccaaauuucaguaaguagaaaucauacacaauuuucugacucuaaugcuacaaaccuaaaaugaauacaagcaacuuuuccagaauguuuuuucucugguguucaguaucaaugaggaaauaaaaaaggauaaacuauuaagaaagcaaugaagauaauucuguguauaaaaaugcaucaggccaggcacaguggcucacgucucuaaucccaacacuuugggaggcugaggcaggugaaucguuugagcccaggaguucgagacccgcuugggcaacaugacgaaacucuaucucuacaaaaaaaauacaaaaauuagccggccauggugguacaugccuguagucccagcuacuagggaggcugaggugggaggaucgcuugagcccaggaaguugaggcuauggugagccaugaguauaccccugcacucaagccuagaugacagagcgagacccugucuccaaaaaaaaaaaaagguaucaggcuuaaaacuuguacagaaauuacuagaaagggaaauuucuaaggaacuaauaaagcugacauaggcuuagaaccaacaaacaaggacuuacauaugacagcugguuauugugagggaugggauaacauuaauaaacuauaaagaaaccugacaaaaugagaauuucaaauuuagucaaaacauacuaaauuuaacucagggaaagaauaaauugacuaagaacugagaaugaaauuagauucacugucaaagaauugccucucuaacagauauauuuuuucuagcaauuuaacacauuuaacaaaaacgacucagcuucuccacaguuuuucuggaauguuaagagaacaacuuggugacuuguuuuauaaguuugcauaaagcucauucuuagaucuaagagcaagcauauaccaaagaaaaagacacaugucacauucauauacauaauucuuaaaugcuaggaaauaaaauuguccagugguaaucugugaugucuaguuugaacuuaacaagcuauaacauucuaguagggcauccacauugacagcauuggguacugugcacacuguaguccaugugaaugguacccccuggguugggcugugccuacaacagucuuccaagguagcccuggguuaauacuauucauaugcugucauuugaagaugucagcauuagguacuuagaacuccagaggagcauaucaguaaaauauuugggucguguuuuuguuuuucaaauuuaggaagccaugggaauugaaagaguaacaaaaaccauagguaaucuugucaguacuucucaaggaaccagguaaauguuggcucuacauuguccuauugcuccccucuuauacaucuguagauggggaacaggauggagcagcuggaaguauggaugcuucuacccagggcuuauuagaaggcauugggcuagauggugacacauuggcucccauggagacagaugaaccuacugcuucagacucuaagggcaaaucuaaaaucacaccagcaauggcugccagaauuaagcaaaucaagccuuuguuaucaggugagucauucuccuuucuccuaccuuuucuggcuuucagucccuuagucuugaaacagauugaguuggaaaggcuauguuguuucaccuaaggaaguuuaaaacuucugugacucauuuuuaaguguccuuuguugaguggcugcuaugugacaggcuuuguacuagcugcuacggauacagacaugacagaaucccuuccugagagccauaucuacuacccucccuucuuuaauuucuuccuccuacuuacucuucaacuauugcauauuguugcugcuccuuccauuucacugagaugucucagcaaggcaucuacaacguccuuguccuaagucccuucucacuugucugcagcaugguaguugacccaccaucuccaucuagaaauauucuuccuuuggugcuuguguuauuaagcuaucuugauucucggauaacuaucuggcucuuccaccuagucuucucuuuuuguguuccuugaacauaacuggcaagagacauagucugauagguguuuuauauuaaagucacuuuggcagcuuuauugagacuguauuggcagcauacaaaacugcauuaaugauuugcacuggucuguuugcccuuuuuuuuccccuuuaauguaauaccaauguuugggaaccuauuuguguguucguaaauugucgucacuuucuggcaccuuaauauagaggaaaauggagaccuaacuuagaggaaucuggggcccuucguaaaagcaaacagaaaauggccuuugguguuuccauuuguuaccucaaauucccauugcauuuuacauuuuacuuuuaauuaguuuaauucuccauuuauuuuaauuugaaagucuaccaacauuaccuucaaaggaaaauugaccaagcaagaagauguucauauuucucucuccuugcuuugucauauuucuuugaucuuggagcauucagagguuucugugugaacccaguccauauacuguuucucuuugguuacuggccuuuugccauccucuugucuuuggacuaccuuuaagcacuuugcuaucuguucaccugaaagcaguggugagaaaguguaaacccaaugauuggauucauuagguuuucaaagucuggguauacccauaucuguagacuauucccuaauuaggauaaagaaaucuuaauuuggauguaauaggaagaagaaaggacuguuuuccuuguuccuauacuguauacauuugagcuuauuacuaaauuuuagcaggauauguaaccuaggcucaaguagagccuauuuuuacacacugaguuuauaugugcauguauauccugaaaagacauagauuuaacccuugagcaacauggggguugaggcaacuccuccacacagucagaaauccauguauaacguuugacuccccaaaaacuuaacuacuaauagcuaucuauugaccagaagccuuaccaguaacauaaacagucgauggacacacguuuuguauauguauuauauccuguauucuuaaaguaagcuagauaaaggaaaauguuaaaaucuucagagaaaaauauauuuacuauucauuaagaggaucaucauagaggucuucaucuggguggucuucacauugaguagcugaggaggaggaaggaaguggggggauguuggucuugcugucucugagauagcagaggcagaacaggucaaggagguagaaggaaaggcagguaugcaugguguaacuuuguggaaauacacaguacuuucuuucugacuugguugcuuuuucauuucucuaaaaaugugucuguacaauaccaauuuuucuuccaccguuugcuuuaguuucggugcccauaucauaguaagguccacaucauaaaaagucaaaaguauucuuuaguaaucagaacccucugccagauugucuuaugucacuuugguuccuggcacugcuucuacaucuucuuccucaucaucugguaucgguucagaagcacucaucucuaucaagacgucuucuguuacuugcucuggugugguguuuauuagcucuugaauuucacugagauucauauccugaaauucuucacccaugaccuuuuuuuugcuauauccacaaacucgugauuuccuugauuggcgcugucauaaauccuguuaaguucugcacaauaucaggacaguuuucuccaacaggaauuuauuucaggcuugauggcuuuuucugugacaaugauggcaucuucagugguguaauccuuccagacuuucgugauguucccucugucaggguucucuuccacagcauuaacaauccuuuccuuagaguacuguguguaauagccuuaaagccccuuaugacucucugaucuagaggcugaauuagagaugugguuuuggggggcaaguagaccacuucagugccuuuuguguugaauucauggggcucugggucaccagaggcauugucuaaugucaaaagaacuuuaaaaggcacucccuuacuagcaagguacuucugacuucagagacaaaacaucaauggaaccaauccagaaaaggggucuuguugcccaggccuucuuguacaaccaaaagaccagcagcugguaguuuaucuuucuccuucaaggcucggaaguuaggagcuauauagguaagggcaguccugauuauaaacccaguagcauuugcacaaaauagaggagugagucugucccuuccugccuuaaauccuucugcucacuucuauuccuuacuaauaaacguccuuuguggccuuuuuuuuuuuuuccuucaaaguagggcacuuuugucuguaugaaaaacccuuucaggcagauacccuuucucaaugauguucuuaguggugucugggaacuuaucuguugccuguugguugguugucagaagcugcuucuccuauuaucuugacauucuuuaagccaaaucucuuucuaaaauuaucaaauuauccuuuacuggcuuuacauucuccagcuuuagauccuucacuuuccuuuugcuuuaaguuuucauauagugaguucauuauuuucuugaauugcauuagaaucuauagauuugucuuuauuauggcaauccuguacccacauaaacgugcauuuucaauaugaaauaaaaagauuucacaaaagugcaagguuuucaagccugcugguguagcugcagcaacagcuucacuaauuuccuuuuguuuguuuuacaauggucuuuacacugaauucauuuuuccugaaguggugggcaaucugcaauccauaucaaauaauucaacuuuuucuugaagugucaugacuuuucccugcuucuugggagcacuuccaacgucacuagugacacuucauauggggucauagagugacccagguuuauuccagguuuucaguauugcgguaaacaugaaaaacaaugcgagaaccaugagagaucacuacacaauuuacuggagagaugaacuguucauguagaagugcuuagccucacacaguguuuuaagcagauuguggcaacacuugagcucaccacaguaucagcaggucguggcuacaaaauuauuacagaguauaauauguacuaaauuuuauccaguuacucaauacugcuuauuuacugcaaauggcaccguguauaaguguaugugcauaagugugauaaauauuaaauuuuuauaauuuguguauauuuuaugguaguaaaugauaaaauagacuaguaucuacauauauuuuaugcguuuaugacauaccuaacuuuuuguuaauuuuucaauauuuugaggcuacauguuucaucugagaguuuuuucaaauugucaccaaucuccaaaauuuucaguauaucuauugaaaaaaaauucacacauaaguaggcaucuauaguugaaaaccuguguugaucaagcgucagcuguacuuugauucagaccuagcccuucuugucucuggaucaugaaauaacguuucaugaaaaaacgugaaauaacguuuauuuuuaaaaugcuauggcaacauuuucauuuaugauuuuaaaaguauauuucauuguagaaauauaaaaacacaugaaauauuuaaagagaagcuggaaagcacucaguuuuuuguguuuucuuuuacauauguuuauauuuguaugcugccuuuuccuuguugaauuauauauugaaaagcauccuaugaaauggaaaauuugagauguccauaaucugcccaauuccuuaagaagcuacuuguaaaaauuuuccugcuuuuccuaguuuauuuuuuccucugggacuacauauuuuuuguugugaucagacuauguauauugucagugaucuuuucuuaucuaaguggcuaaucauuuuuggcauuuuaaaaguuuucuguaggcauuuuaagugacuuuaucauccacuagauaucauuuaacuuaaauaugguuucaauuuauguuccucuagcaguaugagugcuuauuugucuuuuacauuugguaucuguugagugccacauaucugucuccuaccgucaaaaguggcauuuguuccuugugggacuuccuuuuuggauuauugaauguagaacaaauccaaguguuaacuagggguuguaggaggaaguggugagucauaaaaauauguuaaugguaauaugucuguuguaauuaaaccauucugagaauacuguacagucuuauucugauuucuggguuucagcuuccuccagauuaggccgagcacuugcugagcuauuuggacuucuuguuaaacuuugugugggaucuccuguccgccagagaaggagccaucaugcugccagcaccacuacagcaccgacaccugccgcgcgaucaacagccucagcucucacuaagcucuugacuaagggguuaucuuggcagcccccaccauauacaccuacuccccgauucaggugaaguucagcuugagauucagggacuagaaaguuacaauaaaaaauauguaaguuguuccuauacuacuuaaaauggagugugagccacugaauuugagaauuuggaggucccuuguuuacucuagaaaaugaaguguaaguuacuuguuuugguuguaccuaguacagaacauggguaauauuuuaaguauuuacagucaaacugcauuucaguggucuuauauagguaguaucccuuauccaaaaugcuuggggccagaaaguguuuugaauuuuggaauuuuuuggguuuuggaauauuugcggaauacuuaucaguugagcaucucuaaucugaaaugcucccaugaacauguacuuugagcgucacgucagcaaucagaaguuucagauuuuggaacauuuugaauuuucugauagggauacucauccuguauucuuuaguaggugggaggugucacuucaguguguaaauuuuacucuugccuuuuacaugaauuuccuauugcuucugucucugcuuuacagaagguuaaaguuuugccuuuuuuuccacuuucaggcugacauucuucaucuguucaguugguuucacauccccaaugcuguuugaugagaggaaguaucccuaccaccucaugcugcaaaaauuucucugcuccggaggccacaaugcucuuuuugaguaaggaucaaguugcuucacagaggagcauuucuuggaguuugaucuuugcugugugccuucccagcccacugcuuuuaaguacccuaucuuguaacagugggauauauagaaauagcuauugguuguauccuucaguguucugggaaguaaccauguuugucuccauuuaccuuggaggguaggauuuagccuccccuagaguuguguuuguaagggucucugcuuuuucucauguggcuuccaguuccaaguauggguuuuuaaaauagguuugucuuuuucuguuguuucucugaauauaauuuuucugcuauucuuggucagaugauuucaagaugaguuucacugguuuagguuuuuuuguguuuuuuuuguuuuguuuuguuuuuuguuuuuuuugagauggagucuggcucugucgcccaggcuggagugcaguggcgcaaacucaacucacugcaagguccgccucccggguucaugccauucuccugucucagccucccgaguagcugggacuacaggcgcccgccaccacguccagcuaauuuuuguauauuuaguagagacgagguuucacuguguuagccaggauggucucgaucuccugacuucgugauccacccgccucagccucccaaagugcugggauuacaggcgugagccaccgcgcccagcugguuuagguuuuuaagacucuaaaaaguaacggaggagaggcggaacaaaagaaaaaaauaguauagcugaaaacuguuggacagauuagacguaauagcucuaagaagagggacguguagggccaauauagagauuggggaccuuuuagauguaaaccccccuugccaggguaaaauacuaauauucugucuacuuuuccuuauuugaauuuagaacuuucaacugggcucuguccaugggagguaaaguuccuguuucugagggauuggaacacucagacuugccugauggcacaggagaauuccuagaugccuggcuuaugcugguggagaagauggugaaucccaccacggugcuugaaucuccacauucgcugccugccaaauugccuggagguguccagaacuuuccccaguucagugcacugcgcuuccuugugguaacucagaaagugaguauucaguauucuaaaaucaaaaggaauuucucaugcuaagucguucccacucuauuuuguccugcuuaaugaaauaacaugcuuauuuaagaaccacuggauccaacucccagauagggcugccuuacguaagggaauauagaccauuugagaauuuuccgugauaaacauuugagcuguaaauuucagauugguacuugcauuaggccguucuugcauugcuauaaagaaauaccugagacuggguaauuuauaaagaaaagauauuuaaguggcccacaguucugcaagcuuuggaagcauggugcuagcaucugcugggcuucuagggaggccucaggaaguucacagucauggcggaagguuaagugggagcuugcaugucacauggcaggagccaggagguggagggggugguacacacuaacucacuaucaugaagacaacacuaaacaaugagggauccacccccaugacccaaacaccuccagcauuggggauuacaauucagcaugagauuugggcagagcaaauauuccaaacuguaucacugcuuaagguugaguaaaaugccucuucucugugccuccuuagaccuccucauguuggccaauuauuuuguugcugguacuaguuguggaaggacuguuccauaggucuuuaacuuaauccuucugagcuuugaauugaagcaaaaugauuuucacacacuuuucaaauuacuuacaggcagccuuuacuugcaucaaaaacuuauggaaccggaaaccccugaagguauaugguggacgaauggcugaaucgaugcuggccauucuaugccacauccuccgaggagaaccugugauucgagagagacuaagcaaggagaaggaggggucucgaggagaagaggauacagggcaagaggaagguggcucccgccgggaaccucaagucaaccagcaacaacugcaacagguaggguacuggccucacacuccaggguccagacuuugcacccaauggagugugaugcuuacggauuuucuaagcucacauaccacugagucccuggucacauuaaccaggagacaguuuagauuuccuccuucucuuaguauuuauuuuuuuucuccugaggaaaacuggaguauaguccugaugcucugcacagguaauacuccuuucaagcauguugaugaguauucucaguagccuccugcugccucaguggaggcaaacuguccucaguuacuuucugguuaaccuguaaagagaauggauauugugaaccagauuuauucuccaacaagagcuuucugaaaccuuagucaccuacaaaacuuuuguuuucacuugcaaauaaaauguauaaggggcauuuuaaaaauugggaggccagaaagaggagaggggaaaggcauguaaaguccugccacuuccaucucaaagagcauuuuaagauuuucuuccuggaguuuguauguaugugugucagcuuuuaugucuggaguccuguucaaaucugucuacuauauacacuugucccguuuuuuaucauuaaaguaauaaauacucucauuaccaaauuuggaaaauacaagacuuuuaaaaggcauucguaauuuuaucacacaagauagucauugucuccuuuuucagucagucuugugccuaauuuuuacgucguuaacaucaaauaauacauauacuuguauugcuguuaucaagaacuuuuuuuuacuaauuggucauucuuuuauuguuggaugcuaauuuucuuacaguuugauguuuuaacacuguguuguauaguuuccuuacguaccaauccuuacauacaucucaugauuauugccugguaguagauuaacuaggucaguuuuucaggcacuugcucuguuaccaguuuguuuuccagaaaguugggaccaauuuauacuucuuuguaugagucucaaucuuuuaauuauaauaacccuguuaaucauaauaaccaugcaucccccccuaacuuucuuagaggaugaaaucgagaaucuucuuggcuccuuacccaauguguagcuuagaaugcuauagaagcaccaaacagaaaggauuguucauuuuaccuaauugcccuagcucauaaaugcucucagcccagaugaaguuagaaaaaguuauuuccaucuugaaaagguuccuuccuuuuaaaaauguauuuggauuuccguuaugugauucugagcccuugcauucuuuauguagcucauggacaugggcuucacaagggaacaugcaauggaggcacuguugaacaccagcaccauggagcaggccacagaguaccuuuuaacccacccuccuccaaucaugggaggaguuguucggguaaguuggcucagaagcagugauuuuccaggauauugguuugacugcugaaguccuuuuuccccuuauuauucugucauuggucuuccuuucuauaaacugcuucucauuuucagacauguccaugccaguauuuucuuuucauaauaacagaaguuuucugucccccagcaauacaaauuacuauacuuuguuugcacaagaacccccagucacaaaacaauagaagaggcacacuuuucuaagauguagaauagaugaucacacuguaagccuccuuccuauacuuaguuuuacgugugauuuuccucaucuguucuuguuuguaguaaccacauaagccugauaggguuugacuuauacaagagcagcauuuugaggcccuuccucucucuuuagcuugagcacaagaugucugauugccugugaguugcaguggucuuguuggguuucuuuguuuugaguguguauccuuacuggauauucucuuaacacucuaggaucucagcaugucugaagaggaccagaugaugagagcaauugcuaugucucugggacaggauauuccaauggaucaaagggcagagucaccugagguaacuauggaacacugcauccuaaagggcuuggcacaugaaucuuaguauucugugaacauucugcuaguauugcaaacuaauugauagaauucaaaucuaaaggaagacaugagaagaguacuaauucaucccagcuuugccauccauuauugagcuaccuuguauugaccugaagcuuuaagggaggcauaugaagcguuaaucuuuauugucaaauaagagacccaauguguacucaguagugccauuaggccgaacuuggcuguauauuucuaggugacaguuacuuuaauuuucccugcuggcacagaauauagaacagugucuagaaaugauuuugcgggagguaguauagaaugcuacaagugacuugacagugaaaguuguuugaagcaucccucccuucuaccuucccugucuugccuuaaacuuuguggcugccacauccuggaugaaaguaucaaccgcuugaggagaagguugaggguaaucauaugguagagcaaaaacauucucagagucucucuuaucuuuccuccuucaccucuccuguguauuauucacacuuccuucccugcuuccaggaaguugcuugccggaaggaggaagaggaacggaaagcucgggaaaagcaggaggaggaagaggcuaaaugucuagagaaguuccaggaugcugacccguuggaacaagaugagcuccacacuuucacagauacuauguugccaggcugcuuccaccuucuugaugagcugccagacacaguauaccgugugugugaccugaucaugacagcaaucaaacguaauggagcagauuaucgugacaugauucugaagcaaguagucaaucaggugagcucucaaggggucagaagaggggaguaugugaagugguuugccugccugugucaaaaccugauuucugaaaaaucagcauauuuucauucuaccugauauggguauauucucuauuuggauucuuucgaucugguaauccugaaacaguguguuaacuacaucgcacacacaaaaaugucuuuagaagggaaaaacaaagcucuccuuuucuacuuuucucuuaaaaugucuaaaaugugccucacccuugagucagguucguccccuggacuaauacugaauaaauguuuuuuccuauguaacagccgcuugaacaacugaguccccauccugaugaauacuugugaccugauauuuguccucuuuuucuuuucucucauuaugaaauuaugcuaauuauagaagugggauaagaaaggaauuaccuuaaauccccacacccagauagccaguuaacauuucgauuguauuuaaguuacuggaaucuuguuuuauguaauguuucauucuagaagcagggaaagaaauuaaaaaagggaaaacuuuuuucugggcuuuguaaaauagaacuuuaaugcacaagaacacaaguaaaggaaaacuggauaaaacauuuuuucacagaaaguuuuagugucuauuuuuuaacaauaauucugagagagagagauaaaaugaaagauugcugauggaaguauaaguugauagaaccuuuuugggguugacuguaugcaccaggaaguuuuaaaauacucauuuccuuuaacuuagauuuuaggcugcuuauagucuagccuaauaaaguaauuguuuaguggugauccuuuaguagcauacaucuuuugauauagauucuaaaucccuaugguaaauauguuagauuuaccuaccuuucuuuagugaauguguuggaggcagagggaguauuuuaaaagguugagaauauuuucagaaaccucaucuugcucugcgguuccgugacuuaacccuuuuuuugcuuuucuaggugugggaagcugcugauguauugaucaaagcugcucuuccccugacaacaagugacacaaaaaccgugucagaguggauaagucagauggccacacugccccaggccuccaauuuggcuacuagaaucuugcuuuuaacgcuacuuuuugagguaagauuuagaucuuuggggccuuguaauucauucaugaaagaauuaucaaacacuuaacauauaugaggcauugaagacgauaaagcgaagaauaaggcaugaguccugcauuucaugagcccaguuucugauaggcugaaaugcauauaauuacguauaaaauacagcauucuguguuagaaugauaacaguuuuaucuggguuuaggaaagucauaugcaucacuuuggauucaugugagaagggcuucugagaacaagcauuaauugaauugagucagaauugugaggugguaguuuaaaaaaaaaguauuuaaauuacuaacagagcuuggucauagaauauuuuuugcucuucugaggaaaccuaacuggcagccacauaguagaguaggguaugcaaauuggauguggucaauauugagguaauagacauuagaugaaaucagauuccucucucuuuuccuugccuauuuagucagcagauuauuugaggcaagagagugguuugggcaagaccugauccaaccaacguaggaacuaggaggcaauugaccuuggacaaaugacuucauuuguggcucauuaucuuuaaaaccugaacuuaaugaacugaacccuuuacauacagcaaacucaggggauaaauccaauauaagagucaaacuguguaacagcugucuuggggguuuccuuuaucauggaagugauaacucuuacuguagcacuuuguaaauagauacuugugggaaagguuucagaguacuaaagagagaaucauucauggacccccaucuaaaacaaaucacaaguaacagucuuguauuuucuuuuaguguuuuuuccuguucauuuaagcaauugggauaagacuguauagaaaguuuuauauucuuuuuguuaaguauuaugacuauuuucccauuugcuauauacauuaguccaucuuuugaauguucucuaauuuauuuaaauaauuaccuauccuuggacauuuacuuccagugauuuccuguuaaaaguaacacuuugguguagccccaguaagacgaaccauuaacuguguuuaauuauuccauuuuccuugaaagauuauaaaauuucucuguaaaucuaaagcuuuacaacuucaacauagacugcacaaccuuggugauaaaccauuuccauauuaagcauauacauuagugccaggcacuggguacuuuauauuaauauauauaaaaccucaaucaucacaauuauucugcagguaaaaauuauuuccucugacccaugaggaaaccaaagccuagaaaauuuaacacaucuuagauuacacaacugguaaaugguaagagguaaaauuugaacucaaccaauucuauuauuauuuacccuuauguuccccuccccuaucccaugcuaaucuuuguuacugaguagaaauugguaucugguuguuguuguuuuuucccuuugaucuaucaggaguugaagcuaccuugugcuugggugguugaaucaaguggcauccuuaauguccuaaucaaacucuuggaagugguucagcccugccuccaggcagccaaggagcagaaggaaguccagaccccaaagugaguaacccuauaucuacccuaguuucguuucuauuucccugggacaugggccugaaucaggcacucuucuggggcauguauggggcaaauuugugguacuucuguaguuuuaaaauuauaaaggaagcaucugaugaaauuaagauauauuuucccaauuugugcagguuucuugcuuucccaaaacagaucauuuuucuuuuuuagguggaucacaccaguguugcuccugauugauuucuaugaaaagacagccaucuccucaaaaaggagagcccagaugacuaagguguguaauguaguauguaugacugcaggacgguuuagcuuccugaggcaagaguagaccagaagagaauaugagagaguagugaagaauauagaagucucugaccaauguauaaaucucuuaagggauuuucauagcuagguuucucuucugaauaauuuacucuggaaguaaauuuugaaggagugugcuaucuccagaggaggagcggcuuuucuguuauguaagggacugaguauacagcaauccuaccaaaaagcaaacacuccuuagaugaagauuauugugccacaucaucucacuaccuucuuggaaacagaauuuuuguuucaguacaucucaggugaacauuccccuuuuagggaaaaucaguagaaacaaaaggaaaguagaaaauggcaagauaaggggcuguagauaguuuuuuugucuaggaaaaguaucuuaguccguuuugcuguugcuauaacguaauaccacggacuaauuuauaaaccauaggcugggcacuguaggcucacgucuguaaucccagcacuuugggaggcugagacagguagauuacuugaguucaggaguucaagaccagcuugggcaacacauggugaaaccccaucucuccaaaaaauacaaaaauuaaccaggcauaguggugugugccuauggucccagcuacucagguggcugagguggggagaucacuugagccugggaggcagagguugcagugaaccgagccggcaucgcgucacugcacuccagccuaggugacagagucagacccugucuccaaaaaaaauauuuaauauaaacuguacaaguuuauuuggcucauaguucuagaggcugaucuaagggaccacaucuggugacagccuuagugcugcauccuucuauugcagaagguggaagagcaagagguguccaaacucgcuuuuauaaccaacccagucacaauaacuaacccaguccguggauaaugacauuaauccauucaugaggggcggaguccccaugaccuaauauuaucuuuuauuaggccccaccucccagcacuguuaaauuagggauuaaguuuucaacaccugaacuuuagaagacauguuuuuaagcguguagcagagagacuaaggaaugugagaguaaaugcauaugaaaaauguucuuuugguuuuuaaaauuuauuguccaguauauuucuuuuuccugggugaguuuuagcagugaacacugaugaaguuacuauuucuucuaaucaaccuugaaagaaauacaaagaaacuuuguacuuuuauguuuaguaccugcaauccaacagcaacaacuggcgcugguuugaugaucgcucugggcguugguguaguuacagugcaagcaacaauagcacuauugauucugccuggaaaucuggagagacaagcgugcgauucacugcaggccgaagaagauacacgguccaauucacuacaauggugcagguacaugcucacucaccaagcuugucuaacccguggaccacaggccacauauggcucaggaugucuuugaaugcagcccaacaccacacauugagguuuuuuugucguuguucuuuuuagcuuaucaaauaucguuaguguaguuuauguguggcccaagacaauucuucuuccagugugguccagggaagccaaaagauuggacaccccuacuguaaacuuuaucaaaaagagggguauguguuuugguuuucuucuuucugaaccagcauuccuaacguguuaggaggaggagaguuaccauuaccuaauuaaguauagauuucagaaaaucgagucuuccuaaggucauugauuagaccuugggucuguagcaauuugauacuaucccucuuagaaaugauuuuaaguguuuagucaagggcuagggagugguuagggaugguauuugcucuguuggaaggucuacaguucauuauaaggccuuguguaugccacuugccuucuggggacuuucagguuuuuucucuguaaaugauaaaggugggauaaauugccagaguuccuuccuguuguagcauuuuaccugggagaugucccuccccucccccaccuuuauaauucauuuuugguagagguuuuuuuaaugucuguuugaauuccuagguuaaugaggaaacagggaaccgacgcccugugaugcugacucuccucaggguaccucggcugaauaaaaauucaaaaaacagcaauggacaggaacuagagaagacgcuggaagaaagcaaagaaauggauaucaaacguaaagaaaauaaaggcaaugguauguaccaagaguguuuuaccuaaagcuaaugugccuuuguggcuuaaggucuggccaauuucauugugaguuauuuucaucagcuugauuaacagauuaaagauacguaggccucccuuaugcuuuuucaucugaucuuaaaauugguauuuggcaugcuucucuuaauaggacccaagugcuuggccaauuacuuaggagggaggcgugggaggaaauaaacaucaaguuaaacugucuaaaacuguuauuuucccauuuuauagauaccccuuuggcccuagagaguacaaacacugaaaaggagacaagccuggaggaaacaaaaaucggggagauccugauccagggcuugacagaagauauggugacuguuuuaauccgggccugcgugagcaugcugggagucccuguggacccagauacuuugcaugccacccuucgucucugucugaggcucacccgggaccacaaauaugccaugauguuugcagaacugaagaguacccgcaugaucuugaauuugacccagagcucaggcuucaauggguuuacuccccuggucacccuucucuuaagacacaucauugaggaccccuguacccuucgucauaccauggaaaaggugaguguguuuuguaucagauucugguuuagcuuuacaucauaccuauguucuccuuggucugagaacaaauagacuucugguucuucuuaggguauauagcuagauauguauacuguauacuccacccaacagaauuuuccaacucuaugcuugggagcuugcuuagguaugguaggaugauccuauugcuagaaaguccucuccagcaaucugguuuucuuuuuuuucuuuuuuucuuuuuuuuuuuuuaaucuagguuucauuaaccaagccaaaaaccguuaguaaagaacugggauaccuucccccaaguucauaccuucagaaucauuccuuuguaggaguaccucucggguguucagccaagagacuauucucaaaacacuguauuuuggaauauaaaaguauaguuaaagcuuuuugaauguuuguaaucugccaggcacugugauagacacuuaacaaauauccauugugcagaucagaaaacagguuauuauauuuuaggaaacuuacaaaccaguggaagaaauagcaacguacuuauaaaaaauaaaaacauuuguaaaguuaagacaauagucugggugugguggcucaugccucuaaucccagcacuuugggaggcagguaaaucaccugagguuagaaguucaagacuaggugggugugguggcaugcaccuguaaucccagcuacuugggaggcagagguugcagugagccgagauggugccauugcuccccagccugggugacagagcgagacucugucucaaaagaaaaaaaaaaagaagacaacaguggaggguugaggggcaaauguccuaguagugaggcuuuuccuccucaguacuuaauacaaaauccuuucuucugcugauucuuugucaucaauaaugacuguuaauagacuuugcuuccguuuuccucucuugggacauuguuucccacauuuauaagcaguguugcaauaugcguuuuugugccuaacuuuguucauguuuaagaucguuacuuagagauuuuuaguaauuggaucaaaaggcauuacaaguauuuuuuaacuugcuugccagaaaagugguaucaguuuuuguauaucugaguauacauuuuagauucuucagacaguucuuuacacagccugcuugauuucaccucacaugugccaaaucaagagaaagagagcuguuaaagguagcuuguauggugauccacaguccaggagauaacccagcagggaaggaacaacuauauacaacuaaauucugauuuuagaaacuugaaaugcuugaaacgcuuucuauaaagaaauguuuaaaaguuacaaguucaaagugcuaggagaaaguguagguccucauuggaugagggaaaacuuuuaaaguuuuaacuuuagguaaauuauaguuggggugugggaaacaaaggaacaucagugacagucuuaacguaucaagauggcaaaauguaaagucuugguacuauucauugcuaguacagguguggaaaaccaggcauacucuuaacuuucgguaggaguggaaauugguguagccacaugggagggcaauuugguacucuuggucuaagauauccuuugaccuagaaauucuauggcuaagaauuuaucugauaacuaacaucaaguauaccaagaugcauauauaagaguguucacuguggaauugcuuguaauaucaagaaacuagaggucuaauguccagcaguugggggcuggauaaauuauggcuuauccuuaauauugaaauuaaacuuuucuguguuuauuaaauggaaauuauuuuauaauuacagccagacaggcaagauacagaggguauaaugugcuaaagggcaugauugauuugguuuaaaaaaaaaaaauuaagauaccaaaagauguuuuucauugugagcauguaguuugugaaauaacagauaauggaaaauaauacaauugaguuauuuucuucgugcuuucauggauuuuuccauuauuaacaagcaauuuuaugagaagagcagaagcauagcuauauguaagcccuguguuaucaaggcaaacaauauauaaauaguucaguaucuccaguggcuaucauuaucucagacugaugguugacuuugaggcauaaagaaaauauuuaauuguguuccuguacacuaaguggauuacaguguuacauguuuuugaaccauucugguuuaaaauugugacagcauuuggagaggcucaggagcugacauuuuaauguggaaguuaugugggguuuauagucuugacacaucucccaguuucuauaaagaucacaugcagucuggucuaauaauugauaguuuugagacaugcugcaacuuuuuuauaagccagguuuuuugaaucaagaagggaugggacgggacuuaaaaauaaaaugucauucuccccaaaaucaaaagcuuuuagucuugguaacucuugacugcaguuguauuuuuagaaaguaguguuuaaucgacaguguuucuuucucucuuuacuagguuguucgcucagcagcuacaaguggagcugguagcacuaccucugguguugugucuggcagccucggcucucgggagaucaacuacauccuucguguccuugggccagccgcaugccgcaauccagacauauucacagaaguggccaacugcuguauccgcaucgcccuuccugccccucgaggcucaggaacugguaaguuucgcuugcuccuggccuuugauauuaaguuuguggccugguauaaauccagaaauuuauuuaugaggaggucuguaacuugaagagccuccuuaggcaaguauuaggacauuugcuggcuaauugauuguuugggucaauuuauuagguacuucaguagcuucucugggccuugcccuguuguaaucccugccagagacacugaggacucauucauucuaguccuucacuucaaagagcucauuuugguggggcaguaggcuuuacauauaguuaaugguuuacaaaucaagugauaauuaaggguuaaauggauguaugucucguguaacacagugcgaaauagacgucaucuguguauuccugccaagaaauguuugaccuguauuuaauuaugaggaaacaauuagauaaauacaaauugugagauguucuauauaagacaacuggccuagacucuucaaaaauauuaauguuaugaaagaaaaaauacaggaucauuucuuauagagaaaaguagacuagagagauaaucaccaccagccuugguugggcuguggauccagauaaaagauuuggagaaauuugagugcuauguauuagguaauguaauuguaucuguuaaauuugggggguauuauaaugguauugcaguucuguauaaaaauacccuugaucuccccucugcugacuuuuuugguaauaaaaaagaaaauauauguccuugaucuuaggagcuacaaguagauguauuuaggaguagucacuugguaauucuggaugaaaaguauauagauguuuauuauacuauucgaacuuuucuguagguuuguuggauuuguuuuuuuauuuuauuuuuuuuuuuuaauuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuuccauccacacagacccggcaaccauccgauuucucaauuucuuccccacccuucccgccuuucuauuccacaaaaccgccauugucaucauggcccauccccaaugagccacugggcacaccucccagacggggucguggccgggcagaggggcuccccacuucccaguaggggcggccgggcagaagugccccucaccucccggauggggcggcuggccgggcggggggcugacccccccaccacccucccggacggggcggcuggccaggcagaggggcuccucacuucccaguaggggcggccgggcagaggcgccccucaccuccuggauagggcggcuggccgggcgggggcugaccccccccaccucccucccggacggggcggcuggccgggcagagggguccucacuucccaguaggggcggccgggcagaggcgccccucaccucccagacggggcggcuggccgggcggagggcugacccccccaccucccucccggacggggcggcuggccgacccccccccccgccucccucccggacggggcggcuggccgggcagaggggcuccucacuucccaguaggggcggccgggcagaggcgccccucaccucccggacggggcggcuggccaggcggggggcugauccccccaccucccucccggacggggcggcuggccgggcggggggcugaccccccaccucccucccggacugggcggcuggccgggcggggggcugacccccccccaccucccucccagacggggcggcuggccgggcagagggguccucacuucccaguaggggcggccgggcagaggcgccccucaccucccggacggggcggcuggccaggcggggggcugauccccccaccucccucccggauggggcggcuggccgggcggggggcugacucccccaccucccucccggacggggcggcuggccgggcagggggcugacccccccuccccccucccggacggggcggcuggccgggcggggggcugaccccccaccucccucccggacugggcggcuggccgggccgggggcugacccccccaccucccuccuggacggggcgacuggccgggcagaggggcuccucacuucccaguaggggcggccgggcagaggagccccucaccucccggacggggcggcuggccgggcggggggcugacccccccccaccucccucccagacgggguggcugccgggcggagacgcuccucacuucccagacgggguggcugccggacggaggggcuccucacuucucagacggggcggcggccgggcagagacgcuccucaccucccagacaggguugcggcccagcagaggcgcuccucacaucccagacagggcggcggggcagaggugcuccccacaucucagacgaugggcggccgggcagagaugcuccucacuuccuagaugggauggcggcggggaagaggcgcuccucccuuccuagaugggauggcggccgggcagagacgcuccucacuuuccagacugggcagccaggcagaggggcuccucacaucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaccauugagcacugagugaacgagacuccgucugcaaucccggcgccucgggaggccgaggcuggcggaucacucgcgguuaggagcuggagaccagcccggccaacacagcaaaaccccgucuccaccaaaaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagaccauggaaggagaccguggggagagggagggagagggagagggagagggagaggagggagaggagggagagggaguuuuuuuuuuuuuuuuuuuaauaaaacguugggaaggggaugaaauuauuuuggaaguuccagcuaugugccugccccugugcugggcauuucucaguuauauccucauuuaauccucaacauaaauuuggagagugagaaaauugagguuuguugaauuaacaacuggauuucaaaaccaguuuucucuaacucaagccuuuacuauuugguacugcuauauuaaauccuguggaauuuaaggaaaguauaaaccagguuuuauaguagaguacuugaacauuaauugaaaauggucuccuaucucaagccuucuauaucauacaugcccccuucugagucuuuauuaguaaccuaguuuagguacugcuucaugauugacugguuuuucucucucauuuuggcuuagcuucagaugaugaauuugagaaucuuagaauuaaaggcccuaaugcuguacagcuggugaagaccaccccuuugaagcccucaccucugccugucaucccugauacuaucaaggaagugaucuaugauaugcugaaugcucuggcugcauaccaugcuccagaggaagguauguggcuagccuaccucaggaggcugggcacuagaggauauguuacuuugccugggucauuucagccaacucauggcuuagugagcacucacuaugugcccauacucuggggcucaagaugaauaagauacccauugcaugucugugaagaagcuaauagucauauaguaugacauaccaggauggugguaaguccuuagggugaggcaccuuaccuagugagggugcacagguaagaaaauuucuuuguguacaugauuucuaaaaugaaccuugaauggaugagauugccagaguucuguuauaugagaauacacaccauacgggggaagaaugaacaaagauuuagaaggagauaauagcauucugugagagguugaaaauaagacaccaggaagucucuaauguuuucauacucaagcaaaaccuuuuuauugucugaagagcuggaggcaauauuaggaggugugucugaguuuccuaacuguugagaccaccacacccauccaccuuuauuccuaguuaaggugcaucuuauaagcauuaggaaagucaugauugauuugcuuggaacauagguuuccauuauaguaagguccuucuggauuuuauucaggacauacuuauuugauagguccacagaauugccaaaaauugaugaaugcugccuuuaauaagcaaaagaaaucugagucuugaccuuggugcuuuucaucuguacagaacccugauccauauagaauuccuugguucuccuaucaccccagaaucuuuacccuaucucuuaucaccuccccgaaauaguuuagcuauauagcuguggcaaccauuuauugacccaccacugcaugagcaauagugccagguauguucacuuaagguuuguaguuacagcuuaggaaagugagacuaaguuaauugccuguggucacaagacuaguuuuuguaauuuuagggugaggcacucuaacauuaucuguaauagcaccauguaaacagucauagccacuugaugugaaauugaccaagacugacuagauaggccuuaacauuguccaauuguagaagagguuuauuuuguuuuugaugguuguuacuguuuuccuagcagauaaaucugauccuaaaccugggguuaugacccaagagguuggccagcuccugcaagacaugggugaugauguauaccagcaguaccggucacuuacgcgucagagcagugacuuugauacgcagucagguuuuuccauuaauguaagucaauuccaacagcguuuuaucuuucuucucauuuuucaaugccuguguggucucaguauuuagggcuauccccggggaauuucaaagauauuaauugugauguaucuguaaauuaucuguugccuguaaagacaaaauuggggugucccuggagacuuuuuuuucucuccuaggauuagaacuguucuuuaauuuuuuuucuuuucccuuuccuuccccgccucccccacagucucccagucacuguauuuauaauagccucccacagauuauaguauaaagguguaaggugguuaaaagguuggccaaagagaaucuguggcauucccagccagugcccugggaaggaguucugccauuugcagacgggugcuuuugaaauucauaauagcucaggaguuuucuucuucuucagagucaggucuuugcugcagauggugccuccacugagacuuccgcaucugggaccucccaaggagaggguaaugauuugcuuuucucacuaccauguucuuauuccuuaggaaaacaacuugaaaaaacuguagguguccugugcaggggguaggagaauacagacuuaauuauuacguuuacuggucuaagugaacuuucucaggugagcucaguguucuguaauaaagggucucuauaugcuaaaguuaauggaacuguaaguuaaccaaccuaguaaugguugcugugguaacauauuuuaguuuuacuuuuuaaaucacaccauaauuauuugggggguuucuaaaaacuggcuuauagagauuuuaugccagugauauuguucuagcuacaugcuuuacgugguggaugccugucuuccagcaauguuaacagagcccauugacuacucaccaugaacuagaaaaaugucccugggaguaagucuaaugagaccuuuaaagagcugcuucuccuuagauaggaaaggucuuugugauccaauuuaggagacauuuuguuuaaaaucauacuaguuccuggagauaaauuuaaaaggcuaacauuagugaaauaauugguuaacucauuuuacuggguuuacuggccauauguaguguauagcguggaugauggugcugauucaagggaagcauuacccacuauguggcagacuauauuggacaccaaaauggaucagauuuguucccuguacuuaaaguacuuuguccagugacugagaccugcaagaguuauaaugcaggauaacugccagaaugaaggcauacuuggauaagauauaauggacauguaaaguaucucacaguaugucuagaugagacaggaaagcauuuauggaggaggucagcauuugagcugaacuagauaaaagugugccaggcagacggaagaaagaaguaagggagcaagacaaguuugaagaacuguuaguagaguguuucuggaguauguaaaaggagggaaauggagggagaugcacaaauaguuggacaaagcaucccuguuguacuguaaccacauaaaucugagaccugaguuauccugguucucugcucuugcacugcagugucacgagagcauucaguuuguacagguggcuuaaaguggaggagaaauagcauucuuuuccaccuaagacuugauuuugccaguguuccaguguggaauugaaccaguguuugacuuuucucaacagcuucaacuccagaggagucucgagaugggaagaaagauaaagaaggggaccgggccucugaggaaggcaaacagaaaggcaagggcagcaaaccuuuaaugccuaccuccacuauccuucgucuucuggcagaguuggugagguccuauguugguauugcuacccugauugccaacuacagcuacacugugggccagucugaacugaucaaagagguaauauuuccaacuucuauuuaagauguuacacuguacuuccaucauuuggguaccgccugugucagacacugcugggaagcugugcaugcuaagugcuaacccaaguaaugagugagaagaggcaucuucagacaugcaaggccgggugcgguggcucacgccuguaaucccagcacuuugggaggcugaagcaggcggaucaccugagguuaggaguucgagaucagccuggccaacauggcaaaaccccaucucuacucaaaauacaaaaagaaauuagccaggcgugguggcgggcaccuguaauuccagcuauucgggaggcugaggcaagggaaucacuugaacccaggaggcagagauugcgggaaucacuugaacccaggaggcagagauugcgggaaucacuugaacccaggaggcaaagauugcagugagccaagaucgcaccaucguacaccugccugggugauaagagcaaaacucugucucaaaaaaaaccugaaagagcuaggccuuuuuucauuagguucacugagagagagaguuaaugagauuuguucuauugaaagucccuuuuuaugcauuguggagauugaagagggaagacuggagucagagagaacaguuaggaaucugauagaguaaucuaguaacguacgaucuuggugaaguuggaggaaaaugggugaguugaagaaauauuuuuaagguacaaauggacaagaauuggguuuggaagaugaaaaaggaaauuaagacucaaggauguuucuugauuuguggggguuuuuuuaauugcuuuuauggguuggcaucuaacaagaaaauagaaugggguggggaagguuugaagagaaaaugaggaguuuugagaaguaucugugggacaucuaaguaaaagugucuaaaggacaguugaauaaaccauauaaauaagaauauagguguucaucuuccagauguacucacacaugugcaaagacaccagaugugguagcaguauugguaauaaaaauaaaggaaaagccuuaaauguucauuaguagagcuguggaaaagaaugaaguguccugaugcagaauuauccucagguuagauuuuuuaagugaguggggcauuuugagaaacuguaucacauguucccgcauauguaaaaugggugcccaaauauuuuuucccguaagggugccuuguuuuguggaucacauuguaauuuuaugguuaguaaguggcaaaagggucugagagugaguaggggcacuaguguugccaucuuugaaagcaaccgccauuuuuaaagcuauucuuacuuuaauccaaguuuaauauacauagaaaaauacacaaaucuuaaauagucuguuuuuccuagguaaccacuagccaaguuaaauaaagcauuacaagcucccuagaagcugcccuccuuguucuuuagugcaucuccucccacccauuucaccuucacucaagauaaccauuaucuugaguucucgugccguaauuugguuuuguaguucauguaaauggaaucucauagaauguacucucuuuuuugccuggcuucuuuugcuuaacauacuugauucauuuugugugcaggugaaguuuauuuucaucuguauaaaauuccacuguggaauguaccauguaccaaaacaaauacaucuuuuacccauucuacugcuaauaaacauuuggguaauuuugccuuuggagcuaucacagauagugcugcuaugagcauucuuaugaauauauauaaguucgugaacuacccaauuucuguuggguaguauaugccuaagaguaagaauugcugagcucuagaguaugauaguuguucugcuaaugcuaaaaguuuuccagaguggccaggucaguuuauauuauuaccagcagcauaugggagaucaacaguugguguuuuuucauuuuacugauuuuaauggguuuguagugguauugcauuauaguuaaaauuuacauuucccuguugaccauuuuuuucaugucuuuauuggccauuuguucauucucuuuugggaaaugucuauucagcucuuuuacucuauuuuccuauugaguuuuuaaaauauauucuggacauaaguccuauaaauacauaaauaggcuuccuuuuuuuaagagucucacuuugucucccaggcuagaaugcagugguacaaucauagcucacugcagcuuugaacucccaggcucaagugauccucccaccuuagccucucaaguagcugggaccuauaggcacaugcuaccacgcccagcuaauuuuauuuuuugaggucuugcuauauugcccaggcuggucucaaacuucuggccucaagugauccucccgccucagccucccaaaaugcuaggauuacaggcaugagccaucacaccuagccaggcuuuauuccaaagcuuuaacucauuuaugccaguuguauucauaauuuauaauaguauuaccuguggguuaacauauuuaauuacaaauuuauuaaguaucugccuaauauguguccaguguccuaccaguacuggguacugguaagugcuuuauaaauacuauuguuaauccucaccuccacacugcaagguuguugauagugaucucuuuaauagaggagagaaggcucaaagagguaaguaacuugccugggaccauacuacagaguagcagagcuaaaauuggaagcuagggcuaugauuccaaagcuaaguccuuucuacgugguuauugagaaaauaguuuuaacuuuguauguauucacuacugggaaauuaauuguuauuucuaauuguuuuguuuugacaaggucacuuuauucaguuucucagacucucaaauuauucaaugcauuuucuuuauugagguaaaauuuauauaaagucaaccauuuuaaaguguacuguugaguggcauuuaguacauucgcaguguugugcaacugucaccuauguaguuccaaaaauguucaguguauuuucauccaaaauuugcuugaaugacaauagaauuuguuucuaagauaaggaauugucuaggcaggaauuguaguuagagaaaaaagaagagucugacuuaauuuccuuccucuauugagccuuuuucguuacuuuaaauaaccuugcauuaaauauuuuugcauauuaguuucugugacucugcugucucuugcucagcucuuaccagcuucuauuguagcacaggguccugggcacauuguaggugucaguaaauaauuucaauuuaauugaacacugaaggguuuauagcacuuaauuaagaaucaagguuugaauccucagcccuugauuaaauucuucugugcaagccacuucuuuagggggcuucagauuaccgcuuaucaaaugagaaaauacuuaucuauuuauagauuugcuguaaguaguucuauuaaauaucacaugugaaaauauuuuaagauaggugcaauagcacaugccuguagucucagcuacuuggaaggcugaggugugagaacacacacacaggaguuugagacuguggugugcgaugaucaugccugugaauagccacuguacucuggccugggcaauauagcaagaccucaucuucuuaaaaacauuuuaauaaaaauaaaguuuuuaaaaaauguuuuuaaaaauacaugacaucuacauaacaguguauaagcugugcagugggaaauggguggcauuuggaaguuuucuaaaaucuggguuugcuccuuacuugcuuguaucuuugagccuuggcuucuucaucuauaaaguggaccuaauaaucacucauugggugacuuaaggaaauacuauguguguguguaucuuugguccugugcaaaugauauggcauaauugugcuuguaaguaaaugucgugauucaugacuuuucaggacugcagugugcuagcuuuuguucuggaccaccugcucccacauacccagaaugcagaagacaaggacaccccugccuuggcccgccuguuccucgcaagccuggcugcugcagggaguggcacagaugcccagguggcccuagugaaugaaguaaaagcagcccuuggacgggcacuggcuauggcugagaguacagagaaacaugccagguaagauucauaccugucccagggcuaauagccaagaacauccccuuauucuucuucuuaguccaugggugguuuugcacuugaacaaaacuucuugucauacuggcaucauauacucucugguccgcucaaauaguucuggcgguuggaaauagccagagcacugauuaccauuagaguaaguggguaaaccuagagaaaacaaagggaaauguuaaguguacuuuuaaggucuucaaggaaguugagcagguuauuugaucuuauauuuuaaauuuuauuuaaaguaggggcugggcacgguggcucacgucuguaaucccagcgcuuugggaggccaaggccgguggauugccugagcccaggaguaggaguugaagaccagccuuggcaacauggcgaaacccugucucuacagaaaauuagcugggcguaguggcacgcucccguagucccagcuacucgggaggcugaggugggagugucacuucagcccaggaagguugcagugagccaagauugcgccacuguacuccacccugcuacagagugagacccugucuaaaaaagagaaaacgaaugcuaucaccuuagggaguguguucucaccuguuuguuuagauguuauuuccagaaggaaauacaaaaguuacaggaggguuaucugaggcuauuuugugaagacuuggccugagaaauggcuauauucauaugauagagaugucaaaacuucucucccaggcuucaggcagugauguguaucaucaguacuaucauggaguccugccccuccaccuccagcuucuacagcagugccacagcgaagacccagcacaauggcaugaacaacaucauucggcuuuuccugaagaagggacugguuaaugaccuggccagaguaccucacagcuuagaccuguccagguaaaaucaugccccagccccaggcuuuuccuucucuucagccucacuacacgaaugauguggagguagcugguguagugggaaaacuuuggguacaagugggagacccaagucuuucuuauuguggcuuuuagcacuugucuuucuuaaagccuugguucuuacuugcuauaaacucaagaguugaacuauaauagugauuuuuuuuucaagcuuccccccacuuuaaaaauuaccacuuauuagaagauuauauguauauuauaagaaauacagaugaguaaaaauaagaaguagacacuguauuccuaccacccagauaccaugauuaccuuauugguuuauuauucaguguuuuucuuugcaugcauaaauaauguauucuuuacuaacaugauaugauacaugcuauuguguugggggaaauuuggggcauuuucguuuuuauuuucaguuacuggucacuuccuugcuaugaaaauaaguuucauccuaccuaaugcccaaauccauaauuaagcauuuuucuccaaaccagaauccaauuaaggacuuguauuacaucuggcuauguuuucugaaucucucuuauucuaaaacaauuuuuuuucauuauuucgaucuuuauuuuguuuuuguuguucaugauuccagcuuguugaagcgaccguguuuuugccuucuaaacuuggugcaguugcuuccuugcaguguaguuuaacuuaauccuuuacuuccugauauuuucuguaaacuucuaguuagaucuagaggcuuuagaggcuuauugaagcaguuuaaacauuuugggcugaaauguguagccuaggugauguauagcucauauuguaucgugggagacacaucucccaugauaauugucacuuuuuguucuuacuagaaagucaucucuguuguuauuuuggcacuuuacaaaugucuacacuaucaaucauauaccuaaauaauagccuuaacaucaguugauaauucuugccuggaucaauuaauuucuuugaggcuuaugaauaaaagcuuucuaauuucucauuucgaauacauuauuaacuggcauuuuucuguguuagccucacagggaaugucugguugugcuaaaauauaauuucuauuauaaaggcaguauaaaaacuuaauuucuuucuauuuacauuugagauucaaauguagguuuuuuucuggcuuucuauuuuuaagucguauuauggacucgacuuuucauguuuguuuuguuuugaaacuagugauugaauuuauuuggaucacugcagucacuuuuucaugcucaaauuauuacaccuuugaccuauguggccccuucaagaugacuaaauuguccuuuugcuacaaaccuaucaauuuuuugaaacauuuauaaaugucaaacucacaguacuguaaugaacaccaugugucuaccuagauuaaccacugcugaacauuuugcuuuauuucuucccuuccuguccuuucaggagcugaaucauuugaaauuaguugaaaacacuguaaaacuuuaccucuaaguacuugaucaucugucuccuaagaacaaauauuccuuuauauggguacaguuccauugucauauccaaaaaauuuaccaauaauauaauaauacuaaauuuauacaauuuuauauacacauacucccaguuauuucaauuaugucuuuauacucugagggagaguguuuugauccgggauucagugaguaucacauguugcauuugguugucacauuuuuuuuuuuuaugacauuuuccuguuuugaugaauccaggcuugaugucuuauagaacaucucacagucuacauugauguaauugcucccuuaaugguuagggucagguuaaacauuuuuggcaaaaauacuacaugggugauauuugcccuucucacaucacgucaggagacaggugaauaccacuuggucccaauacuugugaugcuaaauuugaucacagccgaggcugguggaucacuugagccuaggaguucgaggccaaccugggcaacauagugggacccugucucugcaaaaaaauacaauaauuagcuggacauguacgccuguagucccagcuuuuugggaggcugaggugggagggugguuucuguuagauuuccacuuuguaaugaauaauuccauuacuaucauuauucuuucugauacucagcugggccugugguaaugaucccauuaauuuuuuuuccccauuuuuguuguuauuuuuccucuuuauagaaacaggaucucacuauguugcucaggcuaggcucaagcaauccucccaucucagccucccacagugcugggauuacaggugugagccaucacgcccagcugucccauuaauuuuugaaagcuuuuuggcacaaugagauaucccaggcuuaccuuaucccuuccuugcccuauuccugggaucacuuguucugacgagucuugguuacuuuuagugugaugugauaucagagacugccaucuugguacuacuagugagcauauauauauauauauauauauauauauauacacacacacacacacauacauacauacauacauacauacauagacucacacauaaauacacacauaaagcagauaaaagcagagcugcucugguguuagugggcaccugguuggucucacacaccuuauuacacuuagaaaucauaccacaccuccaacugcagccccuauuguacuuuuauugaacucuaggaagcccuacagaguauaauuugaaauucacaggacuucaaacuguuaucagccgggcgaggagggcagguugccugagcucacgaguucgagaucagcaugagcaacauggcgaaaccccaucucuacaaaaaauagaaaaauuagcugggcaugguggcucacgccuguagucccagcgacuuggaaaccugaggugggaggaucacuugagccugggagguggagguuacagugagcugagauugugccaauguacuccagccugggugacacagcgagacccugucuccaaaaaaaaaaaaggaaaacuuuuaucauguuccuuccuuugagcuuuuaggguuuggggacuaaaugcuggugguuuaaaaaaaaaaauccugaguacauccgagaaguggcuugcuugcauguggucauccagaauacauucugauuuccagucaagaauuuguuacucaugugcuuuccauggccccaugaaauauggcauugauuuaacucuugcuuuuaggguggguuccuugaagacauuuaagucaaaauuuuuuuuuucuaaacaaaaguagaguguuaguuguacgaccuuaugccccuuuucucuuaguagauuccauuguaagaagcuuagugucauuuagaagauagacaccuaguauuucugugcucaguccaucucuuuaucuucccuuaucucagucccaacauggccaacacagucaaugcugcucugaagccuuuggaaacacuuucccggauugugaaccagcccaguagccuuuuuggcagcaagagugcuucuagcaagaacaagucugagcaggaugcccaaggagccucucaagauuccaguagcaaccagcaggacccagguagggaaucagagccaauggacuggagaggugggaguaguugcuuuaugggccugggaucacaacuguucuggcuuggugguguuucccugggaacuugcuggccuuccagagaucugucauaguggcgugggaaucugccccacaaagaauuccuucaaaaugcagccuuguuuggcuauccucacacguagccuugucuuuuccuuugucacccauucguuuauucucugagaacuuacaaacuugcccaaggaagggaccuuauugucuuugcgcuugccucauggugcccagcacauaggcacucuuugauuauuuugcugguugguugauuguuucaggcgagccuggggaagcagaagugcaggaggaggaucaugaugucacucagacagagguggcagauggggauaucauggauggggaggcugaaaccgacucaguggugauugcugggcagccugaggugcucaguucacaagagaugcagguagggaggcagaucacccagcauuucccuguugcggcgcugaaccaaacccuugccagguggugugggugggugaguacuuuagauccuugccucaaugcuggcugcuuugcagaggagcaugggugauaugcuuaguagaugcucaguaaauguguuuguacuguauuaaaagaggggugggggcagggccaggaugccauguacuaugaaaugauauagaucccaaccagaaaacuuaggcacaggugaaauguugaaguagaaagcugaccugagaccguugggccccgggucuuugauuuacuuuggcucuggucauuauuggaagcuccuuaacaccaccuuaugccuauagcaccagcucuugcuggggcauuaaaacagcagucuucuaaagacccuaaaggaaagcauuguaauuucuggagcugguagcauuggguaagaaauugggccugugguccuaagcugcuggcuuuaaagagaucuauuaugucuuccuggacaguauaaagacaacccaguaucagauaacugggauggacccauuugaaggauagucugguuguggauugguagcacgugguaguuucugugcuaauuagcaccgaaugugugguuucacguaacauccucugucacauguuauccuagaaauguaugcugcuuugcuggccuuuuuuaggguuucggugcuagcacaaugauagacuugugugcauccauauauauguucuauuucucuccagguugagaaugagcuggaggaccugauagaugaguugcuugagagggauggcggaucugggaacaguacaauuauaggugagagccccagaacugaguauagccucuuccuuugccucagucucucuugggaggacccuuuuucucaucaucugcuugcucagcucugccuaagggcucauagccagccuagaucgcugcuugucuugauguugacggucuuacagaugagaaauucacaagacgucuacaggccuguggcagucuaaaguguugccugugugggggagguggugggaguggccauugauacagaugauacaucaagcacaucaaaagaguguuuauucauggaggccuagaggaggcuguagggugagaaagcgcugccuuucaguucuucaaugaaguccaggggcuuucugccccugagucucaguaguguaaaaagaaugaucauucccugaggguggcccuuuauaaaucucagagggaaaauggcaaagguacccuacugucaccuggcucugaggguguauguguuacuuguuuuuacuuuguugaucaaggaaaucaaaggauaaauggaaguagacacguauucuuaaguuuuacaaagcuuuuuuauacccaguauccucugugguuucacaauuagugggauuggcagggcagaugugaucauccuguuuuacagaugaggaaacugagacucagacagguaaagugacuggccaagcucaccuagcuagcugacagcagacaauccaggucuucucccucauccaaaaaaaaguggauaucugcuagguguacauagcuacuuuagacgcacccagucuggaaagggaaguccucuguuguucagugaaggcucugcucuguaaccuucagugagcagaaguggagaggaugaaucacaagaggacgugcugauggaugaagcuccuuccaaccucagccaagcuuccaccuugcaggccaaccgagaaggugagagugccgaggccagaaaggccucccuucuugcccugcacgucugacagacacuacacuaggguuuuccuggaggcagcugcccacaugugcagaauaaggaagcaucugucugcaugcgcugacauacaccauccacuuuauccucagccaguuuuucaaauaacauguuacuacugcuugcccaaaguuugucacuucuuacuugguucgcuuucuucucacccaccugcuaucaucgcuccagguucccucuugccaacaggauauagucaauagcaaaguagggcugaaaaggcaagggggcaccagcagacuuggccaaguccuagaccauggcuccucaagcaccacccucuagccagccuccacauucagccacccugcucaguguguugaugcauugauuggcacucucaggaaaucgggucuggcucacuaagucuguacaucaccccagaucugguucuuccucucauagagucagauaucccaucaccuucccacucagccugcuggccugcacaguagccuguuuucuagcuacucaguuuaguccuccaaugugcucccuuuguuuuagauuccaugaauauccuggacccugaggaugaggaggagcacacucaggaagaggacagcaguggcaguaacgaggaugaggaugauagucaggaugaagaggaggaggaggaggaagaugaggaagaugaucaggugaggggggacugcguuuggguugguucagaugaccucuuccaugggaacauagagcugcagaaaaccaacagucuggguugcuagccucagcgucucccucccucaugugcacauguggccauggcaccaggcuucagaaaacccuuaccuccagcaauucuccaucuccuauuuucccuuaaggaggaugaugaaggugaagagggagaugaagacgaugacgacgauggcucugagauggaauuggaugaggauuauccugauaugaacgcuucucccuugguccgauuugagcgcuuugaccgggaggaugaucucaucauugaguuugacaacauguucuccagugcuaguaagauacaggggcucagcuggguuuuucucucuugauucuuauacccuucucuaggguaagccaagcaguggaccaaaccgauccgauacagacagcacuucuuuuccuaugcugacuuccuggggcaagggauaucugaauccaucugucucauuaguguauacuuaggagaaggaauagugagaggcugcuuuuguucccuucaccucaguaaauaggcagccauuuuagagccuggacaacuugaugauuugcuugauuaaaaaaaagaaagagaccaaggcugacugcaucaggcacccaugugcacaccacaguggcagggcaaucaauaauccuuauguccauaacacaagaucuugaggguuugaauggucaccuuugagcuuggcuuuggggagcagauuugaacauacucacucuauucauccaggaugcgucuuuucgggagaacgagugaaucucuuccucccccaucaccgugaaacuucccuuuuagcgucaaguuagaaucgaguucuuagaaucaagcugucuugauagggcaggucuugacaacuuaaaucacaagcaugauguagcagaaaacacugaacuguucuggucuguuuucuuggccaauuaaucucuuaccucuuugagccucaguuugucaccuguaaaugaaaaguucgagaaaaaaauggguuggauuagauaacuuugaagauaacaucuaugauuauuuugcauuuuugugauuuucaucaguuucccuuagaguugagccucuguccauucagcaaauugaacaauauuugaggagugccuacuguauccuagguacuagggauacagcaguaaagaagaaaacaguccucguuccucauaggagugguuuauuaggaaucauaacuaagcaggcauuacauugcacuauaguaagagagcacagagguaaagaguuaccuaacccaaucuguggaagucaggcuucacagagaaagugacaucuuaggccaagaagagaagagcagguaaagaagcgggagaggagucuucaaggugaagggagcagcauguaucugaggggccuagaagcaucacugugacuguaguguggaaaauggauugggagaagguacuauuuaggaggccguugcaguaucuaagugagagaugauggcauaagcuaugguagugucagugauuguagaugaguugugggaaugagggagaaaggacaaagcucagguuuccgugugaggaaguaaggcccaggagacaugauucugcuugaacaaacauggaagaaauuucuuuuugacacugacccuuuuacauauuguccuugcagcagacauccccccauccccaggaaauaucccuaccacccauccacugauggugcgccaugcagaccacaguucucugacacugggcaguggcucuucaacaacucgucucacccagggcaucgggcgcagucagaggacccuaaggcagcugacggccaauacuggccacaccauucauguucacuacccugggaaucgccagcccaacccuccucuuauacugcagaggugaguuacagagaucuguuggauucaucggagcucuuguaagaauuuucacugugcuuuagcauugucuuaaccuugggggaaauaguccaucacuuaauguucuugucauacacacaaauaagguauuuguuccauuucuuuguggauuacauguguagccuuuuggggagugcagccuuuuggggaauaccaaauuaugucaauaguucugcgcauguauuuagcaauuauuaagugucucaugccaagcacuuaacacuuuagauauagacgggacaagaucccugcccucaggcuuagaguuuagugagacaaacaaucuuaagaaguaaaagaaaggcauauaaguguuguaaugguugguguacagacgacagagaggguguaguggaggcaaugugaccugacgcagugccuggcacgugggagcuuauugacacccacuuggugccaggaacuauggaauaauauacaacuuaaguacaaaaccagggugguauucagaaaaauaacuuagacuugugugcacaucaucagguuuauaaucauguucugcauuuaauagaggaugcaugaagaggaucucaugguaacagguugcagggcaccucuggacuuaacagugaucaugguacccaccauuacccuacagguugcuuggucccucagcugcugcugacauccuucagcugagcagcagccuuccccuacaaagccggggucgggcccgccuccugguaggcaacgaugacguccacaucaucgcccguucugaugaugagcugcuggaugacuuuuuccaugaucagagcacagcuaccagccaagcaggcaaguuuguguggugaaagggaggguagaauuugucagauucuacuuuuucccugcugaggaaaagcaagacagugucugcccuauagaaaacccccauuuuauaggagccagaaccacucagugacuuagccaugggcaacaaaaacuuuauugucucuagguacuuguuauguucuaaacauugugauagaccuuggguccuuuuagggaaauacugcaauuuuuggaucgguggaucaguuaaugcuugacaaggccaagaaucucauuccccuuugcugucccuacaggaacccuguccagcauccccacagcccugacccgcuggacagaagaaugcaaaguucucgaugcugagagcaugcaugacuguguuucaggugcguggcagcuugguuaucagggcaauagugagccuuccagagcuagggcaaacguguggagaguuguuucccugguucucuguggcuacaagcucugccucuuggcuuccucccugaccccaccagagcagccuuugauuuuugccucuuugaaacagugguuaaaguguccauugucaaucaccuggaauuccugagggaugaggagcuggaagaaaggcgagagaagcgcaggaaacaacuggcugaggaagaaacaaagauaacugauaaaggcaaagaagauaaggagaacagggaucagagugcacaggugauucccaagggcugggaggauucaucuuugacugugucugccguaaugugguuuuggcauacacauggcaccaggaaucacugaagaauccuagaacguucacguugaaccugggaaauuuuuuauuucaaauucaccauacauugaccugguuuuuaggggaaagaauucaaaccuagaggggagauuucucaagugucaagggaaaaacuggagccagaagcagaauggcuucucacucaacagucacacugcauagucucuaccgccaaggacagcaucaagacaaggagaaaaaccuuaucuaaguccaugcucuuagucgcccacuuccauuucugucggugaacugccaguguggggaaucuuaccgagaugaccccauuccgucauuugaguaagaucagccuaggugucagaucagagaaaauguuuguacucugaaccccaucaccacaugucauuuuuucuagggcucacauguauaaaaucacuaauacaauuuugguuuagaaggaaguuaccuacuuuuuucugaaacuucugggaccucagacagagaucuuuuaaaugucugaguaaauguugauagaauuauacauuacaguguaucacuugauauaaaagggggaaaaacugauagaaauacaaagaaauaagacuugagagugaaagacuuuaguauacccuacucagcaguuaaggaaucagguagauuaaaaauaaggguagugaaguguucaguuaaaauaacaagguugaucuaacaaauaucuuuauauagaacuuuuuaccuaauacacacauuguuucaaacuugauauaggaugaaaaauaagugaaccuagccugugacugaaaagacuagaguggacaaaauaaaaaauaagccccaugaagggaaaaaauacauagaugaaaccaagaaauucuugcuagaaugaucaugaucgugcccaucccuaagggguuuuuauuauccuuuccuuccauauuuauuucccccucagccccaaacaauucuugaaccugaguauguauagagaaauuggucauauauuugcacagugaaaugaucaccuuccuuuggucacauggccaaagcauucuccauuagaucacugaacuccuagauggucuggguggaggauggugacuauuacaguugaccucuaucuuaggugcuugcaaagucccacauuggucuaucccuucuuuuugcaguguacugcaucuaagucaaaugacuccacugaacagaaucucucagguaacucuccuucccuuucucccuucuuacuaaucaauugguugcuucuuuauccugauaguuccgaguagcuggcccacauaggcugaagauggacacuggugcucugugggaugagguaguagauuguauaguuuuagggucauaccccaucuuggagauaacuauacagucuacugucuuucccacggugguacacuucuucuccgacuggcucuguucagguucuuguucugguuauuaucuacuuuguucuggcauggguaaugaggucaugugucuuguucauuuccugacugcaacucuguccucugaaacagcauguucauguacaucuuugaaguggcugguccuuugaugaccaccaugguguggcacuucaugagaauaacugaugacagugguucucaaaugccaguccucuguggaaacgaacaaaaucaaggagcuuuaaugccuuuuucauaaagcugaauuuauuccauuuaaaaggcuguuuuuguauuuagagaucauauuccuaauucugugguaccaaaauauuuuuauuaaaugauguugauuggauguuuuuucuuacauggcuaaacuaaaaguuggcaaccccuacauuagucucuacuuuuuguucuuuuuuuaauuaaauuuuauugguccauggaaucuaaaagucuaggaacauugucuuggauagugugcuguucaugaagguagcucucugggcuuagugguaugacugccguauguuuccuauucccucugaucuucuuaacaauggucaguagccauuuugugauucuaucaguugguucaugugauaucauaugucucccccacccauauuuccucagaacauucuucugccucccuacaccugucuccuuucgcacuugaguuggaaaaugauuguaccaaagccugcacaauauuuuuuaaagcagugaaguaggguagaugccuugguacccuuaaucuagcaaaagaucuuuaaaagagucugucaccauguaaaauggccuuuugccugcugcccuuauuagaggauucugcucaugccagggugagguaguaaguuguauuguugugggguagggauauuaggccccaauuagaagauaacuauacaacuuacuacuuucccugguguguggcauauucacacuuagucuuagcaguguugccuccaucagacaaaguuguagauguuccuuggauaauuuggacuggaagaaaagagacauggaaggggacagaugguguuuagggugaggcagaugucauuauaaagugacuugucuuucauuaauuggagcauauaauuauuuuaccuuugggcaugaacucauuuugcuauucuucaacuguguaaugauugcauuuuauuaguaauagaacaggaaugugugcaagggaauggaaagcauacuuuaagaauuuugggccaggcgcagugguucaugccuguaaucccagcauuuuugggaggccgaggcggguggaucaccugaggucaggaguucgagaccaaccuggccaacacggcgaaaccccgccucuacucaaaauacaaaaauuagccaggcuuggugacacucgccuguggucccagcuacucaggaggcugaggcaggagaauugcuugaacccaggaaguggaggcuucagugagcugagaacacgccacugcacuccagccugggcaacagagcaagacucugucucaggaaaaaaaaaaaaaaaaaaaagauuuugaagggcuggacgcaguggcucacgccuguaaucccagcacuuugggaggccgagguggguggauugcuagagcuuaggaguuugagaccagccugggcaacauggcaagacccugucucuacuaaauauacaaaaaauuagucagguaugguggcacaugccuauagucucagcuacuugggaggcugaggugggaagaucaccugagcccgggaggugaaggcugcagugagccaugauugugccacuacacuccagccugggcaacagugagacccugucuccaaaaaaaacaaauagaguuuugaacgaaauucugaccauuucuugcuccaaauagaugaagugggaggaucaauaggauuuugguaguuagauuuucuguguaccuauaggucagagacauuuagccucacccuauauggccugaaaucuucccccuuccaccugcagggcacagaaaggauuuuauucuuagaauccacagagucagagcuccaguucuugcauucuugggacagagauagcacugugccuuaaccuucauccuuaguauaccagaccagagauguuccuuggaguauuuuuguuguggggaugaucacuggcugggugggauacuuaucaggccacauuugcugauugggguggcuccccucaucauuggcugguugccccuuaaccacuauuauuguucuuuccgagaaagaugggacgccuaugccugacagcuacccaacaaccccaucuucaacugaugcagcuacaucugaguccaaggagacccuuggcacucugcaauccucacaacagcaaccaacacucccaaccccaccagcuuugggagagguuccucaggagcugcagucuccagcuggagaagggggcagcucuacacagcuauugaugccuguagagccagaggaauugggucccacaaggccaaguggggaagcagaaacaacucagauggaguuauccccagcucccacuauaagugaguagaauuucaacauuuggggaggaugaaacaagagggaagaaaggaugucuuuguagcuucucuuugcucuuuugcuugagagaaauaguaggaguucaacuucucaaauaauaagaucucgucuugcgcauucacuuucuuaagugaaguugagguccugaacuggugauaguugaaugucuaaugauauuggugaugauaccaacaguucauugaggcaauuacucuguuucugggcuaucaccccaggcuuauuauuuaaaaacaacucuccagcuggguaugaugacucauaaucccagcacuuugggaggcugaggcagggggaucauuugagcucaggaguuugagaccagccugggcaacauagaccccaucucuauuggggggaaaaaaaaacucuccaaaaucgaugguguuauuuacaugaguaaacugaaacucagaaaugaaauaauuagcccaagucacucuguaagugguugaacuagaauuaaaacccagaucugucugacuuuaaagauuacucucuccuuccacaguucccaggauggcaagcaugucaucccacacuuagagcucucccauucuccuggcagacacuguuuaucucaugacacuauuucucacugguuugaaauggggccugaaaagucuucucagcaguauuucaacaggauaaauugauaccugcuugccaucccugcucuauaccaucuugcuugugaaguucucuggagagacccuaaggugucaguuuuuucuuucaaggaaccuuguuuauuuuauuuuauuuuauuuuauuuauuuauuuuuugagaaaaagucucgcucugucacccaggcugcagugcagugguguggucuuggcucacugcaaccuccgccacccagguuggagugauuguccugccucagccucccaaguaacugggacuacaggugcacgccaccaugcccagcugauuuuuguauuuuuaguaaagaugagguuuugccauguuggccaggcuuaucuggaacuccugaccucaggugauccacccgccucggccucccaaagugcuuggauuacaggcaugagccacugcgcccuaccgaaaccuuguuuauuuagagaacuacagggauaugcacgugcaaguggugccugcagugaaucaaagugaaaaaaucccuuacccgggcugggcgcgguggcucacaccuguaauccaagcacuuugggaggccgaggcagguggaucaugaggucaggaauucaagaucagccuggccaagauggugaaaccccaucucuacuaaaaauacaaaaaacuggccgggcgugguagcaggugccuguaaucccagcuccucaggaggcugaggcagagaauugcuugaacccaggaggcggagauugcagugagccgagauugugccacuguacuccagccugggcaacagagugagacuccaucccccugccaaaaaaaaaucccuuaccugguuugccuagggaagauguuucacaggcaugccuggaacacaguaaauguucaagaauugauagaaagggcuucagcugaaccuuagaaaucucaaagugagauugagagggggacagcaagggagaagugagaagucugagcugagaugccccuaaggaagcagcccuaucaaagaccuuaucugucauuuugccccgguuccagauagaaaccuaaccucucccugcaacuucuuccuagccucacuuuccccagagagagcugaggauucugaugcacugacggcugucagcagucagcuagaaggcucuccuauggauacaagcagccuggcuuccuguaccuuagaggaggcugugggugacacuucagcagcuggcaguucugagcagcccagagcaggcagcuccacuccuggggaugccccaccagcuguggcggaagugcaaggcaggagugaugggucaggggaaucugcccagccaccugaggacagguaagcaugugugggcaaaagaaggguaggauauauuggagggucuuucaaagcacauuucauacucgucaacuaauggacaugcuuguuaugcuggggagauaaagcugguuucugugagaaagggguauuguagcaguguuuuauaaacgagaagacauaauacagacagcaaccugagcaugauuucccucagcuccccaccugcauccucugagagcucuuccaccagagauucugccguggccauuucuggagcagauucccgaggaauccuagaagagccguugccuucaacaagcagugaagaagaagauccccuugcgggugaguuccguguaugcccaggucauccugggauuguuuuggcuucuaguagcccuuggcauggaaaugcccaccagccaaacaguuccauuuagauggagggcauguaugugggaggacugacaauaagcgggggugcugguauggcauaaugaaacggguccagccuuaggagucaaacugaucuuggcucacucaaauucccccacucugccacuucuaccuuuuacaaccuagggucauuauuuaauuucugugaucaugaaugauaccgagggggugaugauaucugcgugguagguuauuuaugaaggguaaguaacagugcaugcagucuagcaaauaacaaaagcuguucugagcccagggaagguggggugggccuucucugugucccaugucuugcaagcagugaagacauauacacugguuucccucaaggagugacauggguuuauuuucuccaaguacauauuaggcaccaauagaggugugagaggcugggcgcgguggcucgugccuguaauccugaaaauuugggaagcagaggucagaggaucaccugaagccaagaguuuaagaccagccugggcaacauagggagaccccaucucuacaaaaauauauauguaaauuagccaggcauuuuggugcaugccuguaaucccagcuacucaagaugcugaggcaggaagacucgagcccaggagcucaacacugcagugaggcaaggguugcaccacuacacuccagccugggcaacagaccaagaccccgucucaagcaauuaauaaggcgugaaucccuuuacauguuauaucucccuucagguaucagucucccugaagguguggaccccucuuuucuggcugcccugccugaugacauccgucgggaaguucuacagaaccagcuaggcauucguccaccaacccggacugcccccuccacaaauagcucagcgccugcagugguggggaauccuggugugacugaagugagcccugaguuucuggcugcccugccuccagccauucaggaggaaguaugugagcgggaaggugguggggccaggcugccuggcaggagaaaugcccucauugacuuuuucugcuccauagguacuggcacagcagagagcugagcagcagcgacgagaacuagcacagaaugccagcucagacaccccuauggacccugugaccuucauccagacucugcccucagaccugcgccguaguguccuagaggauauggaggacaguguguuagcugugaugccaccugacauugcagcugaggcucaagcccugagacgagagcaagaagcccggcagcgacagcucaugcaugagcgucuguuugggcacaguagcaccuccgcacucucugcuauucuccgaagcccggguacagagggaggcaagugggagggcucuggaaagcuuuagccagaugaggcuauguuuucuuaccuuuguauuaccuauauccaguuuacacccucuccacaaucucaguuuucuuuuucuuuccuuccagcuuucaccagucgcuuaaguggcaaccgugggguccaguauacucgccuugcugugcagagagguggcaccuuccagaugggggguagcagcagccauaacagguaccuuugucuauuuuuaccuuaccauaucaccacucaagucuauuagcccagcucccuuaguuuuauagguggagaagcugaaauccugacaggcaggauggauggucucucuaagccauuuccuugaauaagugagagagccagaucuuuggacuccccauucagaaaacuacaccuuuugguuagucuugcuaccaaagaccacaaucgcaaaagcaggccggcagcaggugcuaacuaugguuuuaacaagaaggaacaccacuugucucccaugcaaguaguaaaacaacuaaccaccugccuugaguuuguaacaccuaggcuaaggaaguauagaggagugaguuagccaggcuaaaacagagugggccugacaugccaaaaugugaaaggagugauugguuccuacaaggccacaaacuccugguagucuagagaaggcagaaacuagcauugucuccuagacuuagguauggucagauuuuaccagucgauggaugauaccugggcuggaaucucugcugucuucucagucgccgugugauguagggcaagucacuuaaccuguuugagccucuuguuuaucaucucaaaaaugggugguucucggccaguugucguggcucacaccuauaaucccagcacuuugggaggcugaggcagguggaucacuugaguccaggaguucaagaccagccuaggcaacauggcaaacccaaucucuacuaaaaauacaaaaaguagucgggugugguggcgcgcacuaguaaucccagcuacucgggaggcugaggcacgagaaucacuugaauccuaggggguggagguugcagugagccgguaucacgccacugcacuccagccugggugacagagcgagacuccaucucaacaaaaagcugguggggguggggggcuucauucucuaagcuguacagcagcccugaaaggaugauguacagucauuguaaagugccugguacauaguagacaccuaagagggcagcuguuacuaugaagagcccuuggacuggacacccaccuuucucaagccuccuuggagauaccuagcucauuccccucccccauucuuaugccuaaucccagagcucuagccacugaaguguuacccaaaaaccauguucuguuuccaggccuucuggcaguaauguagauacucuccuccgccuccgaggacggcuccuucuggaccacgaagcccuuucuugucucuugguccuacuuuuuguggaugagccaaagcucaauacuagccgucuacaccgaguacugagaaaucucugcuaccaugcccagacccgccacugggucauccgcagucugcucuccaucuugcagcgcagcagugagagugagcuaugcauugaaacacccaaacucacuacaagugaggaaaagggcaaaaagucgagcaagagcugugggucaaguagccaugagaaccguccccuggaccugcuacacaagauggagucaaagagcuccaaccagcuuuccuggcucucaguauccauggaugcagcccuaggcugcaggacuaauauauuucagauccagcguucaggggggcguaaacauaccgagaagcaugcaagcgguggcuccaccguccacauccauccccaagcugcuccuguugucugcagacacguuuuggauacacucauucaauuggccaaggugaggguuucaaacccaacuccuggggauggaagaaggguggcagcaagagccugggugaaaguugaacacuaagcaggcuagcgugucuuuuugcucuuauuuuaaguguugagcccuguauuguuucuaggggauuguccuauauauuucugggguuuuuucuucauucuuuuccauuuuuauguaugucuuauuuagucaucaaaacaacugggcuguaugauuccuguuuuacagaugaagaaccugagauucagaacauuuuauucauuuugucuuaugauuagaaagugauggagcuggaccuagaauuuaguguucuuucaauaauaagcauugcugccaucuaucaaaggccugccuugugccaggcacugugcaaaauacaucaugucguuuaaucuccaacaacuuugcaaggaaguguaguuaucuccauuuuauaagugcgagacuaaagcucaggaaaaguuugcucgugagucuguauugcuacaaagcccucauucauuucucuaggcugcuuuacugucuguuggauaaaacucuuauaugacauaucccccaauauuuaccaaaauugucugaaggagucugggaaccaguugucuuuucccuaucaggaaggcucauccucugugaagacguccuagaccaagccuuguccuccuuuucccggcagguauuucccagccacuucacacagcagcggaccaaagaaacaaacugugagagugaucgggaaaggggcaauaaggccuguagcccaugcuccucacaguccuccagcaguggcauuugcacagacuucugggacuuauugguaaaacuggacaacaugaaugucagccggaaaggcaagaacuccgugaagucagugccagugagcgcuggcggugagggggaaaccucuccauacagccucgaggccucuccacuggggcagcucaugaacauguugucacacccagucauccgccggagcucucucuuaacugagaaacuccucagacuccuuucucucaucucaauugcucucccagaaaacaaggugucagaagcacaggcuaauucuggcagcggugcuuccuccaccaccacugccaccucaaccacaucuaccaccaccaccacugccgccuccaccacgcccacacccccuacugcacccaccccugucacuucugcuccagcccugguugcugccacggcuauuuccaccauugucguagcugcuucgaccacagugacuacccccacgacugcuaccacuacuguuucaaguaaguguggauguagacugggagcugugggguauauacuguggcacccacuucacccccuuuuccauccagauaguucucccucagugauagcaaucagcuugguuuguguuugugagaacagaauguguucauucucacccucaucugucccaguucucucacucugucucccuuccuccauccccgucucucugugucucucucuuucucucucuccccugccucucacacacacacucuuuugaaggucagcaggcauucacugaauguagcuucccuaggcuaggcaccagaaggaggaaagaaaguuaaguuccauccucagggaauucccagccuuuccaguuguguugagggagccaguucucaugggaaauaguucaagggcgggcaggauacagugugauucagaguaaccagaucaucccaggaaauaaagguaaugagcccugccacagauuaguaagaaagaauuaucugaagaaguagguuuuaaagaauagagugggccaugauggugggggaauaguuggaagaaaugccugggguuucuuuuucagcuuagaaguuacagucauaagaguccucuuugaguuuauggugagacgugauugugccacugcauucuagcuugggcaacagagcgagaccgugucuguaauaaaaaauaaaaagccuuuaucaucccaagucauuuagauuugccuuugguggguggguuuucuuuuucaguacuuucccauuuugaagcccugggcaauucagcgauuccuugauuuugucacuuagucccuggcuugugaguuucagagaggcuuacaguguucugucuguuuccucaaaguuucucccacuacuaagggcagcaaaucuccagcgaaggugagugaugggggcagcagcaguacagacuuuaagaugguguccucuggccucacugaaaaccagcuacagcucucuguagaggugaguccaagcucuucugaucugcuaagacuuggggagaaaggauaaacaggguagauaaugauuuuguucucaggcuggggcuuacuccuucugucuucuuuuucucagguguugacaucccacucuuguucugaggaaggcuuagaggaugcagccaacguacuacugcagcucucccggggggacucugggacccgggacacuguucucaagcugcuacugaauggagcccgccaucuggguuauacccuuuguaaacaaauagguaauagcagaaguaaagcauuuucucuuucugaagguuuccacuuaggugcuuccucuuucuggaauccuuuccugaauccccaagcugaaucagauaccuccauaucccuauaacacagccuccaugcucccucugucguaacacagauuacccuggguuaucaucuguuuuccucugcucaguuguuugaaagcaaggcuggguuugucuccucauccccgcugcccggcacacaguggugcuuaaugaagagaaaagagaacacaugggaacagcagcgccuccuuucuucuccaugcugggcacucguaagagccccauaagacagcugaggcagcuucaccccuucaaaguaugucccuacacugcauucagccucaggaauuacagagucagaauaguacucucugcuuuuguguaauuuugaggguauaaaaauucuaagaacaguuacaaauuaccucguuucuaucaucuuccucccuguuuuacugagaagaaagccaaaacccagggugauaaagugauuggaccaaggaguacagccagguuuucuuucaacauagagucugucuacccugucccacccucaucccaaucaugagucucccuagaucuuggcuacauacuuaguucucucucuccuucacccccaugucccuaagucuggggugauaggagaguugguuggccuguauaacucaggguguucuuugcugcaugaaaauuacaacguucuuccagaaagaauuuggccucugaccuuucucucuuggcugccaccaucuauuccacaccuaugggccaggcacugucuaggcacucuaccauauaauuaucucuuaauugucacagcaacguuaugagguuaggcaguaauauucccaucccaguauuaauauugguuagcaaauuggguaaggggucaagaaauuugccugaaaccaccacagaaccucaguaauuuugagagauauaugggauuucaaccauggucuguuuagcuccagaggagauacuguuucucuucuacaugaaacucauuucaugcagauucagcagaucccuguggccauagguaaauugguagucccaggugacgguucguggacacgcauaauaagcugaacagagcacgauuccagcucacucuagguucucugcagcugagcaaugaagaguggccuaagcaggugucuuagagagauuuggcuuuuagccacuuuaccaggggagucucugaacacuugcugacuccucugccugcucagguacccugcuggccgagcugcgggaauacaaccucgagcagcagcggcgagcccaaugugaaacccucucuccugauggccugccugaggagcagccacagaccaccaagcugaagggcaaaaugcagagcaggugggugguagccacccuuuggcugggggcuugaaucugggauauucuggaagauggcucuugcugguuuccuggucuuuuuuauuucucugggugauuuucguaucuuuccuauacacacuugacccauuuuuuucuacuuccuacuuggaagauuuccuucugaguuuccuuaccccucugguugacaccaggaagccuugcuugcuuuggguguuuauacuuugaugcugucaauauacgcaagccaccucuacacuauccagguuugacauggcugagaaugugguaauuguggcaucucagaagcgaccuuuggguggccgggagcuccagcugccuucuauguccauguugacauccaagacaucuacccagaaguucuucuugaggguacuacaggucaucauccagcuccgggacgacacgcgccgggcuaacaagaaagccaagcagacaggcaggcuagguauggaacuagaguguccaguugaggggaaggguugguggcgguaaagccagauuccuuggaggugcaggacuuaacggccugucuccuuccuguuugaccuuuccaaaaggaaaaugauuauccuuuuuucagaauguugauggcugcauucuacaucucauucaagcuaucugcguaggaaauucauuagggggagugggaauuaagggggaguggaaaucuggcagggaaguugggggccagccuuuugcugaacaagacuuaacucacuaggugcaucuccuuucugcuuccuuggucauuucuaacuaagccguggcuugacaaaucauuuucccuaccucuuuccuccugucccacagaacccucucgcacaaaaccauccgucugucuagcaucaugcccccugcccuuaucuguaaugguaaaucuuagcgccugaugaugagcacucugaagcuuccugagcuaaagcucaaaagaccucagcaagaugcccuguggcagcccaggagauaggagagagaauauugggcuuucccucuuccuauauuuuauaucuugccuuccucuuucucuuucucccagguuccuccgguuuaggcucagcuagcagcauccaggcagcuguucggcagcuggaggcugaggcugaugccauuauacaaaugguacgugagggucaaagggcgcggagacagcaacaagcagcaacgguuagcaugaugccuguggccccucauucauuugucucuccacucauccccccaccaugucaucagugggguuucauugccuuuaccuuguaugcuuuugcauuaaguuugcuauaugaaugcuucuggacaaaaggguuacuuucuguugguguuuuccuauuuguugauugguuuguugguuugauuugauuuaaagcuuggccaucauaccccacucccagcuauccagucaacaguggcgcuuuugcaaacugccugaugcuaaguguugucuggguucugagggguuauggggugaaguuuuuuuucagucccauggaacaaugcagguacaucagaaacaucucaggaauccuaccauugaaagucccccaagcuugguacauaucccacacagccacuucugucuguggcugcucccuccacccugcccucugccuuuauucuccauaaucccuuggcaccuaggcacucaggcacuuuuaggaggaaaccuucagguacuuaaguagccagcucaguguuggggucccggcauugaguggcugcaguaaaagccuggcaucacauguguaugcuguggcacucccucauuguuuuccuguccuugcaacauguaaguuaccuuuccaagauccaagaaagguauccuaagacccgauauuucuuugcguauaauuacuauuauacaguaugguuuuauugaguaggcagggaaaagccuugaacuuaggggcagugacuccaggaagguagaaagggaaaauaaagcuguuauucuggaguauuuuuucugccgagucucuuucccauuacacgaaaagaugucggcuuuuuaaauaaucccgcucaugagagguugcucuaauucuccuauuauuuccccuuuugugagcaaacagaaacaaagagcagaccuaccuuccacccaucugaauuuuuuauacacacacacacacacacacacacacacacacacacacacacacacaacagaagaagacuugaagucuauauacaggaggcuaguucugacuggucacaggucuggauuguagacuguaggaaauguaagcauccaaggagcuguugggaaaagcuuacaaaacacaguggagaaaagcagaagaguugggaaaggcauccuuuuguccuggauagcuacaguuuuccccacccaaauaugggaagcuucuuugcaagcucaauguaugagaaguggaagggccaaccucuagccugucucuaaggaaagcagaguugcacccuuaugugauuuuugucucccuuuuauccagucggagucuagccagucagaggcgucuguccggagggaggaaucacccauggauguggaccagccaucucccagugcucaagauacucaauccauuggucaguacuacuuccuguuuccagccgagcaaaagggauagccagucuucuggaaugucugcugaauccccugcucccagcauauauaagcccaguguuuucccauuuguuccaguaaacccugguuucuguaaaugaugacagguguuugacaaccaaggcacacuuuucuuuccuguaguaaaggaaagaaaauggugggauaucaugcauucagacagcauguuuuuaugggguuuucucuuguuguggugguuguuuuugagacagucucccucugucgccaggcuggaaugcaguggcacgaugucugcucacugcaaccucugccuccuggguucaagcaauucuccugucucagccucccaaguagcugggauuacaggcgcccaccaccacaccuggcuaguuuuuguauuuuuuuuaguagagacgaguuucgccauguuggccaggcuggucucaaacuccugaccucaggugauccaccugucuuggccucccagaguguuagaauuacaggcaugagccacugcgcccagcccagcauguguuuuaaaucuuuuguuuuauuauugaggcagggucuuucuccaucaccuaagcuaagauacaguaacauagucauagcucacugcaaccucaaacuucugagcucaaucgauccuccugccuuggcuaucugaguagcuggaacuguaagggacaggccaccaugcccagcuaauuuuuuuuaucuuuguagaaauggagucucacuauguugcccaggcuggucuugaacuccuggccucaagccauccucucacuucagucucccaugucuucuuucuuucuuuuuuguuuuuugacacagagucuagcucugucucccaggguggagugcaguggugcaaucucggcucacugcaaccuccgccuccuggauucaagugauucuccugccucagccucccaaguagcugggauuacaggcgccugccaccaugccuggcuaauuuuuuuuuuuguauuuuuaguagagacaggguuucgccacauuggccaggcugauuucaaacuccugaccucaagugauccaccugccucggccucccaaagugcugggauuacaggcaugagccacggccgaccagccuuagucucccguguuuuaaaucuuggcucccccauuuacugcuucugggaccugaggcaaaccucuuuguuagguuuccuuguuuaaaauaggaauguucaguuguuaggauuaaaugaguuaaaacauguauagugguuagagaagcacacgaugaaugcuauuguuagcagcauuucucaaagucagucauacauagaauacauuuuggcacccucauaacacauucccauggaauaguauucuuguaggacaaccauuguuauccuaccuuucaucaggauuuggggagauagauauuauuuucguguucuguauucaccuucuuuuaccuaaggucauaugauuugcaaguaccggagccaggauucaaaccuaaggcugucagaaccuugaagaauagucaggauuuggguaaaggaugaacagcaaaggucaggaagaaaccuaagcagggccagguguauggggaucagggguugaugagaaaacagucacuuacuccccacccagaagaugggguugugucuugcugcuuagcuacugagcagagguuagaauaagcccccagugaguaucaggaaaaguaccagccaugggauuccaucugucauaccauggcuucucaggguuuuaaacugccccaggacaagaugacuaauuuagaaggcauuagaaggccgggcgugguggcucacgccucuaaucccagcacuuugggaggccaaggcagguggaucacgaggucaggaguucaagaccagccugaccaacauggugaaaccaagucucuacuaaaaauacaaaaaucagccgggcaugguggcuugugccuguaauuccagcuacucaggaggcugaggcuggagaaucgcuugaacccaggaggcggagguugcagugagccaaggucgcaccacugcacugcagccugggcgacagaacgagacugucucagggaaaaaaaaaaaaaggcauuagacuuaagguuagaaagauuuaguuugauguccuggugcugucuuccucagaaaccaaaaugaggaaaagacagccuacuuuccaaggccagcugucagaauucaaugacaaaaguguccuaaaacauccuguguaaacuggaaggcaaccauccaaagcuccacuguuguuacauuacccugaaauaauccacagauucucuugaaacuagugaggcagugacuagacuagcacuaucuggaucugcaguagcaccuguggcuuuugagcaccuuaaauguggcuagcgcaacugaggaaccagauucauuauuuuauuuauucuguuuaauguaaaugccauccaaugcagguccuagaccuuguuucagauguugcucggugaguaccacucaguggccagugguccccucuacuuguucuguauauuaguuggugcguguggucuagaaagaucuaagcagaagggaaauuuugaagacuuucugacucucuucugugugcccuccagccuccgauggaaccccacagggggagaaggaaaaggaagaaagaccaccugaguuaccccugcucagcgagcagcugaguuuggacgagcugugggacaugcuuggggagugucuaaaggaacuagaggaaucccaugaccagcaugcggugcuaggugaguuguguccuaaaggcccaggucccaacccaguggucugcucuggggcccuuccugccagcuuguuuuucuuccuuccagguuacuccucucccucagugucucuguaaugagaauucaaaagagaaguguuuuuucucugacuucaguauaaaaaagauugaccuucucuuuuaauaguuggugucuuucacuuuauagacaaggggaaucuuuauaacugguuagcuaucccauuuuucuuuggcuucaaggaaguuccucugugacuugauucuaccauauuucccugcaaguucucauuguuucuuuuuuuuuuuuuuuuuuuuuuuuaaaucagaaaugaggucucacuauguugcccagacugaucucaaacugcugggcucaagcaauuuucccaccucggccucccaaagugcugggaucauaggugugagccaccacaccuagccuaguuuucacuauuucuucuuccuuauuuauuuuuauaauuuguuuaugauggcaaagagguuugcauguugaaguuugcagaguaaaauguuacuucuccaucauuccuaacccuagugcuacagccugcugucgaggccuucuuucugguccaugccacagagcgggagagcaagccuccuguccgagacacccgugagagccagcuggcacacaucaaggacgagccuccuccacucuccccugcccccuuaaccccagccacgccuuccucccuugacccauucuucucccgggagcccucaucuaugcacaucuccucaagccugcccccugacacacagaaguuccuucgcuuugcagguacagggaacuuuuaggcugccagguguagaaggcuucauuuuaaacaggauuguuucauacaguuaauccuuaguugaugagagagagagagagagagagagagagaguguguguguguguguguguguguguguacauacacacacccgugcacguaaacccugcaugguuucccuuggccucaggauacucagguuuagaauagaaaugcucagauucacguucacaccucaagggcuggcccuugguuuugacuaguccuuuuagagcccugaaauaaggaagaggaaggaagagagaguugcuagcugguuggcugucuuacagcuucuggggcagaugaugugcuuaauuccugcugucacuucuccccucagagacucaccgcacuguguuaaaccagauccuacggcaguccacgacccaccuugcugaugggccuuuugcuguccugguagacuacauucguguccucgacuuugaugucaagcgcaaguauguguccuggauauugggggguagagggguggugagaacuccccaaaugguaacucgccucugaaguuacucuugaggccacaaauuuccuuuggugacagcacuuggaauggugguggugaggagggaagagacagcuguagcauugauggccaucauaccuaaauacuccugggcuucuccaccccaucugcauuuuucaucagcaaaacagagucacaugauuuuugaaccacacaguuucuaaaguucuguuccauccguuggggguaguacaggaggcacagguggccauagaacacacacagcaggguuccaggggcuuccacaacacuccuggagucaucccuaugccucuccuucuccucgugcauguauacaugcuuaccugcuuguggcagaaaucacaugucacaaucuuugugggcccuuacucaguggagguaagaaaaauuuagaguugguaaugagugaucuaccucucccaacuacugggcauuucccaaacagguguggagcagagaucaaaguguuuggaggauagaaggagcaucauugugggucuucuuccuaaucacacaaacaaauuuguucugccacccuuaauccuaucuuccuuccuuuucuaccucccaagauauuuccgccaagagcuggagcguuuagaugaggggcuccggaaagaagacauggcugugcauguccgucgugaccauguguuugaagacuccuaucgugagcugcaucgcaaaucccccgaagaaaugaagaaucgauuguaagggcccaggaacggagaaaagauggcgggugggagguggggccuccugcacaguagcgauggcuugcucuagccucaaauuuagggaggugcugcccucccuaauaggaauuccccauaggaaucugguuuuagauaaucuuacugaguugucuccuaucuucugggccugcccugcuggcuggcccuuuagcuaagcuacccaacaauucccagacagacaggaaagucuuugguguuuauaaggauauaccugcuggcuuugcaaugagagcuuuaauauugcuauacuaggaaugaccauguaugaguggccuccaccaaacugguaacugcucacuggugauucugaagccaccuagaggagaucagcaguuuguaauacugagcguaggagcugaugagaugaaagaccuauuggaguuguuuaaugauuccuccccaucucuuguggugugggcucuccaacuguguaaucacaagaagucagggagucucccuagacagacuguaugccauguucuuccaccaccaaauaccuuuagagaauuuggacucugggcuuaucccucucuaauaccacuuuucuccccuccccacuucaccuaagcaaggccucauuuauuucucugauaccuuuccuauugguguuuucuggaauaucuguuaaccuugacuauuuugggacaucuccucugucaguggugcuuuuguuugcucccagaucuccaccccauuucugggcuguccuggcacucucuguuuaccucuucaucugacacugcacuccccagacacugcuucacagucucucacucacacaaaugacuggauguauccuggguuuucugcacagcucuuuucugcuucugcuuucuuaugcagguauauaguauuugaaggagaagaagggcaggaugcuggugggcuccugcgggagugguauaugaucaucucucgagagauguuuaacccuauguaugccuuguuccguaccucaccuggugaucgagucaccuacaccaucaauccaucuucccacugcaaccccaaccaccucagcuacuucaaguuugucggacgcauuguggccaaagcuguauaugacaaccgucuucuggagugcuacuuuacucgauccuuuuacaaacacaucuugggcaagucagucaggugaggaugaggcauaguccugggacugucuucaguccugggggucuggucuuuuugugucccauccuugugcuccuucuucccccccacucgcaaaccaugacccuguauaauuguguuuuucuagauauacagauauggagagugaagauuaccacuucuaccaaggucugguuuaucugcuggaaaaugaugucuccacacuaggcuaugaccucaccuucagcacugagguaggucaggaaauccuaaucacagcacaucccagccaaucuggaagauccauuccagguucaccuuagaacuagcacugcgugaccuucucauaguucuaaggaagcaucuugacuucuuaaagcuguagcagguguuugugagugacaucacaaacaggaaaaccagaauuugcaggccauuuccuaguuucaccuuuauuaaaaaaaaaaaaaaaaaaaaacuccaguacauaauuccucauucccaaggguaggucuuuguagaaaaaucguacaaauguaaguggggggaaaaugaaggcaguuaagguuacucuucuccuaaauucuuuuccuaagagauuacauuccguuacauauguuagccauucccuuuucccuuuuaccacugauaguugccuuacucucuucugccuuuuuuguaggucuuagagccaaagaguauuuuccucuuuccuacccaaagccuuucccuauaaggggaguugcgagcuaugaguaguagaaaaagucacuguuuuguauggacuugccucaucucucugccuaggacauggcaagggguuuaggguguguuccuagguaucuaaucccauccuagaugaagucugauauguaugauugguguuuugguuguucuagguccaagaguuuggaguuugugaaguucgugaccucaaacccaauggggccaacaucuugguaacagaggagaauaagaaggaguauguacaccugguaugccagaugagaaugacagguaggggaaauguuccuagaccucuaguugcucaauaugagaagaggucggacuugauucauuugauaggcauguuuuguuuuccucugcuaugacagagccacaaaugccuugcacaaaagacaaaacacuugaucaaaaauacuuaacuuugggcacgguggcucacaccuauaaucccagcacuuugggaggccaaggugggcggaucaguugaggugaggaguuugagaccagccuggccaacauggugaaaccccgucucuacuaaaauaaaaaauuagccaaguguggcagcgugcgccuguagucccagcuacucgggagacugagacagaagaauugcuugaacccgggagguggaguuugcagugagcugagaucgcaccacucuucuccagccugggcaacagagugagacuccaucucaaaaaaaaaaaacaaacccagcuuaacuucacuggacacaguggcucacauuuguaauccuagcacuuugggaggcugaggcaggaggauagcuugagcccaggggguugagacuagccugggcagaauuaaccaguugugguggugcaugccuguagucccagcuaacagugguagaugggagccagaugggggaucucugaccucuacgguugugugaguuuagaagucauuuggcuuuuugguuaucucaccaggagccauccgcaagcaguuggcggcuuucuuagaaggcuucuaugagaucauuccaaagcgccucauuuccaucuucacugagcaggaguuagagcugcuuauaucaggacugcccaccauugacaucgaugaucugaaauccaacacugaauaccacaaguaccaguccaacucuauucaggugagcugcugcuggcaucccuccucauaugguccucuuacccuaggcaacgcuaguuugugugauaccaaauaaaccaguaguacucuuagaggaaguugcauguagaagacagucuaccuauaucuaacucuuuguucuccugaagcauagcagacuucucuuggccgucuuaugaaugaaaggagcuaaagcucaucccacagaagggacuugccucagauaccaaguccaguccuguuuccuagauuccaucccccccacccugcuucuaggagcuuucuaccuaacacuggcuucaugggucccuuccuacagauccagugguucuggagagcauugcguucuuucgaucaagcugaccgugccaaguuccuccaguuugucacggguacuuccaagguaccccugcaaggcuuugcugcccucgaaggcaugaauggcauucagaaguuucagauccaucgagaugacagguccacagaucgccugccuucagcucacacaugguaaaaggaaggguuuguuucuccuuuucagugcuuagguugagcuugcauacuugauguuuucaggacccuacccaagauugggaacacaaauguggcugaguccuggaccuuggguaacucacaauuugguguuucuauggaggugauguuugagaugagaugugcuagacacagugggggcuggggagacacugucagguaaacagcaccacaagagagcaugguguauuccagggccagcgugacuggagcaaggaggaguugcagggagcaaaagucuaaagagcucagcagagguccgauuaccagugacucugaaaaccaccuucaaguuugcacuuuagccuaugggcgagugaggccaggguguuuaaggaggagugacagggucagauuuuugguuuuggugccugauggccaguuugggagccagauaaagggggacauacugggcugagacaagauugggagucaucaagaagcagggaguugguuucuucagggaggggaggggcuggugggcaccaugggaacacacagauuugguuaucugucaucccucaccacaaacugaucuuucuucuuuccuuaguuuuaaucagcuggaucugccugccuaugagagcuuugagaagcuccgccacaugcuacuguuggcuauccaggagugcucugaaggcuuugggcuggccuaauaaggcccugcccaacuccgugggguuuuuuuuaccauuguuggaccuggggaggggggaguuaaaaaaagaaccagaaagaaauugucaaaaaccaauaaaugaaauccaccaacucaccgugugugucccagcugccccaucuuccccagcgcauaccuguuccucuucucauucucuccccgccgccuguuuccucaccuucucuccccuuuccaugccguccaugauccccaccccauguguuuuaaaaaggcaguagccuuugcagggaccugucugucccaacuguuugaacagugugcuccucagauucuguguucagaaggauuugcugcauugagacuugaaaccuuuggauaggggaaaaaauuauauauauauauauuuuuuuguucuguuugcauuucuuaauuugugcuuggaauguguugaugugcacagcuaaugauucaaugcgagacaagauuggcgucuguguuguggagguuucaaauaaagagcacucuucauaacucacuuuucacaauggaguuuuuuucaaacuuaaaaaaaaaaacaaaaaacucuuaagcacaugcuaggcaucuggagaaaagauggauucuccaggaaaccaucccugcccuacccgcuugcccaccugccuccaccacuggugcaacuuccuccuucagagucaguuucugcagucaggagagaugagcaguucaccaggaauugggggugggggcaucuguuuuuuuuuuuuagaaugggagcugcacuuggggauggugaugguguuagagauugcagcccaggacaaagcaucaccuugcucaaggggaacaaacugcagcagguuguacaaaacauucagagagcucacuugacccaaccgaggguuuuacuuggugagccuuucuaguagucuugagucuggggcucaguuuuagauuuuuauuucauuaauguuuguuuauuucuaauaaauuuuaauaagcgaguaauuuaacuaggucgccagaagaccauuauuuuuguuugucuauuuuuguugucgucacucccucucucgucaucugucugccagucuguucacagaucaccuuguagucccuugugguuuuuacuccauccagugcuuaaagcugaucuaaggacuucgaugguuccagccuucaaagaaaaaauaauuuaauaaaaauuuaguuagaaaaaauaac
